United States Patent 10,696,975 (GENES AND USES FOR PLANT ENHANCEMENT) - sequence listing, part 9

SEQ ID NO: 36961 - protein, 605 aa, Legionella pneumophila str. Paris
MFGFISDLLTAAVSSLDELLQDTPAHQIILGTAALYFLYNQYHNPSISRWCRSRNNASMKQRIIDSAYALAKNLPGVNQIIEKELNKELSSTREKLRIQRSGMTLREEIPEEGLSPQDILSAFDVDVEKCHFDFLSVTNDSPEREFLVGRGDGKDSGALYAIHPKELTELLKEVYGATALTNPLHDKWPRINAMQAEVIRWCQNLFHGSKEGYGLLTHGGTTSIIEAMAAYVIRARAKGIDYPEIVVPETAHAAFKKAAELTGAILITVPVDKKTGAVNPNVMSSYITRNTAVMVGSAPSFMNGIHDPISELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIIRLRNAIQKELTALVEEGNGLTSEDIYVYGNPQWSILGFRSNTCNAHFIADELEKRGWKLNLLQNPDGFHLCLTHVHTLVGSFETQFIKDLREAVIDVKNYPPGKKPSGNVKVYGAVGMMPVELQKEICKQYQKARLDFTAASHGSLGIFAPSSTEEDDGLRNRKVGEQKVQTSL

SEQ ID NO: 36962 - protein, 271 aa, Burkholderia xenovorans LB400
MKIAFIGGGNMAAALIGGLIKRGVAAADLYAIDPNEEARKRNEQQFGIRTGAAADAALAAYDAVVLAVKPQILKSVAEAVAPHLNASQLVVSIVAGIRMGDMSRWLNGHSRIVRVMPNTPALIGMGVTGLVATGSVDEAGRALASQLLGAVGETVWFDDEAKIDAVTAISGSGPAYVFYFIEALQEAARQLGMDEAQGRALAVATFTGAAQLAANSDEPPGVLRERVTSKGGTTAAALASFDASGIKDAIVRGALAANARAREMGDEFGKQ

SEQ ID NO: 36963 - protein, 506 aa, Magnaporthe grisea 70-15
MPLLRRGVASEALPGAFSGVGVYIDAGSRYENDYLRGASHIMDRLAFKSTQKHTADEMLEAVEHLGGNIQCASSRESMMYQAATFNQAIPTTVGLLAETIRTPNLTDDEISQQLETAQYEVTEIWSKPDLILPELVHTAAFKDNTLGNPLLCPQERLGSIDRHVISAYRDAFYRPERMVVAFAGIPHMDAVKLTEQYFGDMRGKPPPKAQETSTIALDEAAAAQQQQQQQPGLLSKLPFFKNTSKPTSPSPLPTAPLDTGASHYTGGFLTLAPQPPPLNPNIPNFTHIQLAFEGLPILDDDIYALAALQTLLGGGGSFSAGGPGKGMYSRLYTNVLNQHGWVESCVAFNHSYTDSGLFGIAASCFPGRTASMLEVMCRELRSLTLDKGYSAVTEVEVNRAKNQLRSSLLMNLESRMIELEDLGRQVQVHGRKVPVHEMTRRINALTVEDLRNVARRVVGGMVENPGKGSGAPTVVLQEATAVGVTNKQLTWDEIQNIIRQWQLGRQ

SEQ ID NO: 36964 - protein, 232 aa, Burkholderia xenovorans LB400
MPDLIHNLEAVRQRIATAAHVAGRDTRSIHLLAVSKTFPAEDVRAAYAAGQRAFGENYVQEAITKIEALADLRATIEWHFIGPLQSNKTRPVAEHFDWVHSVDRLKIAQRLSEQRPDNLPPLNVCLQVNISGEASKSGVGIAEAAQVAQAIAALPKLKLRGLMAIPEPAGSIDEQRVPHRQLRELFERLRDGGLALDTLSMGMSSDLEAAVLEGATIVRVGTAIFGARDYSN

SEQ ID NO: 36965 - protein, 418 aa, Cryptococcus neoformans var. neoformans JEC21
MTKCAGCNDKEASRLECPTCKKLGIKGSFFCDQDCFKKNCKGTHKTIHSLVQMAAQVESGKNSSLPPSMRNYRFTGPLRPVYPLSPKRLVPAHIERPDYADHPQGMSACEAVRERTVKSLNKEEIEGMRKVCRLAREVLDLVASHIKPGVTTDELDAICHQACIDRNSYPSPLNYVKFPKSICTSVNEVICHGIPDQRPLQEGDIINLDVTLYHGGFHGDLNATYPVGKVDQESQDLMDTTKKAMDEAIALCKPGVPYREIGNKIEEIIKPKGFGIVRRYTGHGIHHLFHCLPTIVHYGGSKTPGRMEAGQVFTIEPMVNLGTSNLEHWNDDWTAVTSDGRRSAQFEETILITETGVEILTRPPTSSQNKKKKKKKNNGGADAGTATPTENGNGTSGAATPTTEVARGVENLEVEASS

SEQ ID NO: 36966 - protein, 420 aa, Rhodococcus sp. RHA1
MSIEAPRPLLPRRTPRKGSIRTVALLGPAFVAAIAYVDPGNVAANLTAGAKYGYLLVWVLVLANAMAVLVQYLSAKLGLVTGKSLPEMLGTRLRTGNRRAFWLQAEAMAVATDLAEVIGGAIALNLLFGVPLFAGGLITGVVSMGILSIQSRRGQRTFEFVVMGLLTIITVGFLTGLAFTDVSGTDALAGLVPRFEGTETVLLAASMLGATVMPHAIYLHSALARDRHGNDLEGPRLARLLRVTKWDVVGALIVAGAVNIGMLLLAASALSGIPGTDSIDGAHAAIQSSLGPTVAVIFAVGLLASGLASTSIGCAAGSEIMYGLLSMRIPLLLRRVVTLIPALVVLAVGVDPTFALVLSQVVLSLCIPFAVIPLVRMTSSHDLMGVHRNATATTVAAWVAASLIVVLNVSLLWLTFTGSA

SEQ ID NO: 36967 - protein, 99 aa, Nostoc punctiforme PCC 73102
MATYKVTLKTPDEEKTIEVSEDDYILEIANEENDMDLPYSCNAGSCSTCAGKLISGTVDQSDQNFLDDDQIDAGWVLTCVAKPTSDCVILTNQEDELNG

SEQ ID NO: 36968 - protein, 570 aa, Oryza sativa Japonica Group
MAASSRHGPFINWSDGLFLFLSSSSSRNRFLRVFLPFPDPSTMMAGLEVATTAVTGGDASLVVVVGVLFLMVAVVVMTRLGDGGAAPSPPAMPVLGHLHLIKKPLHRSLAEVAARVGAAPVVSLRLGARRALLVSTHAAAEECFTACDAAVAGRPRLLAGDVLGYGHTTVVWASHGDHWRALRRLLGVELFSNARLAALAADRRAEVASLVDAVLRDAAAGGGGGGTVTLRPRLFKLVLNVMLRAVTARRHAGDETRRFQEIVEETFAASGSPTVGDFFPALRWVDRLRGVVATLQSLQKRRDAFVAGLVDDHRRTRRAAAAAADKDQKKNGIIDALLTLQETDPDHYTDNVVKGIVLVLLTAGTDTSALTTEWAMAQLVAHPEAMTKVRAEIDANVGAARLVEEADMASLPYLQCVVKETLRLRPVGPVIPAHEAMEDCKVGGYHVRRGTMILVNAWAIHRDGDVWGSPEEFRPERFMDDGAGAGAVTAVTAPMLPFGLGRRRCPGEGLAVRLVGLTVAALVQCFDWEIGEGGAVDMAEGGGLTMPMATPLAAVCRPREFVKTVVSDCF

SEQ ID NO: 36969 - protein, 382 aa, Escherichia coli
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGSAEDAAKRGHLTASTVIQYRGAIIPREAMPA

SEQ ID NO: 36970 - protein, 392 aa, Synechococcus sp. WH 7803
MKAMILAAGRGTRVQPITHVIPKPMIPILQKPVMEFLLELLKEHGFKEVMVNVSHLAEEIENYFRDGQRFGVEIAYSFEGRIEDGELIGDALGSAGGLKKIQDFQRFFDDTFVVLCGDALIDLDLTEAVRRHREKGAMASLITKRVPKDQVSSYGVVVSDQEGQIKAFQEKPTIEEALSDTINTGIYLFEPEIFDHIPSGQSFDIGSDLFPKLVELGAPFYALPMDFEWVDIGKVPDYWQAIRSVLQGEVRQVGIPGKQVRPGVYAGLNVAANWDRINVQGPVYVGGMTRIEDGATLIGPSMIGPSCHICEGATIDNSIIFDYSRIGAGVQLVEKLVFGRYCVGRNGDHFDLQEAALDWLITDARRQDLVEPSPQQKAMAELLGTDLTAPAS

SEQ ID NO: 36971 - protein, 455 aa, Oryza sativa Indica Group
MAAARAHVKDPAHRTKVVLRRLPPAIAQQAVVEQVDARFGGRYDWSCFRPGNASQKNHRYSRLYLNFKGPEDVVEFAEVFNGHVFVNEKGAQFKALVEYAPSQQVPKSNTKKDARQGTIMKDPEYLEFLESISKPAEHLPSAEIQLERKEAERAAAGKEPPVVTPLMVYVRQQRAAKSMAQQYVLRENAKEKPTYILVPKRDEHAQREKDATSGGISGSAHVAENKKEKIVLLKGRARVDSNTSDVTSQQQSGTPMKNAAQSSSRQDPRLEGSGRIIKTILSNKEGRHVVTSQHDQEGHIITAEKRPPRIPNPRSVVKDQVVENAEKNHLDDKHSHLHGSGLISEKTERHARNRDRPDRGVWAPRRYDKSASGGTHSSSSEFSPMQQHSGENFCQQADGHRHANRRGPPRGLKEMEISASTSDGKPSKRASANYGAHEILIKTNIASCGVLDFAA

SEQ ID NO: 36972 - protein, 794 aa, Ralstonia eutropha JMP134
MTNQANNGAYVQPFEQLRMQDVETVGGKNSSLGEMISQLAEAGVRVPGGFATTALAFRDFLAHNDLTARISDRLKALDVDDVKALAEAGAEIRRWVVEAPFQPRLEQEVREFYARAAEREGAEASFAVRSSATAEDLPDASFAGQQESYLNVSGIDDVLDKIKHVFASLYNDRAISYRVHKGFAHDVVALSAGVQRMVRSDLAASGVMFTIDTESGFPDVVFITSSYGLGETVVQGAVNPDEFYVFKPTLQAGKYPIIRRSIGSKLIKMEFTKPGEAGRVKTVDVPAELRNRYSITDADVAELAKYAMIIEKHYGRPMDIEWGKDGKDGKIYILQARPETVKSQSAGKAEQRFKLKGTAPVLTSGRAIGQKIGTGPVRVINDPSEMERVQPGDVLVADMTDPNWEPVMKRASAIVTNRGGRTCHAAIIARELGVPAVVGCGDATDILKDGTLVTVSCAEGDEGRIYDGLLETEVTEVQRGEMPEIAVKLTMNVGNPQLAFDFAQIPNSGVGLARLEFIINNNIGVHPKAILDYPQVDADLKKAVESVARGHASPRAFYVDKLAEGIATIGAAFYPKPVIVRLSDFKSNEYKKLIGGSRYEPDEENPMLGFRGASRYIAEDFAEAFEMECKAMKRVRDEMGLTNVEIMVPFVRTLGQAEKVIDLLAKHGLKRGENGLRVIMMCEVPSNAILAEQFLQYFDGFSIGSNDLTQLTLGLDRDSGMELLAKDFDERDPAVRFMLSRAIQACISQNKYVGICGQGPSDHPDFAAWLVKEGIKSISLNPDSVVDTWQQLAS

SEQ ID NO: 36973 - protein, 188 aa, Azoarcus sp. EbN1
MLLMIDNYDSFTYNLVQYFGELGADVKVYRNDEITLEQLALMKPAQLVISPGPCTPAEAGISVAAIREFAGKLPILGVCLGHQSIGAAFGGRVVHAQRPMHGKTSPVLHEGQGVFRGLPNPLTCTRYHSLAIERDSLPDCLEITAWTEDGEIMGVRHRTLAVEGVQFHPESILSDHGHQLLRNFLEQN

SEQ ID NO: 36974 - protein, 842 aa, Pseudomonas putida GB-1
MINSVCRMRLSTFCHICRAYFPGTGHKRPAKSQKTGGRLLSFSNTVSGEITLVEYVVSLDKLGVHDVEHVGGKNASLGEMISNLAGAGVSVPGGFATTAQAYRDFLEQSGLNDRIHAALDALDVDDINALTKTGAQIRQWVMEAEFPARLDSEIRTAFAEMAAGNDNMAVAVRSSATAEDLPDASFAGQQETFLNIRGVDNVIRAAKEVFASLFNDRAIAYRVHQGFDHKLVALSAGVQRMVRSETGTAGVMFTLDTESGFRDVVFITGAYGLGETVVQGAVNPDEFYVHKNTLQAGRPAILRRNLGSKAIKMVYGEEAKAGRSVKTVEVDRAERARFCLSDDEVSELAKQAMIIEQHYQRPMDIEWAKDGDDGKLYIVQARPETVKSRSSANVMERYLLKEKGTVLVEGRAIGQRIGAGKVRVINDVSEMDKVQPGDVLVSDMTDPDWEPVMKRASAIVTNRGGRTCHAAIIARELGIPAVVGCGNATQVLKDGQGVTVSCAEGDTGFIFEGELGFDIKQNSVDAMPELPFKIMMNVGNPDRAFDFAQLPNAGVGLARLEFIINRMIGVHPKALLNYAGLPADLKDSVDKRIAGYNDPVGFYVEKLVEGISTLAAAFYPKKVIVRLSDFKSNEYANLIGGKLYEPEEENPMLGFRGASRYISESFRDCFELECRALKRVRNEMGLTNVEIMVPFVRTLGEASQVVDLLAENGLARGDNGLRVIMMCELPSNAILAEEFLEYFDGFSIGSNDLTQLTLGLDRDSGIIAHLFDERNPAVKKLLANAIAACNKAGKYIGICGQGPSDHPDLAKWLMEQGIESVSLNPDSVLETWFFLAEGQGAA

SEQ ID NO: 36975 - protein, 338 aa, Pseudomonas sp. ACP
MNLQRFPRYPLTFGPTPIQPLARLSKHLGGKVHLYAKREDCNSGLAFGGNKTRKLEYLIPEALAQGCDTLVSIGGIQSNQTRQVAAVAAHLGMKCVLVQENWVNYSDAVYDRVGNIQMSRILGADVRLVPDGFDIGFRRSWEDALESVRAAGGKPYAIPAGCSDHPLGGLGFVGFAEEVRAQEAELGFKFDYVVVCSVTGSTQAGMVVGFAADGRADRVIGVDASAKPAQTREQITRIARQTAEKVGLERDIMRADVVLDERFAGPEYGLPNEGTLEAIRLCARTEGMLTDPVYEGKSMHGMIEMVRNGEFPEGSRVLYAHLGGVPALNGYSFIFRDG

SEQ ID NO: 36976 - protein, 254 aa, Magnaporthe grisea 70-15
MSTPSPPRRIVGVSTKMYFSAARTSSYITSLLSLLPSVPSNTDVFVIPDHVTLLPSIQQLRAASSPILPGAQDCYSEDAGAYTGEVSPAVLAEVGCRIVELGHAERRRLFAETDASTAAKAAAVVRNGMIPLVCVGETARQAEISAAVADVAGQVQAVMAAVPGSAEVVLAYEPVWAIGAAQPAAAEYVVSVARGIRELECVRAREGTVRILYGGSAGPGLFEKLKDGVDGLFLGRFAHDPEQFVRTIREVSEA

SEQ ID NO: 36977 - protein, 185 aa, Zea mays
MQNPSGHHTATAAPSSAPSKGKSSAPNPSGNHAATPAPSGTPSKGKSAAAQAAALGHGSSSHHHSAGGGGGGADASATTLKRKRGVFQKDLQHMMYGFGDDPNPLPETVALVEDIVVEYVTDLVHKAQNVASKRGKLLTEDFLYLIRKDLRKLHRATELLSMNEELKQARKAFDVDEETLATTNI

SEQ ID NO: 36978 - protein, 498 aa, Proboscidea louisianica
  misc_feature (1)..(15): Xaa can be any naturally occurring amino acid
XXXXXXXXXXXXXXXEKKNLGRIVQIIGPVLDVAFPPGKMPNIYNALVVKGRDTVGQPINVTCEVQQLLGNNRVRAVAMSATDGLMRGMEVIDTGAPLSVPVGGATLGRIFNVLGEPVDNLGPVDTRTTFPIHRNAPAFIQLDTKFSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 36979 - protein, 332 aa, Myxococcus xanthus DK 1622
MSLPMKATALAHPNIALVKYWGKRDDALILPHQSSLSLTLSPLSVTTTVEFGAASDQVELNGHTAKGSERDRVLRLLELVRAQAKADLGPAKVVSRGDFPMAAGLASSAAGFAALAVAGRAAAGLPSEPRAASILARMGSGSACRSVQGGFCEWQRGERPDGEDSFAVQRFDAAHWPDVRMVVAILDRGEKEVKSRDGMKLTVDTSPYYPAWVKDAEVEVVQVREHIARRDLQALGELCERNAWRMHATSFAANPPLSYMSPGTLALILHLKEQRKKGIPVWFTLDAGPNPVLLTDAAHEVAAEALARACGALDVIRCVPGGDAELKAEHLF

SEQ ID NO: 36980 - protein, 375 aa, Cryptococcus neoformans var. neoformans JEC21
MSIPTEKPAGPSAFTPYLDAVANVFHPVSGPVLNTYAKFHGWKENMGLVQPGTVENLTRDAQQVQLANWMFDGARADVAKVISGNPAFQLTHSFSLGSTTRPAAYNFGVIFANAKTFLQGGLDGSGSLTMRANQTWSARDLSKIQAQVTDKPGHTMVQFEHDHIGDHYTFSWKSINPNLLDFTGIHMASLLHSVSPRLSLGFETVIQYPEPAILQTATSYVAKLTSLPNPVAALTPTTPGLPSPFVPSWIATGHLQPDGNVQATYYQKLSDKVDVALDFQTILRPQSMLGPAKREALTTLAAKYDFRMATFRGQIDSAGKVGMYLEQRFTPAFAFLVAGEIDHAKNASKFGVGIMIESSTMTQEEMIAAGMLTPV

SEQ ID NO: 36981 - protein, 498 aa, Panax quinquefolius
  misc_feature (1)..(5): Xaa can be any naturally occurring amino acid
XXXXXTTSGSGVSTLEKKNLGNITQIIGPVLDIAFPPGKMPNIYNALVVKDRDTVGQQINVTCEVQQLLGNNRVRAVAMSATDGLTRGMEVIDTGAPLSVPVGGTTLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 36982 - protein, 193 aa, Rhodococcus sp. RHA1
MQQDSAARQEENTVREPHVVAIDGRSPRAEKSTWVAPTAAVIGATTLGAETSVWYGAVLRADCDSITLGEGSNIQDGVAVHVDPGFPVVVGRDVSVGHNAVLHGCTVGDGALVGMGATVLNGAVIGEQSLVAAGALVLEGTRIPPRSLVAGVPAKVRRELTDDEVAHNAANAAVYRQLAQQHRSADVTTFDIA

SEQ ID NO: 36983 - protein, 193 aa, Picea sitchensis
MASAIMSSAAAMAAVAAPPKTSNGNGSSNGNVVAAFTGLKSTAQFPSSMKISNAGAEWERKTTSNGGRVRCMQVWPPYNNPKFETLSYLPRLTQEQLLKEVEYLLRNKWVPCLEFDEDGIIKRKYGSTPGYYDGRYWVMWKLPMFGCTEASQVLNEVNECAKAYPKAFIRVIGFDNVRQVQCISFIVHKPEYN

SEQ ID NO: 36984 - protein, 329 aa, marine gamma proteobacterium HTCC2080
MSLHYLVTGGAGYIGSHLVLALVEAEHRVTVLDDFSTGHRWATEGHEVIEVDIRDLAALRSALLHRHFDGVFHFAAKSLVGESGQKPLLYYQNNVSGTANLLEVALESGWGHCVFSSTAAVYGSPQARVIAEEHPLNPVNVYGETKLAMEQMLSAVHKQGAMQAVCLRYFNAAGAAPDAHRGEWHEPETHLIPNILRKAAGEDRALTIFGDDYDTPDGTCIRDYIHVLDLAQAHLKAMTMLHREGGFHTLNLGSEAGYSVREILEACETTVGRPITHEIGPRRRGDPARLVADASRAGQILDWRATRSLGEIVESAWLWEQERQNLQAR

SEQ ID NO: 36985 - protein, 214 aa, Nostoc punctiforme PCC 73102
MEQPKVIFLDAVGTLFDVKGSVGKVYSQIAEEFGVTVPAETLNKAFIKSFKAAPPPIFPDAELQDIPQREFDWWRIIALNTFESAGVLKEFSDFSAFFSELYIHFGTGEPWFVYPDVLPALINWRRLGVTLGVLSNFDSRIYSVLQSLGLREFFTSVTIATQVRAAKPDPQIFAIALDKHKCSPEAAWHIGDSVVEDYYAAKAAGLRGVWINRG

SEQ ID NO: 36986 - protein, 379 aa, Bradyrhizobium japonicum USDA 110
MVRIDSEGIIAKPFDRQFAGGLGSVAYRMPPLSFAPDPSWKGRVINALGAPLDGQGPLTPGSRAVSAEAEAPSAMKRARVHKPLRTGVRVIDLFAPICAGQRVGIFAGSGVGKSTLLAMLARSQGFDTVVLALVGERGREVREFIEDVLGANRNRAVTIVSTGDESPMMRRLAPKTAMAVAEYFRDRGESVLLVVDSITRFAHAAREVALAAGEPAVARGYAPTVFTDLPRLLERAGPGEEGSGTITGIFSVLVDGDDHNEPIADTIRSTLDGHIVLSRHIADQARYPAVDVLASVSRLAHNVWDPEERELVSKLRTMIAKYEDTRDLRLMGGYQSGRDSGLDQAIDLVPRIYSAMRQDASAQPSADPFRELRDMLKGE

SEQ ID NO: 36987 - protein, 436 aa, Haloferax mediterranei
MGLVKMTRWRTLVLATAAFNLSFLIWFSFAPFTGQIAAEFGLSLTDLGILASAHLVGPPGRILTGWLSDRFGASTVFGIVLAYVGIFSMASAFATSYEVFFVERVVVASAGITFVVGIQHVSQWFPEEELGTAEGIYAGIGNAGAAGGALILPRAFGNWSGPLFSTGWRAAFFYTGVVAILMAIVYVVFGQDAATKARAAATSESATLSTWVHTATRYGVVALALGYVMSFGLEISMNGWLPTYFREGFGSNLVIASTFAATFSLAAGLLRPIGGYVSDRLVRDQRDILPFFAGRYREQWTVLCMTFIVVSMTGLTFAGQTGNVLLTVAAGFLVGMSCAFTEGAIFAQVPAMFPNRSGAAAGIVGGIGTFGGIGFPLVYSFAAAEGMIHTGYVIVAALMIPILALNAFISRPHIASRAHVDGFFDGSRFESSQSDD

SEQ ID NO: 36988 - protein, 344 aa, Bacteroides thetaiotaomicron VPI-5482
MKERILVTGGTGYIGSHTVVELQNSGYEVIIIDNLSNSSADVVDNIEKVSGIRPAFEKLDCLDFAGLDAVFAKYKGIKAIIHFAASKAVGESVEKPLLYYRNNLVSLINLLELMPKHGVEGIVFSSSCTVYGQPDELPVTEKAPIKKAESPYGNTKQINEEIIRDTIASGAPINAILLRYFNPIGAHPTALLGELPNGVPQNLIPYLTQTAMGIREKLSVFGDDYDTPDGSCIRDFINVVDLAKAHVIAIRRILEQKQKEKVEVFNIGTGRGVSVLELINGFEKATGVKLNYQIVGRRAGDIEKVWANPDYANQELGWKAVETLEDTLRSAWNWQLKLRERGIQ

SEQ ID NO: 36989 - protein, 759 aa, Rhodococcus sp. RHA1
MSILGNEKAPPSGAPAPGPTLGERLRDNARYDLPASLVVFLVALPLSLGIAIASDAPIMAGLIAAIVGGVVAGSIGGSPLQVSGPAAGLTVVVAELVATFGWKATCAITVAAGFLQIIFGLSRIARAALAIAPVVVHAMLAGIGITIALQQIHVLLGGSSHSSTVENITQLPGQLTSARYSDVLVGSVVIAVLLFWKKIPGKLQVLPGPLVAVVAATVLSLVFPLDIDRITLDGSLFDAVALPSMPEGPWLAVATGVLTVALIASVESLLSAVAVDKMHGGTRSEFNRELVGQGSANMISGLIGGLPVTGVIVRSSTNVAAGARTRASAVLHGVWILVFAALLTGLVEQIPMAALAGLLIVIGIQLVKMAHLRTARRTGDLWVYGVTVAGVVFLNLLEGVIIGLALAVVLLLWRVIHPKMRAEPVGSEDSGRWRVTVEGSCSFLSMPALTGLLAKVPEGAHVTVELAVDFLDHAMFEAIDDWKRHHERNGGTVVIDALGPVDMDAVGVSPPRRGIGVVSPRGFAPWKSWQPRHSDTAESTTTPAALRPVLAGVSEYHRRNAAQLQPHLDELRDGQRPDSLFLTCSDSRIVPNVITSSGPGDLFTVRNVGNLVPTGKQDVSVEAGLAFALDELEVSSVIVCGHSGCGAMKAVLANAQPENDGSDRDAVEQWLTFAQPSRNAFLSGHPVARAAAELGFDEVDQLGMVNVAVQVQTLGRHPLVGAAAAEGRVRVAGMFFDIPSARVLEITSTGVSYLDHVPT

SEQ ID NO: 36990 - protein, 381 aa, marine gamma proteobacterium HTCC2080
MPMSVTLFKQHFGVSPQGTASAPGRVNLIGEFTDYNDGWVLPCALQFRCHVAWRRREDNTITAVSREYPDQIDNFQACDDYQPSNLPWANYIRAIVAALQSEGYVTKGIDLALWSDVPQGRGLSSSAALEIALLGALNSAFDWNIDGAKIAKLGQLSENAYIGCQCGIMDQLISTKAQPGAALLLDCQSLEASSVTIPGQWSIVILDSNYPRKLVDSEYNARRADCEAACVAMAIPSLRAANTEQLAACRDKLTTQQYLRAAHVLGENQRVKTTAAALQQADLAAVAEQLAQGHNSLANRYEVTVPATDTLVAIAKAELGNRVAARQTGGGFGGAVVCLCHRDDVPQLLSAVERNYTQKTGLKATTFVCEAGAGLEVNNNG

SEQ ID NO: 36991 - protein, 397 aa, Burkholderia thailandensis E264
MVRSSHAAATGGDIRATNGILPTMPAMPHHAGCLTDSQFQQRNSMILVTGGAGFIGANFVLDWLAQSDEAVLNVDKLTYAGNLGTLKSLQGNPKHVFARVDICDRAAIDALLAQYKPRAILHFAAESHVDRSIHGPADFVQTNVVGTFTLLEAARQYWSALDADAKAAFRFLHVSTDEVFGSLSPADPQFSETTPYAPNSPYSATKAGSDHLVRAYHHTYGLPTLTTNCSNNYGPYQFPEKLIPLMIANALGGKPLPVYGDGQNVRDWLYVGDHCSAIREVLARGVPGETYNVGGWNEKKNLDVVHTLCDLLDEARPKAAGSYRDQITYVTDRPGHDRRYAIDARKLERELGWKPAETFETGLAKTVRWYLDSQEWVDEVASGDYRKWVETNYAQRA

SEQ ID NO: 36992 - protein, 321 aa, Picea sitchensis
MISVFTRRGGRFIEEAAAALSVSAMAAAIGGGGPQVSASASECWSTPQALQQQKIDISRRRRGIEGGRRRCLSTIASASTTETKEMSGGGEQEWYDKYRRSLYGGLTHKALLVDAVGTLVLPSQPAAQIYRNIGLKYGVCYSEDEILSRYRWAYQQPWPNTRLRFMDDARPFWQFVVQNATGCSDSRYFEELYEYYTTDQAWHICDPEAGKVFEALRRAGVKLAVVSNFDTRLRPLLQALKCEHWFDALAVSAEVEAEKPNPTIFWKACEFLGVEPEDAVHVGDDRRNDIWGARDAGCDAWLWGADVHSFKEVAQRIGVVV

SEQ ID NO: 36993 - protein, 319 aa, Arabidopsis thaliana
MAPVLQSSQPWVEKYRPKQVKDVAHQEEVVRVLTNTLQTADCPHMLFYGPPGTGKTTTALAIAHQLFGPELYKSRVLELNASDDRGINVVRTKIKDFAAVAVGSNHRQSGYPCPSFKIIILDEADSMTEDAQNALRRTMETYSKVTRFFFICNYISRIIEPLASRCAKFRFKPLSEEVMSNRILHICNEEGLSLDGEALSTLSSISQGDLRRAITYLQVVPLEVVNKLFTACKSGDFDIANKEVDNIVAEGYPASQIINQLFDIVAEADSDITDMQKAKICKCLAETDKRLVDGADEYLQLLDVASSTICALSEMAQDF

SEQ ID NO: 36994 - protein, 542 aa, Escherichia coli
MIAVVKLLPTGEDFASHVYPCYTSHRKETIMTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 36995 - protein, 586 aa, Haloferax mediterranei
MASKKEQWKSDLYGDAVRDELEAFAEEGFESIPEDERDKWFTRFKFWGVFQQRTGQESYFMMRLTNANGVLEPGQLRTIAEVARDYATGPVDNPEFGNGWVDLTTRQSIQLHWLELEDIPEIWEQLESVGVTSRSAGGDTMRNITGCPVAGKDTHELVESKPLLDRFQSELREDNALSNMPRKFNISVTGCREGCAQDSINDIGWNPPGKRSTERLFTGFNVRVGGGLGSRKPRVARSLDVFVADEERAYEVVRGFVELYHDHGNRDVRARARSRFFVDDWGTEKIRDRLESEYLDFELQSAGEDIRDEYTYNAGRPQSAGKSDHVGVHEQSDGRYYVGLSVAVGRLTAADALELADLADKYGSGQIRLTRRQNPIVMDVPAGALDDLLAEPLLSKHTPEPNPFQRGTVACTGTEFCSLALTETKARTARMLRWLRDNVEVPDDVHQLKIHYSGCTADCGQANTADIGLFGMRAQKDGEMVEAMDIGVGGGIGDEPSFVEWIHQRVPADEVPGAIASLVEAFAAHRTAGQTFRQWVEAEGPDAVAEYCEPIETDFEAPYMHDAKQSWYPFADEDEPPKTEQPMTSD

SEQ ID NO: 36996 - protein, 418 aa, Bacteroides thetaiotaomicron VPI-5482
MMKNIFQDLKRKDHKRYLGGLDVFKYIGPGLLVTVGFIDPGNWASNFAAGSEFGYSLLWVVTLSTIMLIVLQHNVAHLGIVTGLCLSEAATKYTPKWVSRPILGTAVLASISTSLAEILGGAIALEMLFDMPIMWGAVLTTLFVSIMLFTNSYKKIERSIIAFVSVIGLSFIYELFLVEIDWPAATMGWVTPAFPKGSMLIIMSVLGAVVMPHNLFLHSEVIQSHEYNKKDDASIKKVLKYELFDTLFSMIVGWAINSAMILLAAATFFKSGIQVEELQQAKSLLEPLLGSNAAIVFALALLMAGISSTITSGMAAGSIFAGIFGESYHIKDSHSQVGVILSLGIALLLIFFIGDPFKGLLISQMILSIQLPFTVFLQVGLTSSRKVMGNYVNSRWSTFVLYAIAVIVSVLNIMLLFS

SEQ ID NO: 36997 - protein, 354 aa, Gordonia sp. TY-5
MSALMKTFTMLEVGKTAIVEKPIPTPGPNEALVKTTAALICTSDVHTVKGALPVENGRTLGHESVGVIAALGSAVTGFTEGQRVAVNAVTPCFECSYCQRGFTSQCGGLLGGYKYTAQVDGNMAEYFLVPAAQGNLAPIPDELSDDAAVYACDMLSTGLMGAEHAQIEIGDTVAIFAQGAVGLCATIGAKLRGAGRIIAVESRPERIALAQRFGADDIVDFTDGDPVAQIMDLTGGVGVDASIEALGFPQTFEAALACLKAGGTLSNIGYHGENPAPLPLDLTAWGLGMGDKTIRTGLCTGGSDRMSRLFTLMTTGKVDPTVMTTHRFGFDDVEEAFVMMAEKRDNIVKPLITF

SEQ ID NO: 36998 - protein, 519 aa, Nocardioides sp. JS614
MVTSSSPFVSLAGARVLADGGTAIDATLAMAAVAWMVLPGQCGLGGDAFAIVREPDGEVWTVSGSGFGPDGGTPELYAGLGLDALPLTGPHAVAVPGAPAAVRTLQGRATRGLDELWAPALRLAREGVAASAKTRADVGEFAAALDADPGARAAFLPGGVPPEVGARLRQADLATTLERLAADPDAFYTGWFADRAVEHLVASGAPYSGAEWAAVAHAPVAPAIATAYGGARLHQTPMPSAGWMVLQQAALCDGELVGSEQLGAPAVHWLAEAAAAAFRDRFASCGSDTDAWQRTLDPAALERTRAAIRSRDRVGPAPMRVAGDTTSTVCVDADGRAVSFIHSLGFTFGARLSVPGTGVILNNRLGRGAYLIDGHPNEVRPRRKPLHTLNAWLLDEPGVGLLHAGNCPGGDGQVQWNMQVISHLVDHGDDPQRAVSLPRFTVFPGSDADVVGRRRELRCEGGIPATTLETLGAWGHDVVPVPVQVGGPGGSALAISMDHRHGCVRAGADPRMEGVALAV

SEQ ID NO: 36999 - protein, 242 aa, Oryza sativa
  misc_feature (125)..(125): Xaa can be any naturally occurring amino acid
  misc_feature (208)..(208): Xaa can be any naturally occurring amino acid
MSKEVSEEPEHVRPKDYTDPPPAPLFDVGELRLWSFYRALIAEFIATLLFLYITVATVIGYKVQSSADQCGGVGTLGIAWAFGGMIFILVYCTAGISGGHINPAVTFGLLLARKVSVIRAVMYIXGAEIIGTFVLVYTVFSATDPKRNARDSHVPVLAPLPIGFAVFMVHLATIPITGTGINPARSIGAAVIYNQKKAWDDHWIFWAXGPFIGALAAAAYHQYILRAAAIKALGSFRSNPSN

SEQ ID NO: 37000 - protein, 273 aa, Thermobifida fusca YX
MPQSDLKALLSVAHHAVDAAVDYVLSQPVTGIRSKGGREIVTDIDEAVEHLVRDRLLRDTPDLGFLGEETGATGDSATYWVLDPVDGTTNFSHGLPLNAVALGLIHDEQPVLGVIALPFLGRRYWAARGHGAYRDHTQITVSETTDISRALVALSSYGGWADFPVRDLLSAELDRVLSARAQGVRRLGATAVDLVFVAEGALDVSVTLGNRPWDTAAGTVIAREAGAVVVDSDGSPHTLRSKCTVAVTPGLRDAVLPLLAVARHTPYWPAAAD

SEQ ID NO: 37001 - protein, 519 aa, Thermobifida fusca YX
MGAESYFQKLVDDLAAVRSTVVAGDPRATERQRSLGKLTVRERIDLLLDKDSFHEIGSFRRHRSVGFGIENKRPHTDGVVTGWGRVYGRKVFVYAHDFRIFGGSLGEAHAEKIQKIMDLAYEAGAPVVGLNDGAGARIQEGVGALAGYGGIFSRNVRASGVIPQISVILGPCAGGAAYSPALTDFVFMVRGIAQMFVTGPDVVRAVTGEEITQEELGGADTHSSVSGVAHFAYDNEHACLTDVRYLLSLLPSNNRELPPHLPTDDPPDRPCTRISSIVPPDPAKPYDVRDVIADIVDEGDFFEVHEAWAPNIVCALARLDGHVVGVVANQPTHLAGVLDIHASEKAARFVQFCDAFNIPLVTLVDVPGFMPGTAQEHGGIIRHGAKLLYSYCNATVPRVQVVMRKSYGGAHIVMDSLSIGSDISLAWPTNEIAVMGAEGAANVVFRKEIAAAEDPDAVRARKIAQYREELMHPHYAAERGFVDELIDPAHTRAALISALAALRGKHAERPDRKHGNQPT

SEQ ID NO: 37002 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSAARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTANGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 37003 - protein, 91 aa, Zea mays
MAVTITWVKARQIFDSRGNPTVEVDVGLSDGSYARGAVPSGASTGIYEALELRDGGSDYLGKGVLKAGSNVNNIIGPAIVGKDPTEQDEID

SEQ ID NO: 37004 - protein, 307 aa, Saccharomyces cerevisiae
MSSDAKQQETNFAINFLMGGVSAAIAKTAASPIERVKILIQNQDEMIKQGTLDKKYSGIVDCFKRTAKQEGLISFWRGNTANVIRYFPTQALNFAFKDKIKLMFGFKKEEGYGKWFAGNLASGGAAGALSLLFVYSLDFARTRLAADAKSSKKGGARQFNGLTDVYKKTLKSDGIAGLYRGFMPSVVGIVVYRGLYFGMFDSLKPLVLTGSLDGSFLASFLLGWVVTTGASTCSYPLDTVRRRMMMTSGQAVKYNGAIDCLKKIVASEGVGSLFKGCGANILRSVAGAGVISMYDQLQMILFGKKFK

SEQ ID NO: 37005 - protein, 398 aa, Myxococcus xanthus DK 1622
MSLMPPHAALPVARVTPKGARSLRHFNPWVYRTEIAAPPDVKGAGAVVLVVDSQGNPIGQALYARRSPLALRLLTRKGPAEEPVDDAFFRRRLEAALARRAYLSGRDGLRLVHGEADQLPGLFVDRYGKGLTLQTLSEGMDARKETLAKMLVELTGATHVMCRDDASGRDFEGLPREARLLHGEGAARFTYHEGENRFEVDLQGDMKTGAFLDQVDNHLRAGELARGDALDLFSYHGGFALSLSRTCTSVLAVEQDEKAAARAKANAEANGRANVTVENANAFDVLRRFDTSGRRFDTVVLDPPGLAKRREGLATALRAYHELNLRAFRCLKPDGLLVTCSCSGKLDRAAFEEMVLAAAADAKRPVQILERRGAGLDHPVLAGLPETEYLKALYVRAL

SEQ ID NO: 37006 - protein, 483 aa, Ralstonia sp. U2
MKTKLFINNTWSASSDKKSFDRKHPVSGEVVTQCANATVDDAVNAARAAQEAFKSWKAVGPSERRRLLLKVADVMESKTPEFIEVMAKEVGASALWAGFNVHLSANVFREAASLATQIQGETIPTDKPDTLSMTLRHAVGPILSIVPWNGTAVLAARAIAYPLVCGNTVVFKGSEFSPGTHALITKCLQEADLPAGVLNYLNSSPDRSPDIADALISSKEIRRINFTGSTRVGRIIAQKSAQHLKRCLLELGGKSPLIVLDDADIDAAVKAAVFGSFLFQGQICMSTERLVVDEKIADEFVAKFVEKTKQLSAGDPCVTGDCIIGPMVSPNSGDRINGLFKDAISKGAKVVCGGIAEGAVMPATILDHVTADMQIYDEETFGPITVVIRCKSEADAIRIANDSAYGLSSGVFGRDVNRALRVGMAIEYGSVHINGSTVQNEAQAPYGGTKATGYGRFDGRAVIDEFTELKWLTIEPFEQQYPF

SEQ ID NO: 37007 - protein, 323 aa, Allium sativum
MGSDSIAQNVTELIGNTPLVYLNHVVGGCRARIAAKLEIMEPCSSVKDRIALSMINDAEEKGLITPGVSTLIEPTSGNTGIGLAFIAAAKGYKLIITMPASFSLERRIIIKAFGGQLVLTDPLLGIKGCIQKAEEIAAKTPNSYVLQQFSNPANPKIHYETTGPEIWNGSGGKIDAFVAGIGTGGTITGTGRYLKEQNPNIKVYGVEPAESAVLNGGKPGPHKIQGIGAGYIPPVLDVSLIEETLPISGDESIEMAKLLAVKEGLLVGISSGAAAVAAVRIAKRPENEGRLIVVVFPSFGERYLSSVLFESIKKEAENMIYES

SEQ ID NO: 37008 - protein, 546 aa, marine gamma proteobacterium HTCC2080
MRAAYTFDFKHLRGDIYGGLTAGVVAIPLALAFGVASGLGPMAGMYGAIIVGFFAAWLGGTPTNVSGPTGPMVVVLAGLFASLSGDVGLILTAVVLAGVFQIIFGIIKLGDFIRLVPYPVVSGFMSGIGVIIIILQLDATLGHMAPAGTIPALQYLPTALTDINMSALAVAAVTLLVVYGWPTAWGKYLPAALAALAAGTLVSLFLGELPVLGEIPSGLPSFHMPSFSQGAMMLVIEAAFILAVLGAIDSLLTSLVADNMTRTRHDSNQELIGQGIGNAVAGLFGGIAGAGATMRTVVNIRSGGHTKISGMIHSVVLAAVVLGLGPIAAYIPHAALAGVLIKVGLDIIDFSYLRNAHRGPRWDLALMALVLGLTVLVDLITAVGAGVVLAALAYVRQVAKSQLDDLLSRPLTATSDEERDLIDTLKDRVTVFEFGGPLSFGAAADVGHHVRERYRDGMHAIVLDFCRVPFIDVSAVRAVETIACDAERAGKQIYITGMSDEIADTMTGLGADCCLDLNAARYNDRVELLRNLRDEYAGKLNNRPGK

SEQ ID NO: 37009 - protein, 281 aa, Gibberella zeae PH-1
MTPSLQDAKITFLGGGNMAAAIIGGLLAKNTNKQNIYVSEPWDVNRNKMADLGVRTTADNKEAAADADVVILAVKPQVAKGVCEELSSAWAGRDSLPVVISIAAGITLASIAQWFKGDSGKAPHIVRVMPNTPALVGEGASGLYAAEDVTAAEKELTSALLGSVSKATEWVDKEELLDVVTGISGSGPAYFFAFVEHLISSGVSLGLSEEQATRLATQTCLGAGKMLVESSDEPSQLRKNVTSPNGTTHAALVSFESSGLKEIVNKAVKAAANRAQELGKN

SEQ ID NO: 37010 - protein, 819 aa, Neurospora crassa
MASTSTAGDRIKKFLGIPADERLNDTACYVDGSFVESEPTTQDFLNEIRPTVQGTLNYLRELFPFVNWIFHYNLTWLLGDFIAGVTVGFVVVPQGMAYAKLANLAPEYGLYTSFVGFVLYWAFATSKDITIGAVAVMSTIVGNIIANVQKDHPDFDAGDIARTLAFISGAMLLFLGLIRFGFIVEFIPIVAISAFMTGSAISIAAGQVSTLMGIPNINSREETYKVIINTLKGLPNTHLDAAMGLTALFGLYFIRWFCTQMGKRYPRQQRAWFFVSTLRMVFIIILYILVSWLVNRHVKDPKKAHFKILGHVPSGFQHKGAPRLDNEILSAISGDIPTTILVLLIEHIAISKSFGRVNNYIINPSQELVAIGFTNLLGPFLGGYPATGSFSRTAIKAKAGVRTPLAGIFTAVLVLLALYALTSVFFYIPNSALAAMIIHAVGDLITPPREVYKFWLTSPLEVVIFFAGVFVSIFTSIENGIYVTVAASGAVLLWRIAKSPGKFLGQTEIYTAPRELVRGSKDSGLTQSLLQKSEHHTAFLSLDRDDLSNPELQISTPWPGIFVYRFGEGLNYVNSAKHLDNLTIHVFKHTRRTELNKFEKLGDRPWNDPGPRRGQAFLTDELVSRPTLRAIILDFSAVNCIDVTAAQALQDLRNQFDRYAHPDKVEWHFAGVSNRWTKRALVASGFGVDSLRTAKVQRENHKGGVQEVDQGPLVAIGPSVSASDIEAVPVGTSGSGSTDEKRPEGEGGATNGGMEKGSANGEDISTVPTATSADACALARDAGGKRLVPVFGINRPFFHIDVATALKSAVRNTGVVAAE

SEQ ID NO: 37011 - protein, 326 aa, Zea mays
  misc_feature (64)..(64): Xaa can be any naturally occurring amino acid
  misc_feature (77)..(77): Xaa can be any naturally occurring amino acid
PVPVPYMDAPTASSPSSSFPGTSFVVLSVSIVGILATSLLLLAYYLVLTRCGLLFFWRPGMHDXRRRRRRRAGPPPXVVVTVHDEPPRRSGMEEAAIRRIPTFRYRHGSTRLVLAAEAKQAACAVCLADFRDGERLRVLPPCLHAFHIDCIDAWLQSAASCPLCRADVSDPAALRCHHHHLDVPLPRAATDDVAVDVVSSSPTPTSADAAGEQEAVPSHETAHRNSSCRSCSMGGGGGGGDGCFLPMRRSLSMDSSTDKRFYLALQTILRQSSGGGASQAVTAGGDGKAESSNAAADIGPPSSRRLRRSFFSFSQSRGSRNAVLPL

SEQ ID NO: 37012 - protein, 307 aa, Bacteroides thetaiotaomicron VPI-5482
MINDFIFHLFSYLCSTIKKHPIIMKNFIKGFRFTPSNYPAEVEAKIQKYRKQGYKLPPRKVLRTPEQLEGIRESAKINTALLDYISENIREGMSTEEIDVMVYDFTTKHGAIPAPLNYEGFPKSVCTSINDVVCHGIPSKTEILQSGDIINVDVSTIYKGYFSDASRMFMIGDVSPEMRKLVQVTKECMEIGIAAAQPWKQLGDVGAAIQEHAEKNGFNVVRDLCGHGVGMQFHEAPDVEHFGRRGTGMMIVPGMTFTIEPMINMGTYEVFVDEADGWTVCTDDGLPSAQWENMILITETGNEILTY

SEQ ID NO: 37013 - protein, 272 aa, Ralstonia eutropha JMP134
MSIHLNTAEDVAQMRVACRLASEVLDYITPFVKPGVTTGELDRLCHAYMRDVQGTVPAPLNYAPPGYPPFPGAICTSVNDVICHGIPGDRVLKAGDAINLDITVITKEGYYGDTSRMFIVGEGSILAKRLAQVTYECMWKGIAQVRHGARLGDIGHAIQVHAEAAGYSVVREYCGHGIGKNFHEDPQILHYGRAGTGAEIKAGMIFTVEPMINAGKRDIRTMPDQWTVKTRDRSLSAQWEHTVLVTETGYEVLTVSAGTPAPPAFITESVAA

SEQ ID NO: 37014 - protein, 172 aa, Oryza sativa Japonica Group
MSNTRVFFDMTVGGAPAGRIVMELYAKDVPRTAENFRALCTGEKGVGKSGKPLHYKGSTFHRVIPEFMCQGGDFTRGNGTGGESIYGEKFADEVFKFKHDSPGILSMANAGPNTNGSQFFICTVPCSWLDGKHVVFGRVVEGMDVVKAIEKVGSRGGSTAKPVVIADCGQLS

SEQ ID NO: 37015 - protein, 282 aa, Enterococcus faecalis V583
MKVGYLGPIGSFTYSATLAAFPEATLMPYASIPACLKAIEQQEVAWSIIPIENTIEGTVNASIDYLYHQAQLPVQAELVLPIQQQLMVAKENQAIWQQSQKILSHPQALAQSQMFLEKNFPEAILEATPSTAYAAKYIAEHPELPFAAIAPKLSAEMYDLTIVEKNIQDLSVNQTRFWVLGSENLAISFPLSEKKITLAITMPSNVPGSLHKVLSVFSWRGINLSKIESRPLKTKLGEYFFLMDLVKDQPEKLIEAALTELELIGAEIKILGDYPIYVLSTL

SEQ ID NO: 37016 - protein, 351 aa, Oryza sativa Indica Group
MEERAWLVGRRSCLCFDDKSENAWKSRVGVLYVMHPITFFTNIIGVVTIVLISIVSILGLICLCHSLNFQLLIKRRRRNYYQANDEQLSYFNGPWLTRITLILVALWWGVGEVLRLTFVNGEGRFISDQTWQANVCKFYIVSNLGFAEPGLFLLLAFLLSAALHNQEVGALNRKWNQRTICAVFMLCSPSLIWEACVVFIGPHIASNDGQTSKVAKYWYSASSVHDGDVACTYPLLSSIFLGTFYTVLTLYVIFVGGQILSLVINQGLRRRIYMLIFATGILLPRAMFLGFSVLPWPGEIVHESLVFVSFLVLMIAAMLGIVILVYFPVAETFEVRNQEHIELQTSHSIAL

SEQ ID NO: 37017 - protein, 150 aa, Arabidopsis thaliana
MTKTMMIFAAAMTVMALLLVPTIEAQTECVSKLVPCFNDLNTTTTPVKECCDSIKEAVEKELTCLCTIYTSPGLLAQFNVTTEKALGLSRRCNVTTDLSACTAKGAPSPKASLPPPAPAGNTKKDAGAGNKLAGYGVTTVILSLISSIFF

SEQ ID NO: 37018 - protein, 540 aa, Magnaporthe grisea 70-15
MSAPFSKERDEGVLKEEGVVKEDSHDRVNVTDSDTEIAGVSKFHVDEKRKLGVTGAVFLILNKMIGTGIFSTPSSIFAATGSVGISLMLWVIGGILTFAGISVFLEFGLAIPRSGGEKNYLERAYRHPRYLATCVLAAQMILLGFSSGNSLAFGRYVLFAAGGLGEITPDNWQARGIAVACVTFAILLHVVLPKWGIRLFNVLGVFKVIILLLIVFSGFAALAGHRLVDDPRNFDNAFAIETGDGYSGGGAYAYSNALLNIIYSFKGWENANYVVGELKNPRKTLAVAMPLAVGGTTILYVLANVAYFAAIPKSELAKSEVIVAGIFFRNVFGVRAGGTALPAFVALSNLGNVLAVSFAHARLNQEFGKEGLLPFSRFWASTKPFGTPAAALFLHWIVTVIVLLAPPAGSAYNFIVNLYTYPGAWINAFVAAGLIYLQFSKKENWSSPWHTYLPISVLYLLANAFLALVPFIPPETSWNEDGYPYYVFPIVGVGVLLLGAAYWAVWTKLWPKLGGYRIEAERITDEDGEEVIRYRKVHVR

SEQ ID NO: 37019 - protein, 684 aa, Enterococcus faecalis V583
MEFTFLIIVFALSITFSNIFNRIVPVIPLPIVQIIVGVLIGLTKMGQEIEFEPEVFLVMIIAPLLFREGELINLKAMMKNFGMILFLAFFGVLITLVGVGWTLHMILPTLPLAACFAFGAALGPTDAVAVGSLSGRIDIPERSMNILSGEGLINDASGVTAFQFALAALLTGSFSPVEAAGTLVISSIGGAVVGIVLVLLKQQIVHLLETAVAKDVTGYLLIELLLPFIAYLISELIGVSGIIAAVIAGIMQASSLKKVSLFEAELSNVGESIWSLIEFTLNALVFLFLGIELSQVFSPIWIDQQYSNWFLLLVVLIISAVVFLIRFLAIFSVYTLQHGLKKVKNAMNEMLILTFGGVKGTVSLATIFILPTAINGEHFKERPLLLFITACVILVTLIGGILVLPFLTDSETEVENEESVEIDLLRDVIDVLKQQNEENPRGEMNAVIENYQDRLKELYTEQLSAERKQEVQELRTLIVSIERDGLEESLKQGEISVRSYRMYQRLITRMQRSIAKQLLSIVGFWLLFARQIISILLHPKLFFNRGEASEEEKELRNEELENIRQVFLRNSQVILKSLDNLRGVYDDDLIDFFIDGRLDLAHKFEKGEFIDSYIVHTETDYVKDLLLGFQEERRMIDHYEQSERISIIEANELRKNVNLLESYSISGEVNNVPLKRFVKNFNKE

SEQ ID NO: 37020 - protein, 631 aa, Enterococcus faecalis V583
MSVKELKVTDLTKTYGEKTLFDHLSFLIHEKDRIGLIGINGTGKTSLLNIIAGVDSGDGDLAAIQQPSDYQIGYLSQNQTFDENITIAEAVFQGDSPIIKAVKNYELALAALSENGLDEGVQRRYTQAEEAMNKQDAWTADTNAKIILQKLGIPTLEKKIGELSGGQLKRVSLAQVLIEAPDLLLLDEPTNHLDYETIEWLENFLNNYRGAVLMVTHDRYFLDRVTNRIFELSFGKLYEYKGNYETYVMEKAERERVAVEQEEKRKRLFKQELAWMRAGVQARGTKQQARIDRFQDLKENLHQVQTNGTLEADFATQRLGKKVLEIKEGNYAIDHKQLLKDFNLLIQANDRIGITGKNGAGKSTLLNILAGRIPLESGLYSIGETVRIGYYTQQNEEMDPNQRMIAYLQEAAEEVKRSDGSSVGVAEMLERFLFPRFMHGTLIGKLSGGEKRRLYLLKLLISQPNVLLLDEPTNDLDIDTLTILEDYIQTFKGAVIAVSHDRYFLDKTMDKLLVFQGNGQILSFYGTMSEYLANQKEQEKVKEKPLNKPVKEASTEKKEKTKLTYMEQKEWATIEEDITQLETKLETLTEEMNHQGDDFVRLQELQEAVTATEQLLEEKMNRWEYLSEYAD

SEQ ID NO: 37021 - protein, 134 aa, Triticum aestivum
MARCSKIHNIVLLRQTLQRWRSRAAARAATGDSMVSVPAGHVAVCVGGASRRFVVRAAHLNHPVFRELLRQAEEEYGFPSGACGPIALPCDEDRFRDVLRRVSSEERLGVAAVSSCDIATRPLLQRMAAEELVW

SEQ ID NO: 37022 - protein, 467 aa, Myxococcus xanthus DK 1622
MADFDLVVIGSGPAGEWGAVQAALAGKRVAVVEREPVLGGTAANTGTLPSKTLRETALHLSGFRARGLYSVETTLRHEATVSDFLFRERRVKDIERERIARNLQRHKVEIIQGTGALVDANTVVVRRQDAPERRLTGGTILVATGSSPYRPPLYPFEDPRIHDSDEVLELERLPRSLVVVGAGVIGCEYACMFAAMDIPVTLVEARAELLPFLDDEFSALLGQRMEALGIQLRFGQVVEQVDVPRDADTPIRMMLSSGAVLETDQVLVASGRTANTAGLGLEALGVQVGPRGQVEVGPTYQTALPHIYAVGDVIGFPALASTSMDQARIAVEHAFDLGGVRTMAPVLPYGIYTIPEVSMAGETEEALRTLNVPYVAGRAAFATNPRGQILGDTHGLLKLLFHRESLKLLGVHVMGPQASELVHVGLTALLTGSTARLFVETCFNYPTLSEAYKAATFDALDQLSGCP

SEQ ID NO: 37023 - protein, 363 aa, Ostreococcus tauri
MASTTGMMAPAFFVGRSELVAWVNALLDVNISKVEQCASGAIYCQILDAAHRTSNVVPMRRVNFEARSEHEFVANYKILQAVFEKLNIAKNIEVQKLVKARPLDNLEFLQWMKCYYDTATGGGCREECGSYDAEERRAGARGGASFARRPQATAAPRERRPAVRRDHHARETTTASTTSERGVEHVRHHSRAVDGANASSSARTRELTEANAALKLQVERAEQEREFYFEKLQDVEFVCQRPEFESNALKIVIERILYHTDGKADVEAIIAECFAEDTKTEALSATPTPPPTELPSPSPVAVATASMATLRLERLDSGLSASPIGASPLGTPPPMFSPEESSATSEKATESPREPLRDASNAV

SEQ ID NO: 37024 - protein, 715 aa, marine gamma proteobacterium HTCC2080
MTGFNYEKDADGIVTITMDMDGPVNSMSDAFLPLLSETADKLEAEEGLTGVVLTSAKKTFFAGGDLNMLCQVTEDSAEEFFHGVEATKAVMRRIEKLTVPVAAAINGAALGGGLELALACNHRVAWDDKSVQLGFPEVTLGLLPGGGGVVKAIYLMGLMASNEYILEGKRVAPAKAQASGLIDATVATLDELLPAAKAWVKAHKDDEAASTQPWDTKGYKIPGGGVNHPAVAQMLPAAAAMLQQKTRGLLPAPAKILDIAVAALRVDFETAMRIESRGLTYLACTPVAKNMINTFFFQMNQISGGASRPKDVEPQKTRKVGVLGAGMMGQGIAYVSAMAGIEVILKDISQEAADKGKAYSEKLLAKRVSKGRMTEEKAQGILALIKPTAANEDLQGCDLIIEAVFENIKLKHKITQELEGYLAEGGVWGSNTSTLPITQLSEASRDASNFIGVHFFSPVDKMPLVEIIMGENTGDVALAKAFDYALQIRKTPIVVNDSLGFFTSRTFGTFIDEGVRLLSEGMHPVKVDNLGKAIGMPVGPLAVYDEVSLELSRKAQETWEEMGIDTSARDGAVARDVVNTMIGEHGRGGRHHGGGFYEYAEDGTKAIWPPLLDIYYKAEVNIPVDDAKDRLLFRQVIEALRCLEEGVLRTVADGNIGSIMGIGAPAWTGGLLQFVNTYGLARFSSRCDELAAVYGERFKAPKIVADKMAAGEMFN

SEQ ID NO: 37025 - protein, 222 aa, Listeria monocytogenes str. 4b F2365
MKMIAASIMCADSLHLADELRALEQANVKMLHCDVMDGVFVENAAMGAYVLQDIKNNTDMLLDIHLATVNPDRFVDLYAAIKPAYMSFHVEASPDVDATIKHIRALGIKPSIAISPDTEIEQIYPFLDKVDMVLMMTVNPGFAGQKFQHHVLEKIKKLQRELESHTNKPLIEVDGNIFEETVRLLEPIGADVYVVGTAALFNDKAGSYTEKLAPLREIIQER

SEQ ID NO: 37026 - protein, 482 aa, Burkholderia thailandensis E264
MSFASLGLAEPLVRAVNELGYTQPTPIQAQAIPAVLGGGDLLAGAQTGTGKTAGFTLPILQRLHAFYAENRGARRAVRALILTPTRELAAQVEESVRAYSKYVKLRSTVMFGGVSINPQIDALKRGVDIVVATPGRLLDHMQQKTIDVSSLDILVLDEADRMLDMGFIHDIKRVLAKLPAKRQNLLFSATFSDEIKSLADSLLDSPALIEVARRNTTAETIAQKIHPVDRDRKRELLTHLIREHNWFQVLVFTRTKHGANRLAEQLTKDGISAMAIHGNKSQSARTRALSEFKNCTLQVLVATDIAARGIDIDQLPHVVNFDLPNVPEDYVHRIGRTGRAGANGEAVSLVCVDEKQLLRDIERLIKREISQEVIPGFEPDPNAKPEPIQRRGQRGGNGGGANGGNGGGSAGNAGRGNRAPRAASQPQAQQGQPAARRDGGTQAKAAKPQARGGGRPAGNGASNGGGAHANRNRSSRSGQRGR

SEQ ID NO: 37027 - protein, 906 aa, Bacteroides thetaiotaomicron VPI-5482
MDKKRVYTFGNGQAEGKADMKNLLGGKGANLAEMNLIGIPVPPGFTITTEVCTEYNTLGRDKVVELLKDEVVKAIARVEELMKSKFGDIENPLLVSVRSGARASMPGMMDTILNLGLNDEVVEGIIRKTGNARFAWDSYRRFVQMYGDVVLGMKPTNKEDIDPFEAIIEEVKESKGVKLDNELEVADLQELVKKFKAAVKEQTGKDFPTCAYEQLWGAICAVFDSWMNERAILYRKMEGIPDEWGTAVNVQAMVFGNMGDTSATGVCFSRDAGTGEDLFNGEYLINAQGEDVVAGIRTPQQITKVGSQRWAVLAGVTEDIRAAKFPSMEEAMPEIYKELDALQTKLENHYKDMQDMEFTVQEGKLWFLQTRNGKRTGAAMVKIAMDLLRQGMIDEKTALMRVEPNKLDELLHPVFDKSALKQAKVLTRGLPASPGAATGQIVFFADDAAEWHAAGKKVVMVRIETSPEDLAGMAVAEGILTARGGMTSHAAVVARGMGKCCVSGAGALNIDYKTRTVEIDGIVLKEGDYISLNGSTGEVYNGKVETQAAELSGDFADLMKLSDKYTRLQVRTNADTPHDAEVARNFGAVGIGLCRTEHMFFEGEKIKAMREMILAENAEGRRKALAKILPYQQADFKGIFKAMVGCPVTVRLLDPPLHEFVPHDTKGQQEMADTMGVSLQYIQQRVESLCEHNPMLGHRGCRLGNTYPEITQMQTRAILGAALELKKEGVETHPEIMVPLTGILYEFKEQEKVIREEAAKLFEEVGDSIDFKVGTMIEIPRAALTADRIASSAEFFSFGTNDLTQMTFGYSRDDIASFLPVYLEKKILKVDPFQVLDQNGVGQLVRMATEKGRAIRPDLKCGICGEHGGEPSSVKFCHRVGLNYVSCSPFRVPIARLAAAQAAIEG

SEQ ID NO: 37028 - protein, 290 aa, Saccharomyces cerevisiae
MEKLLQWSIANSQGDKEAMARAGQPDPKLLQQLFGGGGPDDPTLMKESMAVIMNPEVDLETKLVAFDNFEMLIENLDNANNIENLKLWEPLLDVLVQTKDEELRAAALSIIGTAVQNNLDSQNNFMKYDNGLRSLIEIASDKTKPLDVRTKAFYALSNLIRNHKDISEKFFKLNGLDCIAPVLSDNTAKPKLKMRAIALLTAYLSSVKIDENIISVLRKDGVIESTIECLSDESNLNIIDRVLSFLSHLISSGIKFNEQELHKLNEGYKHIEPLKDRLNEDDYLAVKYVL

SEQ ID NO: 37029 - protein, 426 aa, Burkholderia thailandensis E264
MAATFAPPASLDKRAMPVLASSTIAFTLCFAVWMMFAILGIPLKKTLGLNDTEFGLIAAMPVLTGSLIRVPLGIWTDRYGGRIVFFILMLVTVAPIWLISYATALWQFLVLGLFVGLAGGSFSVGTPYVARWFPKARQGLAMGVFGAGNSGAAVNKFVAPALIAAAGTWTIVPRVYAIAMLAMALLFWLFSATDPAHRSTNATSLRAQLRVLKDPRVWRYSQYYSVVFGGYVGLSLWLTQYYVGEYGFGIQSAAFLAACFSLPGGVLRAIGGWLSDRYGAYRTTWWVMWVCWVMFFLLSYPPTDFTIRAAHGPLGFHLSLTPVAFTVLLFAVGIAMAVGKASVFKFIADEFPDDIGAVSGVVGLAGGLAGFALPILFGALVDLTGVRSTCFMLLYGAVSVSLVWMYFSFRAERAAHDQRVLAARSA

SEQ ID NO: 37030 - protein, 516 aa, Pisum sativum
MASMAAIGVLKVPPSSSSSSSSSSSSSKAIARNLSFTSSQLCGDKIFTVSGTRRSSGRNPFIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLVLAGDHLYRMDYERFIQAHRESDADITVASLPMDEARATAFGLMKIDEEGRIVEFSEKPKGEQLKAMKVDTTILGLDDERAKEMPYIASMGIYVVSKHVMLDLLRDKFPGANDFGSEVIPGATELGLRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGGVPIGIGKNSHIKRAIIDKNARIGDDVKIINSDNVQEAARETEGYFIKSGIVTVIKDALIPSGTVI

SEQ ID NO: 37031 - protein, 262 aa, Glycine max
  misc_feature (178)..(178): Xaa can be any naturally occurring amino acid
NFWVFYIMSDKGLAFIFRKLGFNVQTPTGSFTAGLVGDSSPFSVLPQIKPSVTFIMVLLALSPCLFKAWKNPQPQMISRWIAYAYTCGFLFGWHVHEKASLHFVIPLAIVAAQTLEDARHYFLLSIVSCYSIFPLLFEAREYPIKVLLLLLHSILMWSGFSAQFYDGAEAQECQLLIXKKKADQFGSEGNSGATVKKGFAIGWIERIYLIGLVVVEIWGQILHPLLFCDKFAFAPLMLISIYCAFGIMYSWIWQLISIVKCR

SEQ ID NO: 37032 - protein, 507 aa, Pisum sativum
MSSIVTSSVINVPRSSSSSKNLSFSSSQLSGDKILTVSGKGAPRGRCTRKHVIVTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLILAGDHLYRMDYEKFIQAHRESDADITVAALPMDEKRATAFGLMKIDEEGRIIEFAEKPKGEQLKAMKVDTTILGLDDERAKEMPFIASMGIYVISKNVMLDLLRDKFPGANDFGSEVIPGATSVGMRVQAYLYDGYWEDIGTIEAFYNANLGITKKPVPDFSFYDRSSPIYTQPRYLPPSKMLDADITDSVIGEGCVIKNCKIFHSVVGLRSCISEGAIIEDTLLMGADYYETEADKRFLAAKGSVPIGIGKNSHIKRAIVDKNARIGENVKIINSDNVQEAARETEGYFIKSGIVTIIKDALIPSGTVI

SEQ ID NO: 37033 - protein, 399 aa, Ralstonia eutropha JMP134
MNPRLDLLQPYPFEKLRVLFAEVKPADKPAISFGIGEPKHPTPEFIKKALAESLAGLANYPTTAGSDALRQCIATWLERRYGLPKVNAATEVLPVTGSREALFAFAQTVVDGTRSGALVLCPNPFYQIYEGAALLAGATPVFANSDPARNFAPAFDRIADDVWKNVQLLFVCSPGNPTGAVLSLEDWKQLFALSDKYGFVIASDECYSEIYFDESRAPLGALEAAHKLGRGFERLVMFSSLSKRSNVPGLRSGFVAGDAALLKKFLLYRTYHGGAMNPAVQTASIAAWNDEAHVRENRAAYVRKFSEVTPMLAEVLDVALPDAGFYLWADVSRTGLNDVEFAAQLLAAQNVTVLPGSYLAREADGINPGANRVRMALVATPEECLEGARRIVEFCKSLG

SEQ ID NO: 37034 - protein, 526 aa, Ehrlichia canis str. Jake
MSKVAIIDFGSQFTQLLARRIRELNVYCEIFTPDVEFDLVKDSKAFILSGGPKSVASLAEIPKIVHNIIELNKKSSIPVLGICYGLQLLSNYFNSAIVSDCSKEFGKATLNIIKESEITKNVWEVGKRVDVWMSHADSVYNVPRGFEVIAYSVLKNVIAMICNEERKIYGMQFHPEVYHTTDGIALLSNFIKIAGCKTDWTMNSFLDEQQRVIKKQVGDKKVIAAISGGVDSSVAAALTYRAIGDQLHCIFIDNGLLRYNEAEKISQLLVNQFQMPITIVDKSSVFLNKLKSITDPEQKRKIIGKTFIEVFEGEANKIGGVEFLMQGTIYPDVIESGGAVGKESVTIKSHHNVGGLPDVMRLQLVEPLKLLFKDEVRLLGKELGISDEILMRHPFPGPGLAIRIIGEVTQEKIKMLQAADDIYINLIKKYNLYNIIWQAFAVILPVKTVGVMGDSRTYGYTCALRAVTSSDGMTAGCFPFGVDTDTKLIFYEFLQEVSNAIVNNVDGINRVVYDTTSKPPATIEWE

SEQ ID NO: 37035 - protein, 510 aa, Pisum sativum
MASGCVSLKTNTHFPNSKKGSFFGERIKGSLKNSSWVTTQKKIKPASFSAILTSDDPKGSLNLQVPSFLRLRADPKNVISIVLGGGPGTHLYPLTKRAATPAVPVGGCYRLIDIPMSNCINSGINKIFVLTQFNSASLNRHIARTYFGNGVNFGDGFVEVLAATQTPGEAGKKWFQGTADAVRQFTWIFEDAKNINVENVLILAGDHLYRMDYMDLLQSHVDRNADITVSCAAVGDNRASDYGLVKVDDRGNIIQFSEKPKGADLKAMQVDTSRLGLSPQDALKSPYIASMGVYVFKKDVLLKLLKWRYPTSNDFGSEIIPSAIREHNVQAYFFGDYWEDIGTIKSFYDANLALTEESPKFEFYDPKTPIFTSPGFLPPTKIDNSRVVDAIISHGCFLRDCTIQHSIVGERSRLDYGVELQDTVMMGADYYQTESEIASLLAEGKVPIGIGRNTKIKNCIIDKNAKIGKEVVIANKEGVQEADRSEDGFYIRSGITIIMEKATIEDGTVI

SEQ ID NO: 37036 - protein, 279 aa, Triticum aestivum
MRTHAHAHRVISPEREMAAGGMSREARWSLAGATALVTGGSKGIGHAIVEELAGHGARVHTCARSTAELEECRCRWEAKGLPVTVSVCDVSLRASREQLAETVKQVFDGKLDILVNNAAQAVAKAAVECTSEEYTHLMATNLESCFHLSQLTHPLLLGASIAGGGSIVNISSLGGTLGFPGLAIYSMTKGGINQLTRSLATEWAHNKIRVNCVAPGATKSDMLNSVPPEIKENELAKNPMRRAGEPEEVAAVVSFLCMPAASFVTGQVITVDGGRTISA

SEQ ID NO: 37037 - protein, 506 aa, Marinobacter sp. ELB17
MIYAQPGKEGSVVSFKARYENYIGGEWVAPVKGQYFDNITPITGNVICEIPRSTAEDIELALDAAHKAAPAWGQTSVQERSRILLKIADRIEENLELLAVAETWDNGKAVRETLNADIPLAADHFRYFAGCIRAQEGHMGEIDHNTVAYHFHEPLGVVGQIIPWNFPILMAAWKLGPCLAAGNCTVLKPAEQTPASILILMELIGDLLPPGVLNVVNGYGIEAGQALATSKRIAKIAFTGSTPVGTHVLKCAAENLIPSTVELGGKSPNIYFADVMKAEPAFIDKCIEGLVLAFFNQGEVCTCPSRALVQEDMYDEFMEKVIARTKAIKRGNPLDTDVQVGAQASKEQFDKILSYLEIGKQEGAEVLTGGGREHLEGEFANGFYIQPTLFKGDNKMRVFQEEIFGPVVGVTTFKTEEEALAIANDTEFGLGAGVWSRDTHVAYRMGRNIKAGRVWMNCFHAYPAHAAFGGYKKSGIGRETHKLALDHYQQTKCMLTSYDINPLGFF

SEQ ID NO: 37038 - protein, 464 aa, Phaseolus vulgaris
MELSTILCLGASFLFIFLFRTLIKQFLSKRPHFPLPPGTMGWPYIGETFQMYSQDPNVFFASKIKRYGSMFKSHILGCPCVMISSPEAAKFVLNKAQLFKPTFPASKERMLGKQAIFFHQGEYHANLRRLVLRTFMPEAIKNIVPDIESIAQDSLKSWEGRLITTFLEMKTFTFNVALLSIFGKEEILYRDALKRCYYTLEQGYNSMPINVPGTLFHKAMKARKELAQIVAQIISSRRQRKQDYKDLLGSFMGEKAGLTDEQIADNVIGVIFAARDTTASVLTWIVKYLGENPSVLEAVTEEQECILKTKEESGEDKGLNWEDTKKMPITSRVIQETLRVASILSFTFREAVEDVEYQGYLIPKGWKVLPLFRNIHHSPDNFKEPEKFDPSRFEAAPKPNTFMPFGSGIHSCPGNELAKLEILVLLHHLTTKFRWSVVGAKNGIQYGPFSLPQNGLPITLYPKK

SEQ ID NO: 37039 - protein, 558 aa, Oryza sativa
  misc_feature (80)..(80): Xaa can be any naturally occurring amino acid
  misc_feature (214)..(214): Xaa can be any naturally occurring amino acid
  misc_feature (310)..(310): Xaa can be any naturally occurring amino acid
MERLRVAISHHRAALPLPTHHNHFRRRHLQLQPFPSSLSLSLPISPQLSPAPPRRHLLPPLLASASAAQAAGPAPARAAXGGGGGGAKPVPLLVSLAVGLAVRFLAPRPAEVTPQAWQLLSIFLTTIAGLVLGPLPVGAWAFLGLTATVATRTLPFTAAFGAFTNEVIWLIVISFFFARGFVKTGLGDRVATYFVKWLGRSTLGLSYGLAISAXPCIAPAMPSTTARAGGVFLPIVKSLSLSAGSKPNDPSARKLGSYLVQSQLQASGNSSALFLTAAAQNLLCLKLAEEIGVKIANPWISWFKVASLPXAIISLLATPYLLYKIFPPEIKDTPEAPAIAAQKLKNMGPVTRNEWIMVATMILAVSLWIFGDTIGVSSVVAAMIGLSILLLLGVLNWEDCLNEKSAWDTLAWFAILVGMAGQLTNLGIVSWMSNCVAKVLQSFSLSWPAAFGVLQASYFFIHYLFASQTAHVGALYSAFLAMHLAAGIPAILSALALTYNSNLFGALTHYSSGQSAVYYGAGYVDLPDVFKLGFTTAAINAVIWGVVGTFWWKFLGLY

SEQ ID NO: 37040 - protein, 551 aa, Zea mays
  misc_feature (496)..(496): Xaa can be any naturally occurring amino acid
  misc_feature (506)..(506): Xaa can be any naturally occurring amino acid
MNPPAASVACRVCFVKNPPCRHVVGWKIDGQISFCAFVHGVALVHWIRSPPTLLWLLYVSLASCLLYKLFSSSNTSSEKARRRAPGPAPLPLVGNILELRGEPHHALARLAETHGPVMSLRLGTTDAIVVSSAAAARDVLQRYDNVLAARSVTDAGRALGNHERSVIWLPATSQLWKRLRAVCTNHLFSARGLEATRATREEAVRQLVSCLGRRTGETLEVGRVVFSCVLNLVSGALFSEDVAGLSSDRARELETLVRDTVEEATKPNLSDLFPVLARLDLQGRRRRSAEFIGRFYDFFDPIIARRVKARGSGEHVGDDFLDVLLQLHSMDQLSLQTVKSFLLDLFAAGTDTNTIAVEWTMAELLRHPAVMSKVRAELRDALGSKPCPDESDVGRLPYLRAVVMESMRLHPPSPMLVPHLAMADGAEVGGFTVPAGTKVIINLWAIMRDPASWAEPEAFVPERFVGASDADFRGTDRLEFMPFGAGRRACPGAPMXATRVVTLLLXASMLHAFEWRLPEGMKPCDVDVRDWFGTSLNMVTPLKAVPVPSSR

SEQ ID NO: 37041 - protein, 66 aa, Brassica rapa subsp. pekinensis
RTFMVSQQGEIAIRIDQNMEDTLANVEGAQSQLARYLNSISSNRWLMIKIFFVLIAFLMVFLFFVA

SEQ ID NO: 37042 - protein, 310 aa, Enterococcus faecalis V583
MTKGYVKSVTELIGQSPVVKLKRMVPEGAADVFVKLEFFNPGGSVKDRIALSMIQQAEADGRLKPGQTIIEPTSGNTGIGLAMVGAALGYPVKIVMPDTMSIERRKLMQAYGADLLLTPGAEGMKGAIAKATALAEEHGYFMPLQFNNPANPMVHEQKTGKEIVDVFGKRGLDAFVSGVGTGGTVTGVGHELKRIFPDIEIVAVEPTESPVLEGGEPGPHKIQGIGAGFVPEVLDTTVYQKVAAVSSEDALETARLMGPKEGILVGISAGAAIKAAIDLAVELGAGKRVLALVPDNGERYLSTALYEFPE

SEQ ID NO: 37043 - protein, 305 aa, Zea mays
MGKRKKPCFVCGLFGHNAKQCNQGQDCFICKKGGHMAKDCPDKHKRNDHQSTFCIKCGETGHDMFGCANDYPSDDIEQIRCYACNQKGHLCCSDFFDNSLEQVSCYNCAQSGHSGLGCAKQRREASAVTTPTLCFKCGEEGHFARGCTKNAKSDGPKGWSSPHSQRKGRWKNDGKSPSHIRRKEKWKKDSSARSAPHDACTTSKSNSPSFEERMGASNHKSKWRGGWTGDDDLPSKKYKPNGWGSPATPKRSYTNHQYLSGGGDYFTPQSSRRHNHGTASPGARKHRFSSSIFAASNTHVRFKRS

SEQ ID NO: 37044 - protein, 216 aa, Listeria monocytogenes str. 4b F2365
MAKIVPSVFGADIGRINEQLEVLEKNGIDLLHVDMMDGSFVPNIAFGPDQIKMMKKGTKLQFDVHMMVYEPDRYIPRLVEAGAHMITVHQEATTHLHRTIQLIKSYGVRAGVVLNPGTPPSTLEYVLDDIDCILLMTVNPGLGGQKFFQSSLEKIRKTKAYIGNRPIQIEVDGGVNAELAKECTLAGADLIVVGSYLFEGDIEANLEKLSKGVLTE

SEQ ID NO: 37045 - protein, 348 aa, Listeria monocytogenes str. 4b F2365
MKALKLYGKRDLRYEEADMPTIEQPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGAKRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 37046 - protein, 437 aa, Myxococcus xanthus DK 1622
MAIDLSRYFDLIKEAQVVRVRGRVTELTGLIIKASVPNVRVGELVLIKSRNRGAVKAEVVGFQGDEVMLMPLGELHGIGPDSEVIPTGKPLSIKCGEALLGRVLNGIGEPMDGHPLPEEGLIDWSVDRDCPDPFTRQRIERPLPLGVRCIDGLLTVGEGQRVGLFAGSGVGKSTLMGQIARNTKADLCVVALIGERGREVREFIEDAMGEEGMKRSVLVCATSDQPSLVRLRAAYVATAIAEYFRERGGNVLFMLDTVTRLARAQREIGLAVGEPPARQGYPPSVFSMLPRILERTGNSEKGKCTAIYTCLVAGGDMEEPIADEVRGILDGHFILNRALGERNQWPAMDVLASLSRVMSGIVSKDHKKAAGRLRELLSTYEKQRDLILLGAYQYGTDPRTDQAIDKYDAIIDFLKQDTHSNSGFEETVEQLIALFDE

SEQ ID NO: 37047 - protein, 121 aa, Vibrio cholerae O1 biovar eltor str. N16961
MSITNEQILDAIAEMSVMQVVELISAMEEKFGVSAAAAVVSGPAAAAAVEEQTEFNVILAAAGANKVAVIKAVRGATGLGLKEAKALVDGAPASVKEAVSKEEAEALKKELEEAGATVEVK

SEQ ID NO: 37048 - protein, 311 aa, Listeria monocytogenes str. 4b F2365
MAGKMKLFSVTSERPLATKIADYLDIPLCEVELQKFSDGEVKINIEESIRGTNAYVVQSMNSNVNERLMELLIMVDALKRASVHSINIIMPYYGYARQDRKARSREPITAKLMANLIQRAGADRLITVDLHAAQIQGFFNIPIDHLSAIPLIGDYLIENYGEKDVVVVAPDHSGVVRARRIADRLNAPIAILNRKPRPHEDEIMSVIGDVKGKVAIVVDDIIDTGVRATTSADILLEKGAVEVIACATHSVMAGNATERLQNSNIKEVITSDSIDLPEDKQFDKLTTISIGRILGRAIEGVQENRSLHPLF

SEQ ID NO: 37049 - protein, 449 aa, Saccharomyces cerevisiae
MFLEIPRWLLALIILYLSIPLVVYYVIPYLFYGNKSTKKRIIIFVLGDVGHSPRICYHAISFSKLGWQVELCGYVEDTLPKIISSDPNITVHHMSNLKRKGGGTSVIFMVKKVLFQVLSIFKLLWELRGSDYILVQNPPSIPILPIAVLYKLTGCKLIIDWHNLAYSILQLKFKGNFYHPLVLISYMVEMIFSKFADYNLTVTEAMRKYLIQSFHLNPKRCAVLYDRPASQFQPLAGDISRQKALTTKAFIKNYIRDDFDTEKGDKIIVTSTSFTPDEDIGILLGALKIYENSYVKFDSSLPKILCFITGKGPLKEKYMKQVEEYDWKRCQIEFVWLSAEDYPKLLQLCDYGVSLHTSSSGLDLPMKILDMFGSGLPVIAMNYPVLDELVQHNVNGLKFVDRRELHESLIFAMKDADLYQKLKKNVTQEAENRWQSNWERTMRDLKLIH

SEQ ID NO: 37050 - protein, 421 aa, Vitis vinifera
MALLHSNGFCFTAVAFNHPPSVSHGPGTVKASCSPFSSPSLPLLSLQRKAIPGDNGSPETKENSLVVCFGEMLIDFVPTSNGLSLAEAPAFKKAPGGAPANVAVGIARLGGSSAFIGKVGEDEFGYMLADILKENNVNNEGMRFDPGARTALAFVTLRKDGEREFMFYRNPSADMLLQEDELDFDLIRKAKIFHYGSISLITEPCKSAHLAAAKAAKDAGVIVSYDPNLRLPLWPSADSAREGILSIWNTADIIKMSEEEISFLTKGEDPYDDAVVRKFYHPNLKLLLVTEGPDGCRSTLLESWRKMGCKALRSNSLGVNNSGSRRHYQAVHQPSASISQEMILIWPDFSGRVKGLKVDAVDTTGAGDAFVAGILSQLAADLSLLQGLGPKVDNIYIGLNGLLQKVSNPIPNSMSESKWVL

SEQ ID NO: 37051 - protein, 1521 aa, Issatchenkia orientalis
METISVGKESDVSSDGNVAYGGFNEGTNKQIRDLAREFTRQTSVGDGVQDSDDATDSNEVEKFGVDHASPNSPPKSNQYDLLRTLTSMSQVPGVNPVDQTIDPRLDPNSDEFESKFWVKNMRKLLDSDPDYYRPTSLGFAAKNLIAKGISSDADYQANFLNYPFKVVRDTYMDLFRGNDESRYFEILKSMDVLIKPGTLTVVLGRPGAGCSTFLKTVAAQTYGFKVDDSSIISYDGLTPKEINKNYRGEVIFSAEMDNHFPHLSVGQTLEFAAKMRTPQNRFPGVSRNEYAKHMSEVYMATYGLSHTVNTKVGDNFIRGVSGGERKRVSIAEASLCGANLQCWDNATRGLDAATALEFVRALKTSAHILDTTPLIAIYQCSQDAYDLFDNVVLLYEGYQIYFGPGDRAKDFFERMGYECPDRQTTADFLTSITSPAERVAKKGWENKVPQTPKEFSDYWRASAEYKELVADIDEYLSHCHNNNTREEFAEAHAIKQANHARPSSSFRVSYWMQIKLIAQRNIWRTKGDPSIMMFSVIANIIMGLIISSLFYNLSATTGTFYYRSAAMFFAVLFNAFSSLLEVMSLFESRPIVEKHKMFALYHPSADAFASIFTELPAKIATSLGFNLMFYFMVNFRRNPGRFFFYLLMNFMATLVMSHIFRSIGSCFKTLSESMPPATVFLTAMVIYTGFALPTPSMHGWSRWINYLDPVAYVFEALMANEFDGRRFECSQFIPSYPNADLANQVCSVVASVPGFSYVNGTDYIYESYRYKITHKWRNFGIVVGFIIFFLFVYVTLVELNKGAMQKGEIILFQQSKLREMRKEKKSKQISDIEGGSEKPAGVYDHGNEDSEDGVNNLTVGSDIFHWRDVCYEVQIKDETRRILNHVDGWVKPGTLTALMGASGAGKTTLLDVLANRVTMGVVSGSMFVNGRLRDQSFQRSTGYVQQQDLHLQTSTVREALRFSAYLRQSRTISKKEKDEYVESIIDILEMRSYADAVVGVAGEGLNVEQRKRLTIGVELAAKPKLLLFLDEPTSGLDSQTAWSVCQLMRKLADHGQAILCTIHQPSALLLKEFDRLLFLAKGGRTVYFGDLGENCQTLINYFESHGAHPCPAEANPAEWMLEVIGAAPGSHANQDYHEVWMSSDERRAVQEELHRMETELLQIPVDDSAEAKRSFASSYLIQYICVTKRVLQQYYRTPQYIWSKLFLAGANSIFNGFSFYRAGTSLQGLQNQMLSIFMLSVMLNTLVQQMLPLYITQRSIYEVRERPSKTFSWWVFLAAQVTAEFPWNLICGTISYFCWYYPIGLQNNASVTHTTAERGALTWLLIVGFFNYASSLGLMCIAGVEQEQNGANISNLLFTMCLNFCGILKYPTGFWKFMYRANPFTFWIASVLGAGVGDTPLVCSSKEIVYFAPPKGETCTTYIQPYIDEAGGYLVDSEREGYCGFCTASNTNAYLKSVHVEYSKRWQNWGIFICFIAINNIFMFLFYWLARVPKKDNRVKDASALKSDEKATLGPQTTSEA

SEQ ID NO: 37052 - protein, 467 aa, Burkholderia thailandensis E264
MSLFRKKNVDRMIAGAHAAGLKKALGAVDLTFLGIGAIIGTGIFVLTGTGAVQAGPALMLSFVIAAIACGLAALSYAEFASTIPVAGSIYTYSYATLGELVAWIIGWDLMLEYGLAASAVSVGWSGYLQSLLQGFGVSLPAALTAAPGALPGVVTYFNLPAFLVMLVITTLLSIGIRESTRVNNIMVFIKVAVVLLVIAVGIFHVTPANWKPFMPHGWNGVFGAAAVMFFAFIGFDAVSSAAEEVKNPKRDLPVGIIASLGVCAFLYVAVAAIATGIVPWAQYANVSHPISYALQVAGEKWVAGFIDLGAVIGMLTVILVMSYGQTRIIFAMSRDGLLPAALSRVHPRFATPFLTTWLVGLFFGLIAALIPLNVLAELINIGTLAAFSMVSIAVLVLRRTHPDLPRAFRCPGVPFVPILAVAACLFLMLNLQPVTWIAFLTWLVIGLFVYFAYSRSRSKLAHGAQQH

SEQ ID NO: 37053 - protein, 547 aa, Cryptococcus neoformans var. grubii
MSAIIPQVQQLLGQVAQFIPPWFAALPTSVKVVIAVIGIPALVICLNVFQQLCLPRRKDLPPVVFHYIPWFGSAAYYGEDPYKFLFECRDKYGDLFTFVLMGRRVTVALGPKGNNLSLGGKISQVSAEEAYTHLTTPVFGKGVVYDCPNEMLMQQKKFIKSGLTTESLQSYPPMITSECEDFFTKEVGISPQKPSATLDLLKSMSELIILTASRTLQGKEVRESLNGQFAKYYEDLDGGFTPLNFMFPNLPLPSYKRRDEAQKAMSDFYLKIMENRRKGESDHEHDMIENLQSCKYRNGVPLSDRDIAHIMIALLMAGQHTSSATSSWTLLHLADRPDVVEALYQEQKQKLGNPDGTFRDYKYEDLKELPIMDSIIRETLRMHAPIHSIYRKVLSDIPVPPSLSAPSENGQYIIPKGHYIMAAPGVSQMDPRIWQDAKVWNPARWHDEKGFAAAAMAQYSKAEQVDYGFGSVSKGTESPYQPFGAGRHRCVGEQFAYTQLSTIFTYVVRNFTLKLAVPKFPETNYRTMIVQPNNPLVTFTLRNAEVK

SEQ ID NO: 37054 - protein, 211 aa, Ehrlichia canis str. Jake
MGIIVSESSSFISPIEHIIEDARQGKIFILIDDEQRENEGDLVILAEKVTSDAINFMITHGSGIVCLSITEDLMCKLGLEFIPKRHVNDNSASFATSIDVRYGITTGVSAHDRASTILRVVDQNVTKDDFVTPGHIFPIVAKKGGVLERSGHTEASVEIAKIAGLAPVAVVCELMNPDGTMSRMPDIIEFSQRYNVKVTSIEKLIQYVKAH

SEQ ID NO: 37055 - protein, 64 aa, Brassica rapa subsp. pekinensis
FMVSQQGEIAIRIDQNMEDTLANVEGAQSQLARYLNSISSNRWLMIKIFFVLIAFLMVFLFFVA

SEQ ID NO: 37056 - protein, 105 aa, Triticum aestivum
RTPLGRLVFKTDDMVQVVEAPDIVRNKVSFSIFGLDGAVSLTGKLNVLDSKWIQVIFEPPELKVGSLGFRYGGESEVKLEITYVDEKIRLGKGSRGSLFVFLRQD

SEQ ID NO: 37057 - protein, 440 aa, Bifidobacterium longum DJO10A
MTNAVADIEQETPEIEKERQLAGVGAGAGTVANGKKKPHDHALASILGPAFVAAVAYVDPGNVAANITSGARYGYLLVWVLVLANAMSVLIQYQSAKLGIVTNKSLPELLGERMSDAGRFMFFMQAEVIAIATDLAEVIGGAIALNLLFGLPLFIGGLVIGAISTVMLWFQGGKTQTTFERIIIVMLLIITFGFIAGLFVDPPSPGEVVKGMIPRFQGTDSVLMAASILGATVMPHAIYLHSTLVNDHYAGGEKPSIKTQLKGSKIDVVWALLLAGTVNLAMLVLAANSLHGMSGTDSIDGAQRAIAQVLGPVIGTIFSIGLLASSLSSTSVGTYAGSEIMHGLLHVNAPMWACRVVTLVPALIVLWFAKDPTQALVIGQVVLSIGIPFAVIPLMRYTHDKELMGKWADGTVKHVIFMIVVALIVALNVLLIVLTLMGRA

SEQ ID NO: 37058 - protein, 425 aa, Burkholderia vietnamiensis G4
MAIVEVKVPQLSESVSEATMLQWKKKPGEAVAQDEILIELETDKVVLEVPAPAAGVLAQVLQNDGDTVVADQVIATIDTEAKAGAAQAAAGAAEVQPAAAPAAAAPAAQPAAATASSSAAASPAAAKLLAEKGLSTGDVAGSGRDGRVTKGDALAAGSAPKAAPAAAPAKTAAAKPSLPEVKVPASATTWLNDRPEQRVPMSRLRARIAERLLESQQTNAILTTFNEVNMQPVMDLRAKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 37059 - protein, 476 aa, Burkholderia vietnamiensis G4
MSKEFDVVVIGAGPGGYIAAIRAAQLGKTVACIEKWKNPAGALKLGGTCLNVGCIPSKALLASSEEFENTSHHLADHGITVDGVKIDVAKMLGRKDAIVEKMTSGIEFLFKKNKITWLKGHGKFTGKTDAGVQIEVSGEGEAEVVTAKNVIIATGSKARHLPNIPVDNKIVSDNEGALRFDSVPKKLAVIGAGVIGLELGSVWRRLGADVTVLEALPAFLGAADEALAKEAAKLFKKQGLDIHLGVKIGDVKTTENGVSIAYTDKDGNAQTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 37060 - protein, 438 aa, Azoarcus sp. EbN1
MKISIFGLGYVGAVSLACLARDGHNVVGVDIDAAKLDLIRAGTTPVVEEGMVELMEKVAASGRITVTTDTRQALRDSDLSLVCVGTPSAANGSQDQGAVLRLAKDLGRAIAEKDVPHVVVFRSTLVPGTVEETLRPIIEAESGKRDGEGFHLCFQPEFLREGSSIRDYDKPPFTVVGANHAYPVERLRELFGHLPCKFLQTSVRAAEMMKYCCNNFHALKITFANETARLCEALGVDAFEVMNLVCQDTQLNISPAYLKPGFAFGGSCLPKDLRATTYFAKMHDVEVPMLSGILQSNRQHIDRAIAKVLESGHRKIGMLGLSFKTGTDDLRESPLVVLAEQLIGKGMQLSIYDPDVQLSRLLGANRRFIETQLPHIGDLLKADLAEVIASVDVLVVGVSNPLIFDVLATHSRPGQYVLDLVNLPNAEMIEARVEGLCW

SEQ ID NO: 37061 - protein, 248 aa, Helianthus annuus
MPGIAFGSFDDSFSLSSIKSYVAEFISTLLFVFAGVGSAIAFAKLTADADLDPAGLVAIAVCHGLALFVAVSIAANISGGHVNPAVTFGLAVGGQITILTGIFYWIAQCIGSIAACYLLSFVTGGLAVPTHAVAAGVGAIQGVVMEIIITFALVYNVYATAVDPKKGDLGTIAPLAIGLIVGANILAAGPFSGGSMNPARSFGPAVAAGDFSGHWIYWVGPLVGGGLAGAIYSNVFISNEHAPLSSEF

SEQ ID NO: 37062 - protein, 122 aa, Triticum aestivum
  misc_feature (80)..(80): Xaa can be any naturally occurring amino acid
MASKLQKLQSAACQASQFVSSRGTNYYRQLLEQNKQHIQEPPTVEKCNLLAKQLFYTRLASIPGRNESFWKELDYVKNLXKNRKELKVEDAGIAALFGLECFAWYCGGEIVGRGFTFTGYYV

SEQ ID NO: 37063 - protein, 363 aa, Nostoc sp. PCC 7120
MSGKNIVFLVLLLFIPVSLAAHYLEWGDLIVFITAGLAILPLAAWMGAATEEIAVVVGPTLGGLLNATFGNATELIIALVALNAGLVNVVKASITGSIIGNLLLVMGLSMLLGGLRHKEQTFQPIVARVNASAMNLAVIAILLPTAMNYTAQGIGEETLQYLSVAVAVVLILVYILTLIFSMKTHAYLYDVGVAEIETEENPHPKPNILLWSGVLLVCTLLVAVESELLVDALEVATSQLGLTALFTGVILVPIVGNAAEHATAVTVAMKDKMDLSVSVAVGSSMQIALFVAPVLVIAGWILGQPMDLDFQPFELVAVVVSVLIANSISSDGKSNWLEGTLLLAAYTVLGFAFYFHPDVGGLG

SEQ ID NO: 37064 - protein, 571 aa, Arabidopsis thaliana
MSSFNLSVDVNQNGNIKNVDSLSTLDDIDDIDFAKLLEKPRPLNIDRLRSLDERSLTELTGSPQLRNADNASRAPDHADYVISPSFGRRSGFNTPRSQPGFESHPMVGEAWDALRRSMVYFRGQPVGTIAAVDNSEEKLNYDQVFVRDFVPSALAFLMNGEPDIVKNFLLKTLRLQSWEKKIDRFQLGEGVMPASFKVFHDPVRNHETLIADFGESAIGRVAPVDSGFWWIILLRAYTKSTGDSSLADMPECQKGIRLILSLCLSEGFDTFPTLLCADGCCMIDRRMGVYGYPIEIQALFFMALRCALLLLKHDGEGKEMVEQIVKRLHALSYHMRSYFWLDLKQLNDIYRYKTEEYSHTAVNKFNVIPDSLPEWVFDFMPPHGGFFIGNVSPARMDFRWFALGNCIAILSSLATPEQSTAIMDLIESRWEELVGEMPLKVCYPAIESHEWRIVTGCDPKNTRWSYHNGGSWPVLLWLLTAACIKTGRPQIARRAIEVAEARLHKDHWPEYYDGKVGRYVGKQSRKNQTWSVAGYLVAKMMLEDPSHVGMVCLEEDKQMKPVMRRSNSWTC

SEQ ID NO: 37065 - protein, 301 aa, Triticum aestivum
MDMPLASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDDNQC

SEQ ID NO: 37066 - protein, 172 aa, Sulfolobus solfataricus P2
MKLGPGKKAPDEINVFIEIPMGSNIKYEYDEEEDIIKVDRVLYTSMVYPFNYGFIPETLEEDGDPLDVLVLGNYSLMPGTVIEARPIGMIYMRDEEGEDAKVIAVPRNKTDPSFSNINDVKDLPEAIRNKIVHFFEHYKELEPNKWVKISGWGSVAEAKERIKKAIERKKQG

SEQ ID NO: 37067 - protein, 363 aa, Photobacterium profundum SS9
MGFKCGIVGLPNVGKSTLFNALTKAGIEAANFPFCTIEPNTGVVPVPDLRLDALAEIVKPERILPTTMEFVDIAGLVAGASKGEGLGNKFLANIRETDAIGHVVRCFEDDNIVHVAGKINPLEDIEVINLELALADLDTCERAIFRQAKRAKGGDSEAKYEIAVLEKMLPTLTEGGMVRSIELSKEELAAIEYLHFLTVKPTMYIANVSEDGFENNPFLDMVFEYAAKENAIVVPICAAIESEIAELEDADREEFLADMGIEEPGLNRVIRSGYELLTLQTYFTAGVKEVRAWTIPIGATAPQSAGKIHTDFEKGFIRAEVIGYDSFIEFKGESGAKDAGKWRLEGKDYIVKDGDVVHFRFNV

SEQ ID NO: 37068 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVDETLKFIANRDKVAVLVGSKLRAAGAEEAAVKFTDALGGAVATMAAAKSFFPEENALYIGTSWGEVSYPGVEKTMKEADAVIALAPVFNDYSTTGWTDIPDPKKLVLAEPRSVVVNGIRFPSVHLKDYLTRLAQKVSKKTGSLDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAAKGLKAKTGGELAEAIKVALANTDGPTLIECFIGREDCTEELVKWGKRVAAANSRKPVNKVV

SEQ ID NO: 37069 - protein, 510 aa, Vibrio cholerae O1 biovar eltor str. N16961
MSAKKPMALVILDGWGYREDNANNAINNARTPVMDSLMANNPHTLISASGMDVGLPDGQMGNSEVGHTNIGAGRIVYQDLTRITKAIMDGEFQHNKVLVAAIDKAVAAGKAVHLMGLMSPGGVHSHEDHIYAAVEMAAARGAEKIYLHCFLDGRDTPPRSAEASLKRFQDLFAKLGKGRIASIVGRYYAMDRDNNWDRVEKAYDLLTLAQGEFTYDSAVEALQAAYAREENDEFVKATEIRAAGQESAAMQDGDALLFMNYRADRARQITRTFVPDFAGFSRKAFPALDFVMLTQYAADIPLQCAFGPASLENTYGEWLSKAGKTQLRISETEKYAHVTFFFNGGVENEFPGEERQLVASPKVATYDLQPEMSSKELTDKLVAAIKSGKYDAIICNYPNGDMVGHTGVYEAAVKACEAVDECIGRVVEAIKEVDGQLLITADHGNAEMMIDPETGGVHTAHTSLPVPLIYVGNKAISLKEGGKLSDLAPTMLALSDLDIPADMSGQVLYS

SEQ ID NO: 37070 - protein, 318 aa, Physcomitrella patens subsp. patens
PFLKEAVAKRYKEDYGVELDPETEVAILFGGKTGLIEISQCLLNPGDLCLVPDPGYPDYWSGVSLAGARMSFMPLLESHAFLPDYSQVSEEDRRDAKLMFINYPNNPTGAVATPEFYKQTVEFAAANGIVVSSDFAYGALGFDGKRPVSFLQTPGAKEVGVEFYTLSKTYNMAGWRVGFALGNAAVIELINTIQDHYYCSLFGGIQEAASAALTGSQQSVAELNALYQSRREAVFSALDEIGWKAARPGGSFFCWLPVPDGHTSESFADLLLEQADVVVAPGIGFGTHGEGYVRLGLLSSEERLKEAILRIGKLGLFS

SEQ ID NO: 37071 - protein, 971 aa, Streptomyces lincolnensis
MPRGEIPLDPDGGPLFEFAARLRKLREQAGSPTYRDLARDAHYSIASLSSAAAGRQLPSLAVTLAYVRVCGGDEREWKLIWQRTADACTSACTGQGTSAETGPEDRRSGGAKPPYVGLAAFGEADAGVFFGREKLTGTLVEHLKEKRLLVLFGASGSGKSSVLRAGVLPAFPGVSSLVFTPAPHPLEECAVRLAARAGADPGQVRDGLTAEPPTFHRLVRRILAREQEAGSTADELLVVVDQFEEVFTVCRDPRERERFLAALLHAAQAPDSRTRVAIAVRSDFYTHCTRLPGLVDVLPHAHHPVGPMTVEELRAAIVKPAARSRLTVESALLTSLTADAHGRPGALPLLSHALLETWSRRRGNALTLAGYRAAGGFEGALAQTAEAFHHALGDSGRQAARRLFLRLVALGEGTEDTKRRVPRQELDDGPDTEFVLEQATRARLLTVDGDHVEIAHEALIRCWPRLGDWLEEDRDQERLRRALTEATTLWESLDHDPDILYRGVRLAAAKDLPRQALTTRERAFLDAGESAARQTQRREGRRLRRLRRLVGALVVLLVCAVAAAGFAVQAQSTITRQRNEAVILRAADEAVRLSPSNPSLAVPIALAAYRQAPQSRTRDALLSTLSIASTDPRPTGYTPAVTADGRTLAMADQSEIVLWDLSDPRQLRRLGAIDTREFALNGIEFTPHGDTLVGVGSDHVLRLWDVRDPRRPTLLCKRPTGHTEAVYSLALRHDGRLAATSGYDDVLHLWDITDPARPRRLDSLVGHTANVKPVAFSPDGRTLASGSDDRTIRVWDVTDPRHATPVAVLKGHRHFVDALAYSPDGRTLLSGSDDHTAKLWDISDLPRHRRLSDLVRHADIVAGVAFASHGRTAVTVGVDGGVNVWDVTDPARPAPLAHLTNPRGTVKEVRHLAAHGLFLTVTAHRSVQIWHTELDRALTDVCDRFHGTLTRAQWSRHFPRVDYSPPCPHRT

SEQ ID NO: 37072 - protein, 589 aa, Shewanella oneidensis MR-1
MEESSLLTSVLLFLLAAVIFVPLGKRFGAGPILSYLAAGVILGPGGMALVSDPAAVLHFAELGVVLMLFVLGLELNPSKLWELRSAIFGLGSGQLLLSWAAIGGLAWGFGLSIEAALVVGAALSLSSTAFAVQLMSEHRLLTTPLGRDAFGVLLMQDLAVIPMLLLTAYLAPNSAQIEHHAVPWYWTCVALIGFVLVGKYLLPRVLKLVASSGVREVLTAFALLLVMGSAQLMEWLGLSAGMGAFLAGIMLANSSYRHQLETDIEPFKGLLLGLFFMAVGMSMDLKLFLTDPLLILAILLGMLLIKTLVLMLLGRVRHHTWRPSIALGLILAEGGEFAFVLLSQAQLSSIVDDKIAQILVLAIGLSMAVTPMIFTLFRATKPKVVDTRLPDTINVTESEVVIAGFGRVGQITGRILASSGIPFVALDKDASHVDVIRQYGGEVYFGDARRLDMLMSAGIARSRLLLLAVDSVEDSIEIAQQVKTHFPHINIIARARDRNHAYRLMSLGVTDVFRETFGSALSASEKILQGLGLSQVQANERVKIFAEHDKKLVIASAAHQNDLAKLIDLSNKGKAELESLMRGDRENVS

SEQ ID NO: 37073 - protein, 207 aa, Zea mays
  misc_feature (119)..(119): Xaa can be any naturally occurring amino acid
KTAKPLPSSPVPLVFCAGEKERRRPRDGDEAVERWIAEILALHRPGSNGYSIIVGLDVEWRPSFGPHQNPVATLQLCVGHSCLIFQLLYADYVPGALAEFLGDRGIRFVGVGVEADAEXSSDDHGLVVANAEDLRGRAAERMNRPDLRQAGLRALVQVVMGVNLVKPQRVTMSRWDASCLSYEQIKYACIDAFVFFEVARRLLGGAY

SEQ ID NO: 37074 - protein, 446 aa, Zea mays
MAAPPATAAAASRCLSGAKSCRAAERSSSSFAVSAPSTGLRQSRSRVLSVRAKVATGVQRASTVDDGAKRPWKLSDARLVLEDGSVWRAKSFGASGTQVGEVVFNTSLTGYQEILTDPSYAGQFVLMTNPHIGNTGVNPDDEESNQCFLGGLIIRNLSICTSNWRCKETLEEYLTKRNIMGIYDVDTRAITRRLREDGSLIGVLSTDQSQTDNELLEMAKKWKIVGVDLISGVTCDAPYEWLDKTDSEWEFKRDQSSETFHVVAYDFGIKHNILRRLASYGCKITVVPANWPASEVLNLKPNGVLFSNGPGDPAAVPYAVKTVQEIIGKVPVFGICMGHQLIGQALGGKTFKMKFGHHGGNHPVCDLRSGRVDISAQNHNYAVDPESLPEGAEVTHVNLNDNSCAGLQYAKMKLVSLQYHPESSPGPHDSDTAFGEFIELMKSNRL

SEQ ID NO: 37075 - protein, 227 aa, Physcomitrella patens subsp. patens
MMKDKKSVAMIGAGSWGTALSLVLGDNGHSVRIWGKDEKTIAGINSLHVNSKYLPDITLPKEVVGTTSLEESVRDVDFIILAVPTKAMREVTSQLLPYINGPKTFVHVSKGIEPGTLMRISEILEEEIPENKRKSIVVLSGPSHAEEVSLRHPTTVTVSSKNMTEAELVQDLFINHNFRVYTNPDLIGVEIGGALKNIIAVCAGIADGLGFGDNAKAALITRGLAEM

SEQ ID NO: 37076 - protein, 113 aa, Oenococcus oeni
DIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILN

SEQ ID NO: 37077 - protein, 124 aa, Burkholderia thailandensis E264
MAIAKEDILAAVEGMTVLELNELVKAFEEKFGVSAAAVAVAGPAAGGAAAAAEEKTEFTVVLAEAGSNKVAVIKAVRELTGLGLKEAKDLVDGAPKPVKEGVDKAAADEAKKKLEDAGAKVEVK

SEQ ID NO: 37078 - protein, 113 aa, Oenococcus oeni
DIKLLVVSDGEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILN

SEQ ID NO: 37079 - protein, 553 aa, Listeria monocytogenes str. 4b F2365
MFKHILLSLNGYKISYLRNDVISGVGVAALTIPVAMGYAQVAGLPPIYGLYASFLPVIAYVIFASSPQLVFGIDATASAITGSIILGTAGLAAGSKEAIALAPILAFFCAIFLVLFSVLKLGRFAKYISAPVLSGFISGLSVSIIMGQIPKIMGLKESGDSFFSSLGIIFGQFFQSNWISFAMGVVTVIIVITCKKVIPKIPMSLVVLVLGTMAAYFFKLDQYNVDIVGKIPVGFPSLALPDFGASSWALAIGGGLVCAIATFAGSLLPSESFAMRNKYTIDDNRELFAYGISNFVAAFSGCSPASASVSRTAANEQFRGKTQMVSIVAATIIALIVAFLSGLLYYMPQPVLSGIVFAALVGIIDVDVLKGLFKVSRREATVWIVAALGTLLVGVIFGVLLGIFLSFINVVSRSMKSPIAILGVIEGRHGYFDLKRKPEAKPIPNVVIYRYSASLFFGNFNKFADGLKEAVQDDTKLVIFEASAIINIDTTATESMKDLLKWLDDKGIEYYFADLIDHLKTSFRKHDLGYIIDNGYTKKTVEDALEAYYAEHK

SEQ ID NO: 37080 - protein, 372 aa, Triticum aestivum
  misc_feature (163)..(163): Xaa can be any naturally occurring amino acid
MARRSAPLLRRLVSSAPPLPGHGGGARRTVTYMPRPGDGTPRPVTLIPGDGIGPLVTGAVEQVMEAMHAPVYFESYDVHGDMPAVPPAVIESIRRNKVCLKGGLATPVGGGVSSLNMQLRKELDLFASLVNCANVPGLPTRHQNVDIVVIRENTEGEYSGLEXHEVVPGVVESLKVITKFCSERIAKYAFEYAYLNYRKKVTAVHKANIMKLADGLFLESCREIAAKYPSIEYNEIIVDNCCMQLVSRPEQFDVMVTPNLYGNLVANTAAGLVGGTGVMPGGNVGQDHAIFEQGASAGNVGNDNLVEQQKANPVALLLSSAMMLRHLQFPSFADRLETAVKRVIAEGKYRTKDLGGTSTTQEVTDAVIANLD

SEQ ID NO: 37081 - protein, 569 aa, Synechococcus sp. WH 7803
MPMGASSKFSNSATTATFRAFAEKADYSLLSQLKADPQSTTDGRDHRPRQVHSGHYVPVQPTPLPDPAYVAHSSALFDELGLNESLVHDEAFRRLFSGDHSAATDPMRPWGWATGYALSIYGTEYTQQCPFGTGNGYGDGRAISVFEGVFNEQRWEMQLKGGGPTPYCRGADGRAVLRSSVREFLAQEFMHALGVPTSRSLTLYLSQSETVARPWYSENSRSFDPDVMVSNAAAISTRVAPSFLRVGQIELFARRARSEAHPEARRELQLIVEHLIERNYRPEIDPGLPFHQQVIALARLFRGRLTSLVAHWMRVGYCQGNFNSDNCAAGGYTLDYGPFGFCELFDPRFQPWTGGGTHFCFFNQPVAAETNFKMLWASLRTLLDGDTQAQEELDALHDGFSRAMQAEMEVMWSNKLGLSAYDEALVTELLQLLASTRADYCRAFRILSTLPRDVSELDPSFYLPRSDALTDQWQRWLQRWRSRLEAQGDLHQTAALMQRVNPAITWREWLIAPAYQQAERGDMRLIHELQAVFKDPYSPLSADLTSRYDQLRPRELFNAGGLSHYSCSS

SEQ ID NO: 37082 - protein, 569 aa, Ehrlichia canis str. Jake
MHDSKYLLDIITLLSAAIVIVVLFWKLNISPVLGYFVAGTLIGSNGLNLVESSVIIQNLGEFGVVFLLFLIGIELTFERLIAMRLHVFGFGTLQVIVTASVIWYISNKFGIDSRGSLIIGGALALSSTAIVLQVLQEKGYQSTQVGRLSIAVLLLQDFAVVPLIVLLPLLTGESHHSIPISLLYSFIKAAIALTLIFITGRLLLRPLFNTIAAMKSNEIFIATTLLIVLGAAFITENFNLSMALGAFVSGLLVAETEYRHDVEQVVLPFKRLLLGLFFMTVGMSIDIKFVLNKLPIITLASISLIALKSFIIFILCRFFRFQLAAAIQAGLLLSQGGEFAFILFGLAAEKNVLSSDLAQTLMMITTVTMAFTPLLAALGDWISKLITKKKISLNSQELTLDTKDLDQHVIVVGFGRVGRMVAKVLVAEHVNYIASDIQPKIVKDGIDEGYPVYLGDLTKLNTLQSMAISRARMIIIAINNEVTIKKIISLVAKNFPHIIIIVRLPDLNNVEIYKELGAHYLIPETYEVGLQLGAVALSNSGFSNHAVALLKDRFRMVNYDVVKNKESDE

SEQ ID NO: 37083 - protein, 505 aa, Gibberella zeae PH-1
MAHELPFKIPTLQVKQQAPSQVQPLTSSVILPSNSLTTLTTPDPGTNKPWAKVKDNSADDVDHTVQVAYDAFQTFKKTSPRLRAQWLLKWDALIREHKADLATLLVYETGKPYAEAIGEMDYSLTFTSWFAGEAERIQGTCFMPSAPNRRVFTIKQPLGVAVALVPWNFPVAMVLRKAAAALAAGCTMVVKPSPETPVTAMALAKLASEAGFPNGVLNILPTSLDNTPSLSEALCKHDLVKKVTFTGSTRVGTLVANLCSLGLKKVVLELGGNCPCLIFNDADIEAALRELVGLKWRHAGQACVTVNRFLVQSAVYDKFLQRFAEETAKYVVGHGASEGTTLGPVTKPESLDRAERLIKDAVSKGARIVTGGNRLSPKDGEGGYFFEPTILADMTHDTLISCEECFAPIAAFYKFETEEEAVRVANDTPMGLASYAFTKDADRIWRLFENLEAGMIALNTGNSSAAESPFGGIKMSGYGKEAGKDVAVNEYMIQKTGTITVDGLV

SEQ ID NO: 37084 - protein, 181 aa, Oryza sativa Japonica Group
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKA

SEQ ID NO: 37085 - protein, 550 aa, Physcomitrella patens subsp. patens
MVDSRYTRISRKWVGFVTAIWVQSIAGNNYTFANYSQELKSVMHYNQVQLNNLGVAKDVGKSFGLFAGLLADRLPTWLILLIGAVEGAVGYGTQYLVVSQTIRPPSYWQMCVVLCMGGNSTTWMNTAVLVTCMRNFPRSRGTVTGTLKGYIGLSTAIFTQLCTALFTSEASSFLLLLTILPAIVCCSAIIFLTEVPASASHDEDVEEQAGFTIINWISLALALYLLTFTVLEFFFPLSSLQFKLFAVVLLLFLIAPLVVPLKLILRIYNDDKSSPVSPDATAITKPLLEETSDNVVPQTDASQGSVEEYKFPSLGEDHNLTEALLTIEFWLLFFTFLCGIGTGITAINNLGQIGEAQGFADVSIFISLISIWGFFGRVGAGAVSEYYVKKAAIPRPLWMAISQIFLLMGYIMFAMAAPGSLYVGSIVVGICYGVHISITVPTASELFGLKHFGMLYNFLILNIPLGSFLFSGMLAGWLYDREASKVPHLSTILCVGSHCFRSVFIVMAGMCAFGILLNVVLILRIRPLYQDLYGPNGSVERKRRMQPKSR

SEQ ID NO: 37086 - protein, 334 aa, Marinobacter sp. ELB17
MGLLIEGEWHDQGYDTKKEGGEFVRESSKLRHWITPDGRSGPDGQRGLPADRDRYHLYVSLACPWAHRVLMLRQLKGLNDLVSVSYTSPLMLDQGWSYHVEEGSSGDAVSGVDFHHQLYTMTDPDYTGRVTVPALWDKQQSRLINNESADLVRIFNSAFDELTGNRLDFYPESMRGIIDAINDDVYEHINNGVYKAGFATEQAVYDTHVAALFEALDRMEVRLSEQRYLAGEWLTEADIRLFATLIRFDAVYYGHFKCNIRRIEDYPNLANYMRELYQWPGMKKTVDFEHIKRHYYCSHTTINPTRIVPKGPVFSFEQPHDRERLTGHAVVTNA

SEQ ID NO: 37087 - protein, 106 aa, Physcomitrella patens subsp. patens
QGGGVLDRPTIDKPTPGRESEFDLKKKKKMSPPYRVMLHNDNFNKREYVVQVLMKAIPGMTVDIAVNVMNEAHINGLAVVIVCPQEDAEDYCMQLRTNGLLSSIEP

SEQ ID NO: 37088 - protein, 376 aa, Arabidopsis thaliana
MSDLPPDLVEDILSRVPATSLKRLRFTCKQWNSLFKNRRFTEKHFCKAPKQSHVLLWKDYTVCPMSINLNFSGSSIEFKSVLSLKDSHYNSEQVYIAKVFHCDGLLLCTTKDHRLLVWNPCLGETRWINFENDYKPYSRFSLGYKNNKSCRSYKILRFWTSYLTPNHIGLRYNIYEFTTDSWRVLIDKVSLNYFLIESENGVSFKGNTYWLALDEETNFLLGFDFTMERFKRLCLPSNKNCDTMVLSVVREEKLSVSHQNFCSSKMDIWMTNRIDSETAMSWKRYFSVEFKILSMCHSLPFCNSFLIDEEKKIVISTVRGNENMVNIIGAYNAYYAEVPVESTNWPCSPYFVSYVPSLVQIQQCKSKENNKTSLEM

SEQ ID NO: 37089 - protein, 250 aa, Helianthus annuus
MVKLAIGSIGDSLSAGSIKSYLAEFIATLLFVFAGVGSAIAYGKLTTDAALDPAGLVAIAIAHAFALFVGVSMAANISGGHLNPAVTFGLAIGGNITIITGLFYWIAQCLGSIVACFLLQFVTGGLAVPTHGVADGMNGVQGVVMEIIITFALVYTVYATAVDPKKGSLGTIAPMAIGFIVGANILAAGPFSGGSMNPARSFGPAVVSGDFSQNWIYWVGPLIGGGLAGFIFGDVFIGSYETLPDSGDYA

SEQ ID NO: 37090 - protein, 248 aa, Helianthus annuus
MPGIAFGSFDDSFSSSSIKAYIAEFISTLLFVFAGVGSAIAYAKLTADAALDPSGLVAIAVCHGLALFVAVSIAANISGGHVNPAVTFGLAVGGQITILTGLFYWIAQLLGSVAACFLLSFVTGGLAVPTHGVAAGVGVLQGVVFEIIITFALVYTVYATACDPKKGALGTISPIAIGFIVGANILAAGPFSGGSMNPARSFGPTVAAFDFSGHWFYWVGPLIGGGLAGAIYPNVFISNEHIPLTNDY

SEQ ID NO: 37091 - protein, 248 aa, Helianthus annuus
MPGIAFGSFDDSFSSSSIKAYIAEFISTLLFVFAGVGSAIAYAKLTADAALDPPGLVAVAVCHGFALFVAVCIAANICGGHVNPAVTLGLAVGGQITFLTGLFYWIAQLLGSTVACFLLSFVTGGLAVPTHGVAEGVGTIQGVVFEIIITFAMVYTVYATACDPKKGALGTIAPIAIGFIVGANILAAGPFSGGSMNPARSFGPAVASFDFSGHWIYWVGPLVGGGLAGLIYPNVFISNEHIPLTNEY

SEQ ID NO: 37092 - protein, 479 aa, Triticum aestivum
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSMEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 37093 - protein, 821 aa, Nostoc sp. PCC 7120
MVEIIIDPHTSDSVFKEQALVLPLNQVGIADIPLVGGKNASLGEMIQQLRRKGVKVPTGFATTAHAYRYFITSAGLEAKLREIFADLDVEDVQNLRQRGKQARLLMLQTPFPQELQTAIAQAYATLCQEYGDDTDVAVRSSATAEDLPDASFAGQQETYLNVHGLQAVLESCHKCFASIFTDRAISYRQIKGFDHFNIALSVGVQKMVRSDLATSGVMFSIDTETGFKDAVLITAAYGLGENVVQGAVNPDEYLVFKPTLKQGYRSIIEKRLGTKEIKMIYDLGGSKLTKNISVTPSERSVFALNDEDILQLAHWGCIIEEHYSQVRGVYTPMDIEWAKDGLTNELFIVQARPETVQSQKVNNVLRNYRLSPSLIPNPQPLIPLITGRSVGEMIGQGKARVILDVHQISQFQAGEVLVTNRTDPDWEPIMKRASAIVTNSGGRTCHAAIIAREMGIPAIVGCGNATTVLKTGQEITVSCAEGETGKVYSGLLPYEVQEIPLEKLPCTHTQIMMNVGNPEEAFGLTSIPNDGVGLARMEFIINNHIKAHPLALIHFDELEDELAKYKIAELTAQYEDKTLFFVDKLAQGIATIAAAFYPKPVIVRLSDFKSNEYANLLGGKQFEPKEENPMIGWRGASRYYDPRYREGFALECQAMKRVREEMGLTNVILMVPFCRTPNEGRRVLDEMAKHGLVQGENGLQVYVMCELPSNVQLADEFSQVFDGFSIGSNDLTQLTLGLDRDSELVAHLFDERDEAVKRMIAKAIATVKQHGRKIGICGQAPSDYPDFARFLVEQGIDSISLNPDSVLKTLLEIAAAEGKKV

SEQ ID NO: 37094 - protein, 474 aa, Zea mays
MAGKENAAPVGALGVAGPRLTRAAAKRAAAMAAEGPDDAKRRRVALGELPALANNAALAPSRPVKPSKPASRPARPGASEACGPAAAAEAERCASFSPPRAADAESNSASYSPPRTTADTAFSAPPRAADAESNSASYSPPLATADTAFSAPPRAVPPADLQLSGSYASDIYTYLRSLEVLRSAPQSFAFPQIRCICVGSRLIRCLLATDLVRRVQVDPQRRSRSDYIEAVQADVTAHMRSILVDWLVEVAEEYKLVADTLYLTISYVDRFLSVNALGRDKLQLLGVASMLIAAKFEEISPPHPEDFCYITDNTYTKEELLKMESDILKLLKFELGNPTIKTFLRRFTRSAHEDKKRSILLMEFLGSYLAELSLLDYGCLRFLPSVVAASVMFVARLTIDPNANPWNMKLQKTTGYKVSELKDCIVAIRDLQLNRKFPSLTAIRDKYKQHKFKCVSTLLPPVVVPTSYFEDLAE

SEQ ID NO: 37095 - protein, 133 aa, Arabidopsis thaliana; identical to SEQ ID NO: 1103

SEQ ID NO: 37096 - protein, 498 aa, Paulownia tomentosa
  misc_feature (1)..(7): Xaa can be any naturally occurring amino acid
XXXXXXXSGSGVSTLEKKNLGRIVQIIGPVLDVAFPPGKMPNIYNALVVKGRDTVGQPINVTCEVQQLLGNNRVRAVAMSATDGLMRGMEVIDTGAPLSVPVGGATLGRIFNVLGEPVDNLGPVDTRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 37097 - protein, 595 aa, Prochlorococcus marinus str. MIT 9301
MIKVEKVKKKKDSAKEETVCLANGLEVSKFENFKKSSQFLKEPLATELVNESDHFTNDAVQLLKFHGSYQQDNRENRRPGKSKDWQMMLRLRNPGGEVPGKLFLALDELSDKLGNGTLRATTRQAFQMHGIRKEKLKEVIQTIVNSMGSTLAACGDINRNVMAPAAPFDSPEYNIARALAKKVADLLTPMAGQGTFLELWADGDLEYTIKPDKDIEAIRKLQFKDNVFSGIKDEPLYGSTYLPRKFKCAVTVPGDNSVDLLTNDIGIVAFTSKDGNLEGCNFYVGGGMGRTHNNEETFARIADPLGYVEEPDVYELIQSIVAIQRDYGDRKSRKNSRMKYLLHKKGIKWFKKILSDKYFKKEIKKIRKEPDKALIDYLGWHKQNKTSHFVGLPLLSGRLSGEKKNTISSIVKKYNLDLRLTPNQDILLCNIANKNKSAIQNSLSKIGYENLDNINEIQRHALACPALPLCGLAMTEAERILPDVLKRIENLLLDLKIQKTILFRMTGCPNGCTRPYMAELALVGSGQNKYQLWLGGSKNLQRLAKPFLQRMELNDLEKTLQPLFDNWKSNLDLDFGDFINTQDENYILNLLNENQ

SEQ ID NO: 37098 - protein, 332 aa, Synechococcus sp. WH 7803
MAMQHPRLLLLGTGGTIAGTAPESTQLNRYAAGVIAAEGLLDALPELALLAEIQVEQIANVDSADLGFSHWRSLVERIRQSLAADPGLAGVVITHGTNTLEETAWLLHLLIDDPRPVVLVGAMRPASALSADGPLNLYQAVQVAISAEARGRGVLVVMDGQIHCARAVSKRATQGVGAFHSSGRGPLGWVDDLGVHLPEVERSEPALFAGLSLPRVWPQVVILHGCVEPPQALIPALLSAGVQGLVFTGTGAGQLSVVERDALAQWDGQPPLMLRANRCGSGPVHRCEDHAKLGLLPAGDLSPQKARVLLLLALMAGDDRNALAARLKTLSG

SEQ ID NO: 37099 - protein, 513 aa, marine gamma proteobacterium HTCC2080
MNKAEQGPTLLVILDGFGHREDPRDNAIAAANTPTWDRLWQTAPKTLISGSGQDVGLPEGQMGNSEVGHMSLGSGRVIYQSISKIDNAVNDGSFHTNEAYCHGIESAVSQGKAVHIMGLLSSGGVHSHERHIFEMVRMAAAKGATEIYLHGFLDGRDTPPRSASSALRAADEVFEQLGVGRLATITGRYWAMDRDQRWDRIEKSYRLLCLGEAEHAADSSTAGLEAAYDRGETDEFVAPTRIGEPAVIADGDVVLFMNFRADRARQLTEALINENFDGFERTSIPNISLVCTTEYSSQFNCPVAFPPDIVNDGFGEILANNGLSQLRIAETEKYAHVTFFFSGGREELFEGEKRILIPSPNVATYDLQPEMSAIAVTDAVIDAIESRSVDCIIVNFANGDMVGHTGVFDAAVKAVETLDTCLERIEAALLAANGQALITADHGNCEQMLDYDSGQNHTQHTTEHVPLVYVGNHQLVLRQEEGILADVAPTLLALIGVEQPNAMTGTSLLEPEG

SEQ ID NO: 37100 - protein, 467 aa, Ralstonia metallidurans CH34
MREVPAMSSLFDAMRAASRHDQTPPWDVRADRLRRLRRLVQANHDAIAAAISADFTNRPHQETALLEVFPSVAGIDDALRHGKRWMRVRRASTGLWFKPGRSRLMPQPLGVVGIVVPWNYPLYLTIGPLTGALAAGNRAMVKLSEYTPRFSALFAQLVQAAFAPDEVAVINGDAEVAAAFSTLPFDHLLFTGSTNVGHHVMRAAAANLTPVTLELGGKSPAIIGPHADFERAVERILVGKLLNAGQTCIAPDYVLVQADQRDRFAEAARRCASRLYPDIARNPDYTSIISPRHFDRLVSMIAAATAAGAHAVPLTDATPDAAARRLPPVLLTDVPDNVMAMQEEIFGPVLPVVTYRSIEDAIGFVNARPRPLALYVFDKSGDVVDRVMRQTVAGGVTVNDTLFHIAQDDLPFGGVGPSGMGVYHGKAGFETFSKLKPIFHQAGLNGAGLLKPPYGKRFESMLKLLLR

SEQ ID NO: 37101 - protein, 355 aa, Haloarcula marismortui ATCC 43049
MQAVLLEEFQEPLTVQEVERPEPEPDGAVAEVIGCGICRSDWHCWQGDWDWFGYRPDPPHVLGHEPTGRIVSVGEDVENIEEGQEVAIPFNFACGNCDLCRNGRENICENHIGLGFMNQAPGAFAEEVHIPNADLNAVPLPDDIDAESAAGMGCRFMTSFHAMAHRAPVSAGDDVVIHGCGGIGLSAVHIANALGGNVIGVDLMDEKLDRAEELGAVATVNAQEVDDPAKAVRDITDGGADVSADALGIATTCQNAVNSLRKGGTHVQIGLTTSEEAGMVSLPTDEFVAKEIDFKGSLGLQPSRYSEMLDMVESSKLDPTALVEDTVDIHQVPDELAAMSDYNTVGIPVCNEFSN

SEQ ID NO: 37102 - protein, 338 aa, Zea mays
PRVRGATQTANCHLLPQPLCPSPCHQGPRSPERDLAATQAMESPFRADLLRGKAALVTGGGSGIGFEIAAQLARHGAHVALMGRRREVLDKAVAALRSEGLRAVGFDGDVRKQEDAARVIAATVEHFGKLDILVNGAAGNFLASPEDLKPKGFRTVLDIDTVGTYTMCYEALKYLKKGGPGRGPSSGGLIINISATLQYTAAWYQIHVSAAKAGVDGITRSLALEWGTDYDIRVNGIAPGPIQDTPGMRKLAPEEMGNKGKRETMPLFKLGEKWDIAMAALYLASDAGKYVNGAIIIVDGGLWLSRPRHIPKEEVKALSKVVEKKVRASGVGVPSSKL

SEQ ID NO: 37103 - protein, 362 aa, Ehrlichia canis str. Jake
MGLNCGIVGLPNVGKSTLFNALTQTMVAEVANYPFCTIEPNVGKAIVQDHRLKTLAQMASSKKIIYNQVECVDIAGLVSGASQGEGLGNKFLSHIREVDAIIHVLRCFSDQNISHVNQTVDPISDAEIVEMELILADIESLKRRLPALEKAVKSNKEPRKKLDNILEVLSILESGNLAKNAAHLGEDLKQLQLITTKPMMYVCNVEESNVTHGNALSEKVRLMAEKKHNKFCCISAKLEADVSSLETEEEKQIFLSEFNLEESGTTSVVKTMYDLLDMITFFTLGPQEARAWPIKRLSTASTAAGVIHTDFEKGFIKAELISFDDYIKYNGEAKCKEAGKVRFEGRDYIVQDGDIIHFRHNK

SEQ ID NO: 37104 - protein, 173 aa, Ehrlichia canis str. Jake
MKQHINKPTFKVGIGYDVHKFDNIEYDATNTFITICGIKINHHKKIVAHSDGDVGLHALTDAILGAVGCGSIGQHFPNTDNKWKDAKSDYFLIEAKNKAQEKGYYISNADIIIICEQPKIMPHALKMQEYIANLIKIDTSCINVKATTTEKLGFLGRKEGIAAQAIVLCCLQN

SEQ ID NO: 37105 - protein, 508 aa, Haloarcula marismortui ATCC 43049
MSSDSKQQSATERKSAIKKRHEQAANEVLPDRRELYIGGEWVQSSGGETFETIDPTTGETLAEVQAGTAEDIDSAVAAAWNAYDETYSELSTGERQAMLDGIADAIAERSEEFAKLESLDNGKPITEARIDIDLVIDHFRYFAGLARSGEGRTIETDDSRHVQTLREPYGVVGQIIPWNFPLLMAAWKLAPALSAGNTVVLKPAEETPLSILKLMEITEDVIPDGVVNVVTGFGPEAGEPLSKHPDIRKLAFTGSTEIGSKVMQSAAESITDVTLELGGKSPLVVFPDADLEQAVQTTITSIFFNTGECCCAGSRLFVHEDIKDEFLDELAAAAEDLTVDDPLLESTDLGPKVTAEQVERTLGYIEEAEREGAAFVTGGSQPDDEALSDGCFVAPTLIDEIDHDSKAVQEEIFGPVQEVFSWSEYDEMIELANDVDYGLAAGVLTEDLSKAHQCAKDIEAGNIWVNTYNDFPAGQPFGGYKQSGIGREIGQETIDHYTQTKTVNISLD

SEQ ID NO: 37106 - protein, 303 aa, Debaryomyces hansenii CBS767
MIASSSLCGIGRRNFARQFSRTKTSSSTSALAYKALHRNQKRPPLPTFETPNWSADAAVSSILYETPVPSKAPRKQHVLNCLVQNEPGVLSSVSSTLAARGFNIDSLVVCSTEVKDLSRMTIVLAGQDAVVEQARRQIEDLVPVYAVLDYTNAEIIKRELLLARVSLLGPEYFHELIATHKLHTSDGTSLPDLSATASAFHPSNLAPSEALRHKHSHLAHISTITEKFGGKIVDIADRNVIVELSAKPSRVSSFIQLLHPFGILEIARSGMMALPRTPLDGAYEEEEAVNAADIVDASQLPPG

SEQ ID NO: 37107 - protein, 237 aa, Oryza sativa Indica Group
MALSTAQTGESMHSSTFASRYVRTALPRFRMPEKSIPKDAAYQIINDELMLDGNPRLNLASFVTTWMEPECDKLMMAAINKNYVDMDEYPVTTELQNRCVNMIAHLFNAPIGDDETAVGVGTVGSSEAIMLAGLAFKRKWQNRMKAEGKPHDKPNIVTGANVQVCWEKFARYFEVELKEVKLTQGYYVMNPEKAVEMVDENTICVAAILGSTLNGEFEDVKMLNDLLTAKNAETGWN

SEQ ID NO: 37108 - protein, 193 aa, Glycine max
  misc_feature (78)..(78): Xaa can be any naturally occurring amino acid
MKDGGRKQGAPSPCAACKLLRRRCAQDCVFAPYFPADEPQKFANVHKVFGASNVNKMLQGMFGIKKKEREREINIGDXCDAFLHHKVNLSHIKDLAEHQRGDAVSSMVYEANARVRDPVYGCVGAISSLQQQIDVLQTQLAVAQAEAVHLRVRQTASLYSPTSPTNSGSPSQAKPIFDMDMVVDQNSYGDSMW

SEQ ID NO: 37109 - protein, 266 aa, Escherichia coli
MNIAIIGAGPAGIISARNAIKAGHSVVLFEKNTRIGGIWNPWSGGAYRNACMQNSRYTFHYTGFPPGDIDEFPGVEQVFRYLSAVAGEDALRESIRLNTEVVSLRKDAGHRVIRCASEGKDTEDIFDRVIIATGELWQPRRPPLPGEENFSGTLITSRDYQEPEAFKGKNILIIGGGVSGADIASDLVPFARSVSLSVKKMGLYLPRQFPTGPNDMMHSYLGRCLLSQMNYEDFIGYLDTMMPDYMQAYRASSLLPDMANNNAVHV

SEQ ID NO: 37110 - protein, 206 aa, Triticum aestivum
MGKSSKKSAAPTVVAPAAVLTKGKAGKKREADDEIKKAVSAKKQKAAPAKAVPGPKEAAKKAKKQPPPKKVESSSSEEQSSESEEEEVPKKTAKPVKHESSDDSSDDSSSDEEPAKKPSAKPVTPAASNGSKKGKPESSSSSSEDESDDDEKPAALVKKTPVIESDSSESDSDDSSDEDVPAKTPAAAAKKVDSSDSSESESESED

SEQ ID NO: 37111 - protein, 322 aa, Penicillium chrysogenum
MNSTVLPPGTYWGQYQDITKSNTQLSVAERLWVAWYAWVQNDVLATGIMSFLIHELFYFGRSLPWIFIDSLDFFNRYKIQSSKVPSLREQWDCAKFVLLSHFTVELPQIWYVPALDGVVFYPTFACLARLSNNGSSRLFHPMAQFFGLSTSIPFPSPWTMTYQIAIFFVMEDTWHYFFHRALHWGPLYKAIHKVHHQYSAPFGLAAEYASPIEVMILGFGTVSSPILWCAFTGNLHILTMYIWIVLRLFQAVDAHSGYEFPWSLHHFLPFWAGADHHDLHHEKFIGNYSSSFRWWDYLLDTDYTPDALKRRREQKVKAKKTQ

SEQ ID NO: 37112 - protein, 251 aa, Medicago truncatula
MSSKHESPDKKDVSGTHKRLSNLMHQAGNRYCADCGTPEPKWVSSSLGVFICIKCSGIHRSLGVHISKIASLKLDQWSDEQVDALEKLGGNTFLNKKYEACLPSNIKKPKPHTSIEERSEYIRKKYEELQFMMESDENSLCPFVPSQGRSVSLGPSSSSCYTYHIDNKKYEKALTRHHIGHAFRKSWTRKDSEHKCSKKSTSLASTRCTIPANNSTKNLLYILIQKQNTEQNTARKHQYTVQPYNQTSKLI

SEQ ID NO: 37113 - protein, 614 aa, Escherichia coli W3110
MSLISMHGAWLSFSDAPLLDNAELHIEDNERVCLVGRNGAGKSTLMKILNREQGLDDGRIIYEQDLIVARLQQDPPRNVEGSVYDFVAEGIEEQAEYLKRYHDISRLVMNDPSEKNLNELAKVQEQLDHHNLWQLENRINEVLAQLGLDPNVALSSLSGGWLRKAALGRALVSNPRVLLLDEPTNHLDIETIDWLEGFLKTFNGTIIFISHDRSFIRNMATRIVDLDRGKLVTYPGNYDQYLLEKEEALRVEELQNAEFDRKLAQEEVWIRQGIKARRTRNEGRVRALKAMRRERGERREVMGTAKMQVEEASRSGKIVFEMEDVCYQVNGKQLVKDFSAQVLRGDKIALIGPNGCGKTTLLKLMLGQLQADSGRIHVGTKLEVAYFDQHRAELDPDKTVMDNLAEGKQEVMVNGKPRHVLGYLQDFLFHPKRAMTPVRALSGGERNRLLLARLFLKPSNLLILDEPTNDLDVETLELLEELIDSYQGTVLLVSHDRQFVDNTVTECWIFEGGGKIGRYVGGYHDARGQQEQYVALKQPAVKKTEEAAAAKAETVKRSSSKLSYKLQRELEQLPQLLEDLEAKLEALQTQVADASFFSQPHEQTQKVLADMAAA

SEQ ID NO: 37114 - protein, 366 aa, Cupriavidus necator
MTAMMKAAVFVEPGRIELADKPIPDIGPNDALVRITTTTICGTDVHILKGEYPVAKGLTVGHEPVGIIEKLGSAVTGYREGQRVIAGAICPNFNSYAAQDGVASQDGSYLMASGQCGCHGYKATAGWRFGNMIDGTQAEYVLVPDAQANLTPIPDGLTDEQVLMCPDIMSTGFKGAENANIRIGHTVAVFAQGPIGLCATAGARLCGATTIIAIDGNDHRLEIARKMGADVVLNFRNCDVVDEVMKLTGGRGVDASIEALGTQATFEQSLRVLKPGGTLSSLGVYSSDLTIPLSAFAAGLGDHKINTALCPGGKERMRRLINVIESGRVDLGALVTHQYRLDDIVAAYDLFANQRDGVLKIAIKPH

SEQ ID NO: 37115 - protein, 420 aa, Shewanella oneidensis MR-1
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDDMRILGFEEKPQLPKHCPGNPEKCLASMGNYVFNTEFLFEQLKKDAQNAESDRDFGKDIIPSIIEKHKVFAYPFKSAFPNEQAYWRDVGTLDSFWLANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 37116 - protein, 709 aa, Ostreococcus tauri
MDALWKSLKTSFDVRASASEACAALGASADARCVVASVSTACRLRRARARGRTARCGRDGEDCERCVLRAVGSSSARSAKDELESDADDDEVLVTVDKAVEFAIYVDETRAIDRDCKHYIAMRRAELAEEALEAVTTRLVLAHREANERAETLAVTLRDVDASTRRNAIDARAAATAIEDVRARQRAFADDFNKFVLGVDEALKRVERASTGALQAVKFVAELAKRSFVACSEVFSSLVSLETIVVRCVVVALAFTSSRFRGRAIATLAISWTLRALALSSAARLRVGLLIGAVAPSIRVVAAARGAKHRASKASPTTTKSPRHPPTLVSEALGIQVSPKCQRFFTSHGLINTPWIVNENVLNGVHPSLPVMPRIAELVTYPVKSCAGISCDEIALTSTGLALDRTFCVTRANDGKFISQRTHPRLALVQCDVEPRAALTDRTISKFTLKCSAPGMDRALEVEVDLRSDASATGTATTECWEWVGRCGLVGDDARAWFTEFLNQDNAGAGETYELVRWIGKGGYAGGEQDRGDVDVDDASTRLTSPDYGSRRCTTTLSDGFPMLLVNKSSVEALERCVREETPGYKVDARRFRGNVIVDDASPYAEDAWSKIAFGRLTADDVIAEVCKPCSRCAIPMIDPDTGSSTAGVPLARVLSRLRSGAALGTANRLWRQSPFFGWNLICPDAQDASNVLRVGDDVRVLERRPAFP

SEQ ID NO: 37117 - protein, 252 aa, Prochlorococcus marinus str. MIT 9301
MTESNQTILAGVNRPIQIIPSVLPADWANMGACVKELEEAGVDRIQFDVMDGNFVPNLTFGPEMIAACRKYCNVPFETQLMVSQYNCETMLESYVNATKGANGEPGVVIAHAEANIHLHRVLGRIRDLGGSPSVALNPHTPFEMIKNIMDMVDHVLVMTVNPGFGGQAYIPTMLNKIREIRNFIIEKNLNVDIEVDGGIKANWTISQCAHAGANCFIAGSGMFAYPTLKEGCDDLRKVAQEAQKGDVLSEPQ

SEQ ID NO: 37118 - protein, 147 aa, Triticum aestivum
PIASIEDAFDQDDWENWAHLLETSEFQLVGDDLTVTNPLRIATAIEKKACNALLLKVNQIGTVTESIQAALDSQAAGWGVMVSHRSGETEDTTIADLVVGLRTGQIKTGAPCRSERLAKLNQLLRIEEELGSSAIYAGENFRKAHEL

SEQ ID NO: 37119 - protein, 436 aa, Prochlorococcus marinus str. MIT 9301
MHIVVVGLSHRTAPVEVREKLSIPDQSITESLKALKAFSDVLEVSILSTCNRLEIYALVKDKNTGISSIKEFISEYSGIIFDDLNPHLFCFRQEEAVLHLMKVSAGLDSLVLGEGQILSQVKKMMRLGQENQSTGPILNRLLTQSVSTGKKVRSETNLGTGAVSISSAAVELAQLKIGQEKGFDNLVSLESENVLVVGAGRMSRLLITHLKSKGCHKLILLNRNIDRALNLAQDFPDLEIVCKGLNELEENISLSSLVFTSTASEEPIIDLTKIEKINLSNRLKFIDIGVPRNISNDVKQHEFVKSFDVDDLQEVVSRNQEFRQKIAKEAESLVEEERIIFLEWWASLEAVPVINKLRSDLELIRKEELQKALSRMGPDFSARERKVVEALTKGIINKILHTPVTKLRSPQSREERQVSLKIVEKLFSLVEEDKNN

SEQ ID NO: 37120 - protein, 431 aa, Prochlorococcus marinus str. MIT 9301
MKRVLAIILGGGKGSRLYPLTKMRAKPAVPLAGKYRLIDIPISNCINSGIKKMYVLTQFNSASLNRHIGRTYNLNGPFGQGFVEVLAAQQTPDSPKWFEGTADAVRKYQWLFQEWDVDEYLILSGDQLYRMDYSLFVQHHRDNGADLTVAALPVDEAQAEGFGLMRTDDLGNIKEFSEKPTGEKLKAMAVDTSKFGLSKESAAEKPYLASMGIYVFSRNTLFDLLNKFPNYTDFGKDIIPEALNRGDTLKSYVFDDYWEDIGTIGAFFESNLALTEQPKPPFSFYDEKFPIYTRPRFLPPSKLVDAQITDSIVCEGTILKSCSILHCVLGVRSRIESDSVLEDTLVMGADFFESPEERFELRKGGGTPLGVGEGTTVKRAILDKNTRIGDNVVIINKDRVEEADKPELGFYIRNGIVVVVKNATIANGTVI

SEQ ID NO: 37121 - protein, 472 aa, Prochlorococcus marinus str. MIT 9301
MSKAHFGLIGLGVMGENLVLNAERNGFSSVVFNRTYSKTEEFLQGRGLGKNIEGAETLQEFVNKLERPRRILMMVKAGPATDAVIDNISGYLEEGDLLIDGGNSQFKDTERRVNTLESKSFGYIGMGVSGGAKGALEGPSMMPGGTKASYDAIESLLTKMAAKVEDGPCVAYVGPGGSGHFVKTVHNGIEYGIEQILAEAYDLMKRVKGMNGQQMSEVFGIWNNTDELASYLVEITEICLNTKDEITGDDVVEKILDKAGQKGTGLWTVVSALELGVSVPTIYASLNARVMSSLKEQRSEIEKTIPSKEIEDFDLGNISDGMKPLFDAVVLATIASYAQGMDILREASAVYNYGLNMPSIAQIWKGGCIIRSKLLSKIQDAYNKDPNLKNLIFDDWFNNEIATRLDNLAKVVSLSTKAGIPVPCLSSTLDYLNSYRTNRLPQNLVQAMRDCFGSHTYERIDKKGSFHTEWMK

SEQ ID NO: 37122 - protein, 490 aa, Bacteroides thetaiotaomicron VPI-5482
MIFTAENTLLIGSILLFVSIVVGKTGYRFGVPTLLLFLVVGMLFGSDGLGLQFHDAKDAQFIGMVALSIILFSGGMDTKFREIKPILGPGIVLSTVGVLLTALFTGLFIWWLSGMSWTNIYLPITTSLLLASTMSSTDSASVFAILRSQKMNLKHNLRPMLELESGSNDPMAYMLTIVLIQFIQSAGMGVGAIAASFIIQFIVGAAAGYVLGKLAIRMLNKLNIDNQALYPILLLAFVFFTFSITDLLKGNGYLAVYIAGIMVGNNKIMHRKDIYTFMDGLTWLFQIIMFLCLGLLVNPHEMLEVAAVALLIGVFMIVIGRPLSVFLCLLPFRKITMKSRLFVSWVGLRGAVPIIFATYPVVAGVEGSNIIFNVVFFITIVSLVVQGTTVSFVARLLHLSKPLEKTGNDFGVELPEEIDTDLKDMTITQEMLEEADTLKDMNLPKGTLVMIVKRGDEFLIPNGTLKLHVNDKLLLISEKPKEDEEANSES

SEQ ID NO: 37123 - protein, 192 aa, Porphyromonas gingivalis W83
MAQRENSDYLTTKMALIQSVRGFTPIIGEDTFLAENATIVGDVVMGKGCSVWFNAVLRGDVNSIRIGDNVNIQDGSILHTLYQKSTIEIGDNVSVGHNVVIHGAKICDYALIGMGAVVLDHVVVGEGAIVAAGSVVLTGTQIEPNSIYAGAPARFIKKVDPEQSREMNFRIAHNYRMYASWFKDESSEIDNP

SEQ ID NO: 37124 - protein, 402 aa, Synechococcus sp. WH 7803
MAKRSLASLNAGDLSGKRVLVRVDFNVPLNDAGAITDDTRIRAALPTINDLIGKGAKVILSAHFGRPKGQVNDAMRLTPVAARLSELLGKPVAKTDSCIGPDAEAKVGAMADGDVVLLENVRFFAEEEKNEAGFAEKLAGLAEVYVNDAFGAAHRAHASTEGVTKFLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQAALADCQTVIWNGPMGVFEFEKFATGTNAIATTLAELSAKGCCTIIGGGDSVAAVEKAGLAEKMSHISTGGGASLELLEGKVLPGVAALNDAA

SEQ ID NO: 37125 - protein, 339 aa, Magnetospirillum magnetotacticum MS-1
MRVVARGPEDGLSTRAIAVTSEVVGPIEAMAKGRLTVLGQSVSTAGLTTTRRFAAGERVAVSGLRRGDGTIVASLIEPRPAGADRVTGPVRRGRDGSLRIGSLRLVGLEPRLAGQRALVEGEAGKAGLTVASARDVSRPFPAGLARASIEGYVAQGGGSLRLGSGLSVSGRVDPSALPGAGRPAIIETGIGRGGRMTVESVRSEAPGRGGPGSGGQGFGGREPLGSGSEHPGSGPAGRPGPGGEAPFSRPGGRDTGGFGTGQRGPGGSGMPGGYPIDTRPGSGATPGDGFGGAFGGPGGGPGRPGGGRPGGFGGGGPGGFGGGGGPGGFGGGGGGGGPR

SEQ ID NO: 37126 - protein, 234 aa, Fulvimarina pelagi HTCC2506
MASSGDSERLSEGDLDQQAIFYHRNPKPGKLAIQATKPLGNQRDLALAYSPGVAAPCREIAEDPHKAADYTSRSNLVAVISNGTAVLGLGDIGPLASKPVMEGKAVLFKKFADIDVFDIEIDAREIDHVCDVVAALEPTFGGINLEDIKAPECFEIEARLRQRMKIPVFHDDQHGTAIIVSAAVRNALRLSGKKLGEVKIVASGAGAASLACLNLLIECGAKRENILVTDRDGV

SEQ ID NO: 37127 - protein, 370 aa, Oryza sativa Indica Group
MALALQNRCVNIIARLFNAPVGDGEKAVGVGTVGSSEAIMLAGLAFKRRWQNRRKAAGKPHDKPNIVTGANVQVCWEKFARYFEVELKEVKLTEGCYVMDPVKAVDMVDENTICVAAILGSTLTGEFEDVRRLNDLLAAKNKRTGWDTPIHVDAASGGFIAPFIYPELEWDFRLPLVKSINVSGHKYGLVYAGVGQIIAQYYQFLRLGFEGYKSVMKNCMESARTLREGLEKTGRFTIISKEEGVPLVAFTFKDGAGAQAFRLSSGLRRYGWIVPAYTMPAALEHMTVLRVVVREDFGRPLAERFLSHVRMALDEMDLAARAPVPRVQLTIELGPARTAGEEASIRVVKSEAVPVRKSVPLVAGKTKGVC

SEQ ID NO: 37128 - protein, 346 aa, Synechococcus sp. WH 8102
MFGLIGHSTSFDAARRKAMELGFDHIADGDLDVWCSAPPQLVEHVEISSPTGTTIKGAYIDSCFVPEMLSRFKTARRKVLNAMELAQKKGINITALGGFTSIIFENFNLLQHQTVRSTTLEWQRFTTGNTHTAWVICRQVENNAPTLGIDLKTAKVAVVGATGDIGSAVCRWLSARTGVGELLLVARQQQPLLDLQAQIGGGRILTLDEALPEADVVVWVASMPRTLEIDQASLRKPCLMIDGGYPKNLDTKVAGGGIHVLKGGIVEFCKDIGWTMMQIAEMEKPQRQMFACFAEAMLLEFERCHTNFSWGRNNITLEKMDFIGAASVRHGFSTLNLNPSAQAAAA

SEQ ID NO: 37129 - protein, 420 aa, Oryza sativa
SVAFLVATVVTVPLCALLLGGGGVAVVRDNNNNAGGGEAEVYRSELTPLQKHVAFFDRNKDGIIYPSETYQGFRAIGAGVVLSAVGAVFINGGLGPKTIPENTKTGLKLPIYVKNIHKGKHGSDSGVYDANGRFVPEKFEEIFKKHAHTRPDALTDKELKELLQSNREPKDFKGWLGGFTEWKVLYYLCKDKDGFLHKDTVRAVYDGSLFAKMEQEKHFKGFCGKLCEHATSRKGGTGGATLATATTYLLLPQIRRRQSDWERKSAGPELVLMARMCGASDGNDDRGGATGVGPWPDLGTTAAMEGWSGVAKATLKPRASVGPWLALGTAVVTMSREGPVGPVTGFDLDASLLVVGPCSHKMAMLADGRAMKAAWGRAVAAAAVPCADPAATAVPHPDLHGSSCGGGRSTVAAVGGARRW

SEQ ID NO: 37130 - protein, 359 aa, Thermobifida fusca YX
MKAAVLHEFRKDLVIEDVTVSEPAPDEVLIRVAASGVCHTDRTMQQGANDLPLPLILGHEVAGIVERVGSAVTAVEPGDHVVTCASAFCGTCRWCMRGELQHCAHKRRSRDPGQPPRLSQGDTPVEPFVGLGGFAEQVLVYEGAVVKLPEEMPLDRAALLGCSVITGMGAVRNAAQVQSGQTVAVIGCGGVGLNVIQGARLCGAAQIIAIDRLADKLDLARQFGATHTIDASTTDPVEAVRELTGGGVDHAIEVVGIAATMEQAFRMLDTKGTATVVGVAHPEVQVSIRATDLLLEKRLQGSKMGSARPRIDIPFYCQLYLDGRLKLDELLTARVPLSEVNSALAALDNPLGARTVLTF

SEQ ID NO: 37131 - protein, 284 aa, Physcomitrella patens subsp. patens
RIFTYRELSQATKQFSADELLGRGAFGSVFKGTLSDGSIVAVKQIAHDSNQGEREFLAEVSIISRIRHRNLVQLQGWCHEKGNLLLVYDYMPNGSLDKLLDGTNTNAKFAGWDMRHSVLRGVACALSYLHEECQQCVLHRDVKPSNVLLDENFNPHLADFGLARLIHHTTDNVQTTIIAGTRGYLAPELSQVGKASTKSDVFSFGVLALEVATGRKALDKNLPENQNVSLVDQVWRAHEQHTLLSIVDPKLDGSHDPEKMTTLLQMGLFCCHPDPEARPPMSFI

SEQ ID NO: 37132 - protein, 275 aa, Physcomitrella patens subsp. patens
MASALEKIWLYLINNFTDFQLASIGSFIIHESVFFLSGLPFIVMERLGYQRQYKIQGKVNSVAAQEKCVMKLLLYHICVNLPLMIVSYPVFKYMGFTSQLPLPSWNIVCFQILSYFILEDFIFYWGHRLLHTKWLYKNVHSVHHEYATPFGLTSEYAHPAEILFLGFATIFGPAITGPHLLTLWIWMSLRVIETVEAHCGYDFPWSLSRYLPIYGGADFHDYHHRLLYTKSGNYSSTFTYMDWIFGTDKGYRKLKALKAADHEYEYVEEKVPKTD

SEQ ID NO: 37133 - protein, 147 aa, Zea mays
MHTVALRTEATIPGGETPADLGQAFKNHMSEMFAYHATMMSNTLRTSIVVFTRTGFMAILLSHYRPSGTIFAFTDEERVRQRLALYQGVCPVQMEFSDDAEKTFGNALSYLLKHGMVKDGKEVALVQSGKHPIWRSQSTHNIQVRKI

SEQ ID NO: 37134 - protein, 99 aa, Cyanothece sp. PCC 8801
MATYKVTLINEQEGINATIDVPEDEYILDAAEEQGIDLPSSCRAGACSTCAGKLVTGTVDQSDQSFLDDDQVAAGFVLTCVAYPKSDCTIETHQEEALY

SEQ ID NO: 37135 - protein, 352 aa, Arabidopsis thaliana
MAIRSLPSSSGCSNSSSSSSYSLASTSLSNRLETIFRKASELCTLCDIEACVIYYGPDGELKTWPPEREKVEDIALRYSQLNEALRRKKSVTLYDFLNKKKNKTNLEKKAKIKDNDLKRLNVNVLKYPIADHYSPDQISQLIQSLEPHVSKVRERIRFVESQKHKETKPDHQSLASSSLNNQTQSLNPSQFSLFMYNHGDNILSQIPVSASNFNQDYFSALLEQSELKSQIMKQEVCGYEQNMCMSNNGDATLSQIPLSASNFNQEFSALLQEESGLMQQELCNYDQNMFMNNNNFQHSFVSNTQDHSAPAVQESVNNNYGLMPHVPCGYDQNLFTSDITNNNLLIDNSMFL

SEQ ID NO: 37136 - protein, 607 aa, Sulfolobus solfataricus P2
MIEPVLNLAIIFISLAVLVIILMKIFGKSTAKFAYSDKALQLQNKSQKKKVEIEDKKITWDDIGGYEDAKKEIREYIELPLKNKDVATKYGLKPPKGMLLFGPPGCGKTMMMRALANESKLNFLYVNISDIMSKWYGESEARLRELFNNARKNAPCILFFDEIDTIGVKRESHTGDSVTPRLLSLMLSEIDGLHSEDGVIVVGSTNVPQMLDKALLRAGRFDKLIYIGPPNKEARKQILQIHCRGKPLAEDVDFDKLAEITERYSGADLANLCQEAARKVASEAIEKGADRKITMADFIELIKKYKPSITLQMIEDYEKFRLDFERRVRKGEEENELEEKLTLNDIGGYNEIKTELKELLELQLYHYKLLEQLRVPPIRGILLYGPPGVGKTMMAKALAKTLNVKLIALSGAEIMYKGYEGAIAAIKEVFNRARENKPAIILLDELDAIASKRSYKSYGDSSKIVNQLLTEMDGIRSLKEVVVIGTTNRLKAIDPALLRPGRFDKIIHMPLPNREERLDILMKYIGKEECEKVDCGILADQTEGYSGADLAALAREAKMKVLKSILRGESNRTLTREDLIDALNKIHPSVKKRLSKGSSSNSDHETR

SEQ ID NO: 37137 - protein, 712 aa, Nostoc sp. PCC 7120
MEPSSLVLALEQTSEVLGKEPIVPFAILLVVLLVVPILFERLRLPGIVGLVLSGLVLGPSGWNLFHTKSPMISLLSDIGLVYLMFVAGLEVDLELWRRRQRRALGFGCVSFTIPLLIGTLVGRFFHFGWNTSVLIGSLLTSYSLLAYPIINRLGVISNQAVTITIGATVFTDISALIVLAICIPAFQMGMSNIYQILSLLGWLIIYSIVILVGFDWAGREFFRRSGDDEGNKFLFVLLTVFLAVVVAQLIGIEKILGAFLAGLAVNEAVGEGPVKEKIVFVGSVLFIPIFFINLGLLIDLPGLVNSLFTLQLTSLIVISLVASKFIAAWLAKVFYGYSWQEMLTMWSLSIPQVGTTLAATFVGYHTGLLSSAVLTSVVILMLITATLGPLITSRTARALTTVSITESVDANLPEPQVIETQNGNFTIVVPIYNPHTQQYLVEMAALLAHQAQGRIIPLTIATAAAHMDAPQLESTLQRSERLLAKATSQSQALGVAASPLLRIDDASAPGISRAAREQKANLIVMGWGKRTGLRARLFGNVIDNVLWSSHCPVAVTRLVESPKKIQRILVPVENLITPTLQPVQFAQMLAEANQAQVTVLNVCDRRTSSSKIASRRSQLALLVSKLALPNSPEVQIIAHENAAQAILQAARLYDLVVLPFIRNRTSPGGLALSDVTTQLASQLTCSIVMLGEPQRLQTGNITSVAPNTTTAV

SEQ ID NO: 37138 - protein, 385 aa, Caulobacter crescentus CB15
MVHPVFDNLPTTIFERMSGLARQYGAINLGQGFPDDQGPLPVREAAARALIEGSNQYPPMRGLPELRAAVAGHYGRTQDLTLDPDTEIVVTSGATEALAAAFTSLISPGDEVVLFQPLYDAYLPLVRRAGGVPRLVKLSPPHWRFERAMLEAAFSNRTRMVVLNSPLNPAGVVAPDEDLALLAEVCVRHDVVAVCDEVWEAVVFDGRRHRPLMSFPGMRERTVKIGSAGKLFGMTGWKVGFLCAAPPLARALAAAHQFLTFTTPPNLQAGVAWGLDNHRAWFDDMPANLQRSRDRLTAGLRDAGYVVLESQGTYFLNVDLAASGIALDDVTFCERCVTEHGVAAIPVSAFFAEDPVTTVVRLCFAKADATLDEAVRRLAAAKAAL

SEQ ID NO: 37139 - protein, 461 aa, Nostoc sp. PCC 7120
MRVCVIGTGYVGLVTGACLAHIGHDVICIDNNEEKVKIMKAGQSPIFEPGLSEIMQSAIQSGKIQFSTDLAAGVAHGEILFIAVGTPPLPTGESDTRYVEAVARGIGANLNGGYKVIVNKSTVPIGSGDWVRMIVLDGIAERQKTLVTAGGSVEDKLPELPQFDVVSNPEFLREGSAVYDTFNPDRIVLGGNSSRAIAAMQELYAPIVERKFAENQSLPPVPILATDLSSAEMIKYAANAFLATKISFINEVANICDRVGADVTQVAKGIGLDSRIGNKFLQAGIGWGGSCFPKDVAALIHTADDYGYEAQLLKSAVSVNERQRLIALEKLQQVLKILKGKTVGLLGLTFKPDTDDLRDAPALNLIEQLNRLGAKVKAYDPIVSQTGMRHGLSGVLVETDAERLADGCDALVLVTEWQQFSGLDYAKMAKLMNNPVVIDGRNFLDPETLVRAGFQYVGVGR

SEQ ID NO: 37140 - protein, 411 aa, Zea mays
MNALAATTRNFRRASKLLGLDSKLEQSLLIPFREIKVECTIPKDDGSLATFVGFRVQHDNARGPMKGGIRYHNEVDPDEVNALAQLMTWKTAVAAVPYGGAKGGIGCSPGELSRSELERLTRVFTQKIHDLIGTHTDVPAPDMGTNAQTMAWMLDEYSKFHGHSPAVVTGKPIDLGGSLGRDAATGRGVMYATEALLAEYGKCISGSTFVIQGFGNVGSWAARLIHEKGGKIIAIGDVTGSIRNTAGIDIPALVKHRNEGHAMKDFDGAEVLGSTELLVHDCDVLVPCALGGVLNKDNAPDVKAKFIIEAANHPTDPEADEILAKKGVVVLPDIYANSGGVVVSYFEWVQNIQGFMWAEEKVNDELEKYMSSAFQHMKAMCKSLDCDLRMGAFTLGVNRVARATLLRGWEA

SEQ ID NO: 37141 - protein, 75 aa, Synechococcus sp. WH 7803
MPAIHCRCTPAIATTLAELSAKGCCTIIGGGDSVAAVEKAGLAEKMSHISTGGGASLELLEGKVLPGVAALNDAA

SEQ ID NO: 37142 - protein, 763 aa, Ehrlichia canis str. Jake
MLDLENSSFDGKKKEALEFHCKDSKPGKVSLLPTKPLLTQRDLSLAYSPGVAVPCLEIAKNPDLIYEYTARGNYVAVISNGTAVLGLGNIGPLASKPVMEGKAVLFKRFADIDAVDIEVDTSDVDEFINAVKYLGLSWGGINLEDIKAPECFIIEKKLSEIMDIPVFHDDQHGTAIIVSAGLINALDITGKNFKNVKIVINGAGAAGIACLEMIKLIGVPADNITLCDQNGVIYKGRQLGMNEWKEKHAIETKDRSLKDALVMADVFLGLSVKDVLSKDMLLSMNKDPVIFALANPDPEINPDIAREVRPDAIIATGRSDYNNQINNVMGFPYIFRGALDVRAKSVNNEMKVAAANAIAMLAREYVSDEVSDAYGGRKMNYGKDYIIPTPFDPRLITIVSPAVARAAIESGVARKKIEDWDEYTKQLASRLSSTSNILNMMYSAVKRDPKRVIFSEGEEEKVIKAAVQWRNQGYGLPILVGRIDKVQEAFERLGIKNIQGIEIANAAVSKRNDEYTDYLYKKLQREGYLYRSCVRDVKTDRNVFAACMLACGDGDVLITGLTRSYSASISDVQKVIGSQGVVFGLSVIVMKERTIFVADTAIHESPTPEQIAQIAIQASIQARKMGHEPRVGFVSSSNFGSHCQEDARKMRKAVEILDSCNVDFEYDGEMSVDTALSSELLTLYPFCRLTGAANILVMPTLHSANISSKLLQQAVGVSVIGPVLIGMEKPVQIVQMSSSVSEILNLAVLAPSVNSNVQSCDSI

SEQ ID NO: 37143 - protein, 580 aa, Photobacterium profundum SS9
MQGFVVFLFHALSQAWKDGYSFSKFRSDVVAGITVGIVAIPLGMALAIAVGVPPQHGLYTVIVAGLLAALLGGSRFNITGPTAAFVVILLPITQQYGLTGLMLATFMSGIILVLMGLLRLGQLVAYVPYPVTTGFTAGIGLVIAFLQLKDLLGLEVAGNPIHFPEKVMAYASALPSIHFADAFIGGVTIIVFIAWAKLKTRIPPHVVALVIGTVLALVMNQSGGVHVGLLGEKFQYQIGDLIGQGIPQVMPQFNVIWQNDVVTWSLVIELLPAAFTIAMLGCIESLLCAVVADGMTGTKHNSNSELVGQGLANMVVPFFGGIPATAAIARTATNIRAGAFSPVSAIVHAVFVLAAMVALAPALSYVPMSALAGLLIMVAWNMSEAPHFVHTLKVAPHRDIAVLLTCFSLTVVFDMVVAVAVGLLLAGILFIQRIATLTTVTVVNKGHEHLDFGPDVLVYDINGPLFFAASEKAFSVIERSSIDTKVVVLDFTDVTTIDITAIHAFENALERISHYPVYLLGVAPHVATKLVNSGILSAGNIALCPDASSLREHLAINNHNLALQESTPSTVSLYTADSGI

SEQ ID NO: 37144 - protein, 341 aa, Physcomitrella patens subsp. patens
MHQDNWNNISFGSRPLTDLSVPELRHNSSRLKIFSGTANLQLSQEIACYMGLDLGKIKIKRFADGEIYVQLQESVRGCDVFLVQPTCPPANENLMELLIMIDACRRASAKTITAVIPYFGYARADRKTQGRESIAAKLAANLITEAGANRVLTCDLHSGQSMGYFDIPVDHVYGQPVILDYLASKMISSDDLVVVSPDVGGVARARAFAKKLSDAPLAIVDKRRQGHNISEVMNLIGDVKGKVAVMVDDMIDTAGTITNSAALLHAEGAREVYACCTHAVFSPPAIERLSGGLFQEVIITNTIPVKEQNYFPQLTVLSVANLLGETIWRVHDDCSVSSIFR

SEQ ID NO: 37145 - protein, 458 aa, Microcystis aeruginosa PCC 7806
MLSNSEKLAKLRQYFVSGATRSYQFRRQQLEKLKQAIIKYEGEIYQALYRDLKKSPEDCWITENGFLLGEINNALKNLRSWMQPKPVKTNLLNFPSSSQIIREPLGVVLIIGAWNYPLQLLLVPLVGAIAAGNCAVLKPSEFASATEKLVIKIIQEIFPEEYVLIVPGDGAEVIPNTLDSFTFDHIFFTGSTRVGKIIYQLAAEKLIPVTLELGGKSPCVIEADANISVATRRIAVTKFSNCGQMCIAADYVLVHQSQQENLIRELANTIVNFFGEDARLSADYGKIINDKQFDRLIDLLKDGEIVFGGKTDRENLYIQPTLLTNVSLDAPIMQGEIFGPILPIIAFSTFEEALAIIAKNPNPLAFYLFTTKAKTEKKWLESVQFGGGCINNNSFHFTNPSLPFGGRGNSGIGSYHGRFSFENFSHQKAIMKTPLWFNPVLKYPPFKGKLNLFKLLVR

SEQ ID NO: 37146 - protein, 541 aa, Physcomitrella patens subsp. patens
MAFARAAARRLLGGRAKFTARSATSASRDLTGSAVHHQDLQPPVHGHSRNSRLENGVVRLDKMERSTPSRHMCTMPELPSEKSSTVTGMITVAELKELARTKTIDTVVVGLTDCYGRLVGKRYTADFFLESAVDDGTHACSYLLATDMDMEPVPGYKFASWEAGYGDIHLVPDMKTLRVASWLEKTALVLCDVVQDDHELAPHAPRSILRNQIKAAQAVGKFTPMAASELEYFLYKDTYEESKNRGYHNLKPAGWVREDYHIFQGTRGEYFHGPARRHLEASGVPVENSKGEFGLGQHELNVKYAEVLEMADRHSVYKQCLKELADSMGVSVTFMAKPDAAQPGSSCHIHLSLWENGRNIFAGNQTLGSTKCSDEFRWFLGGWMHYTPELMCFYAPNVNSYKRYVSGSWAPTQIAWSRDNRTAPFRVLGSGKSLRIECRLPGADCNVYLAFAAALASGMDGIRNKIEPPPQLEGNVYFAKDLLTIPQSLGAATAAFKDSKFAKEMLGEDVHHHYHHFFDNELLAYQQAVTDWEKARYFEQI

SEQ ID NO: 37147 - protein, 623 aa, Porphyromonas gingivalis W83
MFQAQHLTKSFGDLVLFEDLSFSIERGEKVGLIARNGNGKTTLMNILTGIDSPDSGEVIYQNGIRRAYLPQLPQVLPGSTVLETCFGHNDEMTSLIAQWEEASARGDGKRMEELLPEMDALGAWEYEQRAREILTRLHLDDLHCTTDNLSGGELKRIALAGTLIGNPELLFLDEPTNHLDLDVIEWLEGYLSHQQIGLLLVTHDRYFLDRVCNRILELDNKQLYAYKGNYEYYLNKREERLEATERETSRAANLLRREAEWMHRRPQARGTKAKSRIDAFYELKEKAQPRHRDETLHLSEQGRYIGNKIFEAHKVCKAFGDRTILSDFDYIFSRYDKVGIVGPNGVGKTTFLRLLLGEEKPDSGYFDVGETVRFGYYSQKGMQFDENKRVIEAVQDIAEVIRNEKDGTTLSASALLTQFLFPPEKQYTPIHKLSGGEQRRLYLCTVLMKNPNFLILDEPTNDLDILTLNVLENYLSEFKGCVLVVSHDRFFMDKVVNHLFTFEGNGIVKDFPGNYTQYREYKQQEEAERQTVESSPSTRKAESEKPRTDAAERPRKLTFKEKQELERLEAELPKLEKEKAELESRMSSGTMATDELLTAGDRIAALIEEIDSKGMRWLELSDI

SEQ ID NO: 37148 - protein, 223 aa, Xylella fastidiosa Ann-1
MSNCLIAPSILSADFARLGAEVDAVLAAGADWIHFDVMDNHYVPNLTFGPMVCKALRSYGITAPIDVHLMVEPVDRIVPDFAQAGASMISFHMEASRHVHLTIQLIKSHGCMAGLVFNPATPVDMLDWVLPELDLVLLMSVNPGFGGQRFIPGTLDKLRLVRKKIDLLGRPVRLQVDGGVGIDNIGAIAEAGADTFVAGSAIFHAPDYGDVIAHMRAAVAAVR

SEQ ID NO: 37149 - protein, 468 aa, Leuconostoc mesenteroides subsp. mesenteroides ATCC 8293
MSQQKNATMNADGTIRGLKKKHVQMIAIGGTIGTGLFLGAGNSIAKTGPSILIVYAVLGAFFFMMMRGIGEMLYADPSQHTFVSFISKYVGAGAGYFAGWSYWIGLLFVAMAELTAVSTYVKFWFPSWKTWIIQILFLFVLTMINLIAVRVFGETEYWFAMIKIIAIVAMIVTGLILIFTGFKAPASGGHTVASFSNVFSNFSLFPNGASMFFAAFPMVFFAFQGMEFVGITTAETENPREVLPKAINTIIIRILIFYLGAMIIIMSIINWHVIAKTPESSPFVMVFQLAGFKAAATIINFVVLTSAASALNSAIYSAGRHFYQLAEESDSKFMINFREISSNGVPAKAIIFTAILVLISPVINSIPQITSAFGLITSISSNMYIIVYAMTMYAHRKFRESTNFMPDGFLMPGYKWTSPLTLLFFVSIYASLFFQADSRVAAIGAILFTIVFGYLSHRKFSTKNAVTV

SEQ ID NO: 37150 - protein, 314 aa, Oryza sativa Indica Group
MSARAAGGGGDGDGGGRRKTLAKVSLSSLSAAAAEAATFPIDAVKTRLQLHRGTGGSGGGGGGVMRVAGELVRDGGIYRGLSPAVLRHLFYTPLRIVGYEHLRSTFASGGRDAGLLEKALAGGVSGVVAQVVASPADLIKVRMQADSRLLSQGIQPRYTGIFDAFTKIVRAEGFRGLWKGVVPNAQRAFLVNMGELTCYDQAKHFIIRKQICGDNLYAHTLASVASGLSATTLSCPADVIKTRMMNQGKDAKVLYRNSYDCLVKTVKHEGLTALWKGFLPTWARLGPWQFVFWVSYEKLRQASGSIQNKILLIV

SEQ ID NO: 37151 - protein, 199 aa, Candidatus Tremblaya princeps
MPTLLPPGTGTIGLARRISRHCGIRVGLMECGRYADGERYGDIAQNVRNNDELLLHTLCSPVNSIGEIILAQASGVTLVLPYVAYGRQEKHAQGTRATLSARCVASVLSRNLVAMDLHLSKRHVFFDVPTQLLSMRHAFDEYRLPGSARSTARVSPDAGGAMDVVTDTIPHDPRDLGLSARVLASACVRAREIGASLPC

SEQ ID NO: 37152 - protein, 300 aa, Azoarcus sp. EbN1
MPQLPAPTDVTPARKAEILAEALPYIKRFFDKTVVIKYGGNAMTDPHLKDCFARDVVLLKLVGLNPVVVHGGGPQIETLLARVGKKGEFIQGMRVTDAETMEVVEMVLGGQVNKEIVSLINQHGGKAVGLTGKDASFIRAKKLLMQKEDAAPGDVVDVGQVGEITKIDPSLIAFLDQGDFIPVIAPIGVGEAGETYNINADVVAGKLAEILKAEKLVLLTNTPGVLDKAGKLLTGLTPHQIDDLVADGTLSGGMLPKISSALDAARNGVKSVHIIDGRVEHCLLLEILTDHGVGTMIKSK

SEQ ID NO: 37153 - protein, 337 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDAAHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 37154 - protein, 513 aa, Physcomitrella patens subsp. patens
MSTLEIEARDVIKIVLQFCKENSLQQTFQTLQNECQVSLNTVDSLETFTADINNGRWDAVLPQVAQLKLPRKKLEDLYEQIVLEMIELRELDTARAILRQTQAMGFMKQEQPERYLKLEHLLVRTYFDPREAYQESSKEKRRAQIAQALSVEVTVVPPSRLMALIGQALKWQQHQGLLPPGTQFDLFKGAAAVKADEEEIYPTVLDHTIKFGKQSHPECARFSPDGQFLVSSSVDGFIEVWDYLTGKLKKDLQYQAADAFMMHDEAVLTIAFSKDSEMLASGSQDGKIKVWRIRTGQCLRRFERAHGQGVTSVSFSRDSTQVLSSSFDGTARLHGLKSGKTLKEFRGHTSYVNDSIFASDGARVITASSDGSVKVWDVKTTDCLHTFKPPPPLRGGDATVNSIHIMPKNPEHIVVCNRASAVYVMTLQGQVVKSLSSGKREGGDFVGATVSPKGDWIYCVGEDRNIYCFSHQSGKLEHLMTAHDKDIIGVTHHPHRNLLVTFSNDNTMKLWKP

SEQ ID NO: 37155 - protein, 510 aa, Bradyrhizobium sp. BTAi1
MKDILDTLETRRAGARLGGGEKRIEAQHARGKLTARERIELLLDKGSFEEFDMFVEHRSTEFGMEKTKVPGDGVVTGWGTVNGRKTFVFAKDFTVFGGSLSETHALKITKLQDMAMKARAPIIGLYDAGGARIQEGVAALAGYSYVFRRNVLASGVIPQISVIMGPCAGGDVYSPAMTDFIFMVKNTSYMFVTGPDVVKTVTNEVVTAEELGGASVHATRSSIADGAFDNDVETLLQMRRLIDFLPSNNTDGVPEWPSFDDIERVDMSLDTLIPDNPNKPYDMKELILKVVDEGDFFEIAEGFAKNIVTGFGRIAGRTVGFVANQPMVLAGVLDSDASRKAARFVRFCDAFNIPIVTFVDVPGFLPGTAQEYGGLIKHGAKLLFAYSQCTVPLVTVITRKAYGGAFDVMASKEIGADMNYAWPTAQIAVMGAKGAVEIIFRADMADPEKIAARTKEYEDRFLSPFIAAERGYIDDVIMPHSTRRRIARALAMLRDKKMEMPAKKHDNLPL

SEQ ID NO: 37156 - protein, 455 aa, Oryza sativa Japonica Group
MASPSLAAAAASPLTSLDLATSPATASRPAAAAASALRKRPVLLLDQRHHPSTPNLDSSAAAAAAAAAAGVAQAQPPPPRRKKAGHTSSSTRPRWQTALSVAAKNAVLLAVLLYVGDLAWRAARPAPPRPVDQAAMAGYDARVADVEASLARAFRMLQVQLEAVDRKIDGEVGAVRGELAALLEEKRLELEGQLKRLDARADDLSDALGALKRMEFLRKDEFDKFWNEVKESLGSGPGTEVDLDQVRALAREITMGEIEKHAADGIGRVDYAVASAGGKVVRHSDAYDAGKRGGFFSSLLSGDTAASPKKILQPSFGEPGQCFPLQGSSGFVEIKLRKGIVPDAITLEHVSKDVAYDMSTAPKDCRVSGWYQEAHNEAYSGHAASAKMYVLTEFTYDLDKKNVQTFDITAPDVGIINMVRLDFTSNHGSSALTCIYRIRVHGHEPVSPGMSVSQS

SEQ ID NO: 37157 - protein, 344 aa, Fulvimarina pelagi HTCC2506
MRALQLVGDKDLKIVDLPKPEAPGPGEVTVRIATVALNHIDVWGWRGMAFAKRKMPLVIGAEASGVVTTLGQGVSSLLPGQLVSIYGARTCGLCKPCREGHDNLCEHVSGVHGFHLDGFAQEYVNLPARLLVPAPPGCDTVGAALAPVTFGTVEHMLFDNAKLEPGETILIHAGGSGIGSVAIQLAKKIGCTVITTVGSDDKVEKAKALGADHVINYREDRFEGVVRKLTKKKGVDVVFEHVGKDTFAGSMLCMKRGGRLVTCGSTSGVSTEINLMMLFQQQLKFFGSFGCRMENIADAMQKIARGIAHPVIDTEVTMDEIEVALKRMEGRKVFGKVILKMSDA

SEQ ID NO: 37158 - protein, 384 aa, Oryza sativa Japonica Group
MREFSFEEVEAATGGFAAKNLVGKGSHGNVYVARLVCGGDGGGGRVRKKKVVVVAVKRASHALGEAKLANEIAVLAAAGEVAGVVNLVGVAAGRREGERMLVMEYMADGSLHDLLHRPTTARQPPPPWPRRVEIALDVAEAVRALHGGEPRVIHRDVKSANILLGRDGRARLADFSLAVKVPAAPGGGGATAAAAGPAPAGTIGYLDPCYTEPSRLGPESDVFSFGVVLLELVSGRKVMDVSASPSSIVAWAVPLVAAGMAREVFDGRLPAPRRAREERAVARVLAVAARCVSEAVERRPAMSDVVAELHAALESAGWPRRPRRRGDAHGLAGTLYRRVVSWAASRLHVRRRRVRTSKIECTEHSGSEGSGAQAQPNYPEACQL

SEQ ID NO: 37159 - protein, 277 aa, Thermobifida fusca YX
MCRGGGAHTDDDTTPLRKDATMRRFEGRIAAIVGGGSGMGRAISHRLASEGATVYVADLSEESAKKVAEEITAQGGKAVPVQVDATNNDSLRALFDRIRSDHGVLHVLHAQVGMPGPGGIETSDEEWQKNIDVNIKSAYYTCTLGYDLLKSANGKGSITMTSSTSALVGSPFSPIYSLTKGSLVPFARALALKGAPDGIRVNVICPGTVQTPMLAQFFGREPGADVSELTKDFIKNIPLGRGAQPEEIASVIAFLASDDASYVTGVTIPVDGGLTAK

SEQ ID NO: 37160 - protein, 93 aa, Oryza sativa Indica Group
MAMKDPSLWHKVAAISGVAALGLGTYGAHMFRPKNPAYKECLSSLQFGGLLTAGIVLFSGTCYTVAYLEDRKYSSTAPLGGFAFIAAWASLLF

SEQ ID NO: 37161 - protein, 480 aa, Pseudomonas fluorescens Pf-5
MSDNNKRDDDMQSQDSGLRRGLTARHIRFMALGSAIGTGLFYGSASAIQMAGPAVLLAYLIGGAAVFMVMRALGEMAVHNPVSGSFGHYASQYLGPLPGFILGWTYAFEMLIVCLADVTAFGIYMGFWFPEVARWIWVLGIVLFIGGLNLCNVKVFGEMEFWLSLLKVGAIVAMILGGLGIMLFGISSAAQDQATGAANLWAHGGFMPNGISGVIASFAVVMFAFGGIEIIGVTAGEAQDPKRVIPKAINAVPLRILLFYVLTLFVLMSIFPWPQIGTQGSPFVQIFDSLGISSAATILNIVVISAAVSAINSDIFGAGRMMYGLARQGQAPKGFAQVSKHGVPWMTVVVMAVTLLIGVVLNYLIPENIFLLIASLATFATVWVWLMILLTHVAMRRSMTAEQVAQLQFKVPFWPWAPAAAIAFMLFIFGVLGYFPKTQGALIVGVVWIALLVVAYMLWVKPMAGQAQAIMSDAPLPTDH

SEQ ID NO: 37162 - protein, 176 aa, Brassica napus
  misc_feature (3)..(3): Xaa can be any naturally occurring amino acid
MTXKKKDDDFKLLCLLLFLTSSIQTDASFGVGGGVGVGVGGGVVGGGGVWIGGGNGNTVPTTAPNSAVYNALQAWKAAITEDPSGVLKTWVGSDVCSYKGVFCSGQSITAIDLNHANLKGVLVKDLAYLSDLNILHLNSNRFYGQVPESFKDLDSLQELDLSNNRLSGPFPLVTIY

SEQ ID NO: 37163 - protein, 260 aa, Bartonella quintana str. Toulouse
MTAETERIGVKGGMEYSFGFTKIDEAQKQSMVDGVFHSVAENYDKMNDILSLGLHRTWKNSMVAWLSPPALSNWKVLDVAGGTGDIAFRILNASRKKAHATVLDINSSMLSVGKKRAQKNGLAPLTDFVEANAEHLPFEDQSFDAYTIAFGIRNVPHINQALREAFRVLKPGGRFLCLEFSNVEMPLLNKIYDLWSFHVIPKLGQFIADNGDAYRYLVESIRKFPKQDDFSHMLNHAGFSRVSYRNLTGAIAALHSAWKI

SEQ ID NO: 37164 - protein, 357 aa, Prochlorococcus marinus str. MIT 9301
MKKYKIVLLSGDGIGPEISEVSKKVLKKLSKNHNFDIEIIEKLFGGIAYEKYGTPAPDETLDQCKKSDAVLLACVGDIKYDSLARELRPESGLLKLRSALNLFANIRPVKIRKSLLDASSLKKEIVEHVDLIVVRELIGGIYFGKPRGHITNTKIPKAFNTMVYDSNEIERITEIAIKIANQRNKKICSVDKSNVLEVSQLWRDTVLNITSKDKNISLSNMYVDNAAMQLVRDPGQFDVILTSNLFGDILSDLAAMLTGSIGMLPSASLNNNGPGVFEPVHGSAPDIAGKNIANPIAMLLSASMMLKIGLNEEEAAENLETAIDKVLSKGFRTADLADGSTEVLSCSEIGDKIINEI

SEQ ID NO: 37165 - protein, 380 aa, Fragaria x ananassa
MSSTEGKVICCRAAVAWEAGKPLVIEEVEVAPPQANVVRVKILYTSLCHTDVYFWEAKGQNPLFPRIYGHEAGGIVESVGEGVTDLKAGDHVLPVFTGECKECDHCKSEESNMCDLLRINTDRGVMLNDGKSRFSIKGKPIYHFVGTSTFSVYTVTHVGCLAKINPQSPLDKVCILSCGISTGLGATLNVRKPKKGSTVAVFGLGAVGLAAAEGARMAGASRIIGVDLNSNRFEEAKKFGITEFVNPKDHKKPVQEVIAELTNGGVDRSIECTGNIQAMIPAFECVHDGWGVAVLVGVPHKDAVFTTHPMNFLNERTLKGTFFGNYKPRTDIPSVVEKYMNKELEVDKFITHQLPFSQINKAFDYMLKGEGIRCIITMEE

SEQ ID NO: 37166 - protein, 285 aa, Pseudomonas abietaniphila
MFTYVAWEIHSNNNKKGAAMSLLRGQVALITGAGGGIGRSVALSFAKQGASVVVAELDEASGAAVAEELKALGAQALFIRTDVSSKADIQAAIDAAVTHFGGLDILVNNAFAPTPNVLLEEKTDDMLERTLNSTVWAAWWSMKAAFPHMQARGGGKIINFYSIDTEIGAWLHGDYNTAKSAVVGLTRSAASEWGRFNIRVNAIAPTAMGATFHKLAEENPGFAEMSAGLRPLGRCGEPEEDIGPVVVFLASEMSRFVTGETLHVDGGLHLPGYNSRPKDIPAREY

SEQ ID NO: 37167 - protein, 183 aa, Microcystis aeruginosa PCC 7806
MTATTPTNKTRNLLLAVTAVILSVAIFFGFQTTASSVSLEAQAEKATPFDLALSNGKPTLTEFYANWCTSCQAMAPEIAEIKKQYGNAINFVMLNVDNNKWLPEILRYRVDGIPHFVFLNNQGQPVAQAIGEQPKSILTANLEALLTNSTLPYATTAGETSDFNILVGASQTDPRSHGSQVKQ

SEQ ID NO: 37168 - protein, 178 aa, Prochlorococcus marinus str. MIT 9301
MKEANSNDNYDAQTLLLNDSNGNELFCYLEQLVSVEGQEYALLTPVDTPVSLFKINEKDEPELIEKIDKNEQILKNAEAVLQEHDLRLVRSAVTLTVSGELEEPIYDELEEDYVDDDSESYELLVNFNLLDQEYGLYIPLDPFFIVGKLKDKGALLVEDDEFDKIQPLIETELEKSSS

SEQ ID NO: 37169 - protein, 425 aa, Sulfolobus solfataricus P2
MSKENIFDALKSGKIDYVRVEFVDILGNTKGRSLRRAEFENVINDNKGVDYPESLALMDYKDRPIKSRYEDIIAIPDLNTFVAIPYLERTARVLSFLAQPDGLPYPYCSRSILNKAIEKLKEAGYTLQVSFEPTFYLLNSALNPADYSKAFSLEGLLEQQNFLKLLIKYLEEIDIKVETINKHYGPGQYEVKLSQKPVLEAADSLISSREVIRDTAKMNNVIATFMPKPFKDYPSSSMDITLSLQTVDGKDIMYDPNDSKGIGLSKIAYNFISGILEHLPSILSIAAPTVNSYKRFKEVVTPNMPGIGSERHYIVRLPSYYKDTHQVEFRLADPLANPYILLASMIYAGLDGIERNLMANVNEYYGTLPQTLKESLSRLENDTYMKYNLGQDLISIYINIKNIEIEEYESQITEWERDYYLKAGW

SEQ ID NO: 37170 - protein, 306 aa, Oryza sativa Japonica Group
MDSEHWISSLAAAKRFYAAQLGHVDDMAGIGMEEVEMEMEDDGEGMELELEMQLEEATWPDVACPYCYEDHDIASLCAHLEEDHPYEPHTSAYFCKQATGVDFAMAQNNLEKLMMPCPICFEKITRDMLNHITMQHGYLFKSGRRMRRFDIPESQALSLLSRDLRDAQLQALLGGGHRQRRSNTTATNISADPLLSSFGLGFSTLDSEERSKAPVPIPDDTSIHKDTPAQPWESRNIGLYKHKSCYMLYNAKANAEAPFISNQLSKNVSRFFMKTDKIPRKRFTITLGVQNYYLTTMKVYVQVECP

SEQ ID NO: 37171 - protein, 319 aa, Haloarcula marismortui ATCC 43049
MRRVIIDTDTAGDDTQAILLFCLSDRVTVEAITVVAGNVPFDREVENANYTLELADSLDVPVYEGARQPLLKEFEHAAYIHGEDGLGGDLFPETDIESASGFGPDEIVDRCRAAPGEITLLCIGPLTNLALAYAREPELPELVDEVWVMGGNVNCEGNVTPAAEFNLWVDPDAAKRVFNAFEVTLVDWGVCLRDAVFGSSEFGAVSAFDTELASFFESVTEQARAFNSEGPDDPGWTALPDSVTAALLAYPELREAVSTYHVAVDDRDGLTRGYTSVDVNGVTDGDPNTHVVESVDSDAFQSVMYSLLQSRDPDSGIAE

SEQ ID NO: 37172 - protein, 622 aa, Shewanella oneidensis MR-1
MSLDISQFPVLAQANTPNELRQLPQALLPQLADELREFLLKSVGMSSGHFASGLGTVELTVALHYVYNTPFDRLIWDVGHQAYPHKILTGRRDRMHTIRQKNGLHPFPWREESEYDTFSVGHSGTSISAALAMAVAAEKEQAGRKVVAVIGDGAMTGGMVFEAMNHAGDLHNDMLMVLNDNEMSISENVGALNNHLAQLMSGRFYTTIRESSKKVLKGMPVIKEMAKRTEEHLKGMVVPGTLFEELGFNYIGPIDGHDVDALVETLRNMRNLKGPQVLHIMTKKGRGYEPAEKDPIGWHAVPKFDPSLFKKPATKPGLPTFSQVFGKWLCDIAEQDEKVLGITPAMREGSGMVEFSQRFPKQYFDAAIAEQHAVTLGAGFACEGYKPVVAIYSTFLQRGYDQLIHDVALQRLPVLFAIDRGGIVGADGPTHQGAFDLSFMRCIPNMVIMAPSDENECRQMLYTGYCYDAGPSAVRYPRGSATGATQVEAMTALPIGKGVIKRLGKRIALLNFGTTLAAALTAAESLDATVVDMRFVKPLDVDLVKEMAQTHDVLVTVEENAIMGGAGSGVLELLQQLKMPKPVLQIGLPDEFIKHGSPDEVIHDLQLDAEGMLAQINAYLAN

SEQ ID NO: 37173 - protein, 445 aa, Porphyromonas gingivalis W83
MKTQEIMTMLEAKHPGESEFLQAVKEVLLSVEEVYNQHPEFEKNGIIERIVEPDRVFTFRVPWVDDQGKVQVNIGYRVQFNNAIGPYKGGIRFHPSVNLSILKFLGFEQMFKNALTTLPMGGGKGGADFSPKGKSEAEIMRFCQSFMTELWRNIGPDTDIPAGDIGVGGREVGYMFGMYKKLAREHTGTLTGKGFEFGGSRLRPESTGFGAVYFVQNMCKQNGVDYKGKTLAISGFGNVAWGVAQKATELGIKVVTISGPDGYVYDPDGINTPEKFRCMLDLRDSGNDVVSDYVKRFPNAQFFPGKKPWEQKVDFAMPCATQNEMNLEDAKTLHKNGVTLVAETSNMGCTAEASEYYVANKMLFAPGKAVNAGGVSCSGLEMTQNAMHLVWTNEEVDKWLHQIMQDIHEQCVTYGKDGNYIDYVKGANIAGFMKVAKAMVAQGVC

SEQ ID NO: 37174 - protein, 400 aa, Magnaporthe grisea 70-15
MSTATEDSTNGKRKATEDPASPVSAKRPKHESPDSPEKKKPNEIARIPFPEKPAVIEERNGEIEFRVVNNDNERESLIILTGLKCIFQKQLPKMPKDYIARLVYDRTHLSIAIVKKPLEVVGGITYRPFKGRQFAEIVFCAISSDQQVKGYGAHLMSHLKDYVKATSDVMHFLTYADNYAIGYFKKQGFTKEITLPKSVWMGYIKDYEGGTIMQCSMLPRIRYLEMGRMLLKQKECVHAKIRAFSKSHIVHQPPKQWKNGIEPIDPLSISAIRASGWSPDMDELARQPRHGPNYNQLLHLLNDMQNHQSAWPFLVPVNKDDVADYYEVIKEPMDLSTMENKLEMDQYPTPEDFIRDAKLIFDNCRKYNNESTPYAKSANKLEKFMWQQIKAIPEWSHLEP

SEQ ID NO: 37175 - protein, 339 aa, Debaryomyces hansenii CBS767
MGQLLSHPIEDKTMEHKSYDTITYCIGLMQGYRMSMEDAHNVKVNEDESLAVFGVFDGHGGKTCAEVVSDKLPTMVFRELSSLLKNGNGDLASYMKVLKDSFFRIDRDLTNEDSSNCGTTAIIASIIANEYIIVSNAGDSRCIMSLEGGAPKTLSFDHKPSTMGERVRIENSGGYVVNGRVNEILALSRAFGDFKFKLPYMELLNNQNKYIAANKKYFKHELIHLPPELFLVSVEPDVVVYDLKSLKQPEFVVLACDGIWDCYTNTKLIKIIRDKLSLDWKIHHITEFILNDCVGMANNVTGIGFDNMTIIIVAVHNNNNIDEWYTMMKERVLKEKGLL

SEQ ID NO: 37176 - protein, 198 aa, Ralstonia metallidurans CH34
MKDLESELIGSARLPTRYGEFTAHAFQGVDTGTEHLALSMGEISGENLLVRLHSECLTGDVFGSCRCDCGEQLDLAMQRIAEEGRGILLYLRGHEGRGIGLSNKIRAYALQDGGLDTVDANLALGQAIDSRTYAFAADFLRQWGVSSVRLMSNNPIKIKALEDAGIKVTEQVRHVVPANAENEKYLATKRSRMGHLLD

SEQ ID NO: 37177 - protein, 367 aa, Photobacterium phosphoreum
MALSSAKEIIDDIRQGKMVILMDDEDRENEGDLIIASEKITPETINFMAMYGRGLICLTLSKARCQKLGLPLMVQDNTEQFGTPFTISIEAATGVTTGISAADRARTVQAAVAADATAANIVMPGHIFPLMAQEGGVLTRAGHTEAGCDIARLAGLEPSSVIVEILNEDGTMARRPQLEIFAEKHGLKLGTIADLIEYRNHHETTIERVGECKLNTEFGEFDMITYRDKIDDQIHYALCKGDIEADAATLVRVHLQDTFKDILQSGATQWTLPAAMQRISAENGVLVILSKQESTDSIINKVKNIAAEKEGRPQVKMSPYNPSRQVGVGSQILSDLGIGKMRLLSSSTQRYHSLSGFGLEVVEYICE

SEQ ID NO: 37178 - protein, 156 aa, Photobacterium phosphoreum
MKVIEGAIAAPNAKIAIVIARFNSFINESLLSGALDALKRQGQVSEDNITVVRCPGAYELPLVAQQVAKSDRYDAIVALGSVIRGGTPHFDYVAGECNKGLAQVALEYNTPVAFGVLTVDSIEQAIERAGTKAGNKGAEAALSALEMVNVLSQIES

SEQ ID NO: 37179 - protein, 248 aa, Porphyromonas gingivalis W83
MKLLENKVALITGAGRGIGRAIAYKYATEGADVAITDLNIDEGVQAFVEELKGLGVRAAAYASNAADFDAAHTVVEQIKADFGRIDILVNNAGITRDGLMMRMTEQQWDAVINVNLKSAFNMIHAVTPIMMGQRTGSIINMASVVGVSGNAGQSNYSASKAGMIGLAKSVAKELGSRGVRANAIAPGFIITDMTAVLSEEVKKQWAAQIPLRRGGTPEDVANVATFLGSDLSSYVTGQVVHVCGGMNM

SEQ ID NO: 37180 - protein, 316 aa, Debaryomyces hansenii CBS767
MYTPYGNAANMQQQQQQQQQNLQHPQPQHPSFQQPQQHAQYGNMGQQPQTQQSGPYANFFQDPATSMAAQLAKNSIGSSNQYLQQNFGSIISGTGDLNYYFRVSNSYVFRKILLILFPYRNKNWTRFTAENTGTSGNTTSVAFAPPSQDINAPDLYIPLMSFITYILLWAVFQGLKGDFHPQLFGYLASQTLACSFLDILIFKVGLYLLNCSTQSSLWDLISFSGYKYVTIITLLCWKHLIGGSWMVYYGVVVVFTTSLALFLMRSLKFLVLPSANTAAGSSASNSISSKQRKIRIQFLFVYAVVFQFLIVLFMSR

SEQ ID NO: 37181 - protein, 390 aa, Leuconostoc mesenteroides subsp. mesenteroides ATCC 8293
MKRIKALNTKFAEKFGPHETQQYFSPGRINLIGEHTDYNGGHVFPAAITYGTYGVARKRDDDRILVYSVNFDEKGVVQLDYKKLDFDENDGWTNYVKGVIVKLIEQGYVLDTGFDLLVEGNIPNGAGLSSSASLELLVGVVLEDLFDLDVSRLSLVKIGQKVENEYFGLNTGIMDQFAIGFGQEQKAILLDTNTLTYELVPIVLGEYAIVIMNTNKRRELGDSKYNERRAQCETALKLLQTELNINSLGELTDEEFDDNVALIHDETLVKRARHAVYENQRTLKAKKALSDGDLQTFGQLMNDSHASLKADYEVTGLELDTLVQSAQKQPGVLGARMTGAGFGGCAIALVKETAISNFENKVYDDYMNVVGYAPEFYVAHVGNGTTKLND

SEQ ID NO: 37182 - protein, 87 aa, Arabidopsis thaliana
  misc_feature (36)..(36): Xaa can be any naturally occurring amino acid
  misc_feature (71)..(71): Xaa can be any naturally occurring amino acid
STLGAHRKSNEFFGRVPAREDNERVLFTDTVLERIXRETICQINLDEKLIIGNGRDRLLLRKDVDARHTGXEDGEIISCCVHDRSRC

SEQ ID NO: 37183 - protein, 167 aa, Synechocystis sp. PCC 6803
MVIQPIYLPHLLKQPRCTQVLAIDQAIADLKTLTPVRGEVSVRHGGTFLEVKAEAETIVTLHCDRCAQSYNQRLALDTKEILWLDNQGENTIPVLERELSWDDLSEVLPPDGHFDVETWLYEQFNLALPLKNLCGKDCQAPQVPDDGTGNGFDRRWAALADLKQQWN

SEQ ID NO: 37184 - protein, 356 aa, Arabidopsis thaliana
KLLESPNLKVYNFLDLKTATKNFKPDSMLGQGGFGKVYRGWVDATTLAPSRVGSGMIVAIKRLNSESVQGFAEWRSEVNFLGMLSHRNLVKLLGYCREDKELLLVYEFMPKGSLESHLFRRNDPFPWDLRIKIVIGAARGLAFLHSLQREVIYRDFKASNILLDSNYDAKLSDFGLAKLGPADEKSHVTTRIMGTYGYAAPEYMATGHLYVKSDVFAFGVVLLEIMTGLTAHNTKRPRGQESLVDWLRPELSNKHRVKQIMDKGIKGQYTTKVATEMARITLSCIEPDPKNRPHMKEVVEVLEHIQGLNVVPNRSSTKQAVANSSRSSPHHYRYKAGALGAERKRATPGRFGSVEK

SEQ ID NO: 37185 - protein, 498 aa, Acinetobacter baumannii
AIFMFSNVREQWFSNIRGDVLSGIVVALALIPEAIAFSIIAGVDPKVGLYASFCIAVVISFVGGRPGMISAATGAMALLMVTLVKEHGLEYLLAATILTGVIQIVAGFLKLGALMRFVSKSVVIGFVNALAILIFMAQLPELTNVTWHVYAMTAVGLGIIYLFPLIPKIGSLIPSPLVTIVVLTIAAITLGLDIRTVGDMGQLPDTLPVFLLPDIPLNLETLTIIFPYAAALAAVGLLESMMTATIVDDLTDTSSDKNRECKGQGVANIASGFMGGMAGCAMIGQSIINVKSGGRTRLSTFCAGIFLLIMVVFISDWLKVIPMAALVAVMIMVSIGTFNWDSLRNIRQYPLSSNIVMIATVVVVVATHNLAYGVLIGVLLSALFFANKIERYMAVQSVLDDAENTRTYIVKGQVFFSSADKFTAAFDFKEAISKVVIDVSQAHFWDVSAVAAVDKVVIKFKREGTEVELIGMNEASQTMVEKFGIHDKPDALDRLSNH

SEQ ID NO: 37186 - protein, 425 aa, Cryptococcus neoformans var. neoformans B-3501A
MCLRVFRAMHIIHIIQHVALFYPSSNTMTIATPELYNHKAIPQPWRETPLVQSAALSRLAGCRIFLKLDNLQPSGSFKSRGIGNLVRRSIQRSPPKAPLHFYSSSGGNAGLACVTAASSLGYPSTVVVPMTTTPMMISKLFTAGASKVIQEGASLYQADAYLKEHILPQDQWGVYIPPFDHEDIWQGAESVAEEVVRQMGGERPDGIVCSVGGGGLMIGICQGLEKVGSAKREGAVNGKGGEEVYQTEVIAVETLGADSLNQAIKAQQLITLPSITSIATSLGCARVASRALDIALGLSPSLPPPISLPPSPLPSPSSSPAETSSSLPDPTITSDKSRIPMKNSKVVPTLVTDKEAIQACVQFLDDERILVEPACGATLALVYTGRLREVMKGRLTEDSKVVLVVCGGSNISLEVLQRYKMEYGL

SEQ ID NO: 37187 - protein, 352 aa, Thermoanaerobacter brockii
MKGFAMLSIGKVGWIEKEKPAPGPFDAIVRPLAVAPCTSDIHTVFEGAIGERHNMILGHEAVGEVVEVGSEVKDFKPGDRVVVPAITPDWRTSEVQRGYHQHSGGMLAGWKFSNVKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIESQIMNLTEGKGVDAAIIAGGNADIMATAVKIVKPGGTIANVNYFGEGEVLPVPRLEWGCGMAHKTIKGGLCPGGRLRMERLIDLVFYKRVDPSKLVTHVFRGFDNIEKAFMLMKDKPKDLIKPVVILA

SEQ ID NO: 37188 - protein, 506 aa, Zygosaccharomyces rouxii
MVLPKLFPASSRAALQAARRSVPFTGFRGLASAAAASTGKVRAVIGAVVDVQFDQENLPEILNALEIERPQGKLVLEVAQHLGENTVRAIAMDGTSGLVRGAAVTDTGAPISVPVDKETLGRIINVIGEPIDEAGPINTKERRPIHAEPPSFVDQSTNSEVLETGIKVVDLLAPYARGGKIGLFGGAGVGKTVFIQELINNIAKAHGGFSVFTGVGERTREGNDLYREMMETGVIDLKGDSKVALVFGQMNEPPGARARVALTGLTVAEYFRDEEGQDVLLFIDNIFRFTQAGSEVSALLGRIPSAVAYQPTLSTDMGALQERIATTQKGSVTSVQAVYVPADDLTDPAPATTFAHLDATTVLSRGISELGIYPAVDPLDSKSRLLDASIVGEEHYNIASDVQMTLQAYKSLQDIIAILGMDELSEQDKLTVERARKIQRFLSQPFATAQVFTGIEGKLVRLKDTIRSFKEVLDGKYDHLPENAFYMVGGIEDVIAKAEKLAAGGN

SEQ ID NO: 37189 - protein, 204 aa, Triticum aestivum
  misc_feature (197)..(197): Xaa can be any naturally occurring amino acid
MPGGGEMPETKQIPKNKACLICIDGWGISPEEDHKGDAIYNAETPVMDKLEKEHPFTSIAAHGLAVGLPDGLMGNSEVGHLNIGAGRVVYQDIVRIDLTMKKKEFGQVENIKNAFERAKSTNGRLHFMGLVSDGGVHGHINHLVSLLEAARDAGVPKSFIHFFGDGRDTAPKSAAGYMKQLLESLDKLQYGKIADVXGRYYAMD

SEQ ID NO: 37190 - protein, 356 aa, Magnaporthe grisea 70-15
MTTMDLRVGNKYRIGRKIGSGSFGDIYLGTNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFQYDYVFDWTVYKYQKNAQAIRQGEDKQGREDPSQQAQPGTVAQSSRPRNKNLIAGEDTPNTRGAVGGSDRM

SEQ ID NO: 37191 - protein, 231 aa, Hordeum vulgare
MAVSELEVDGVVFPPLARPPGSAHAHFLAGAGVRGMEIGGHFIKFTAIGVYLQADAAVSALAAKWAGKPAADLASDAAFFRDVVTGEFEKFTRVTMILPLTGAQYSDKVTENCVAYWKAAGVYTDAEAAAVDKFKEAFGPHSFAPGASILFTHSPAGVLTVAFSKDSSVPESGGVAIENARLCEAVLESIIGEHGVSPAAKLSLANRVAELLKGAAHAGGEPAAEPVPVSV

SEQ ID NO: 37192 - protein, 188 aa, Sulfolobus solfataricus P2
MKVGLVYYGGQYNHLILKNVKYLGADIEVIPPHKPVEELKKFDCVIFSGGPYSVSEEIQKMGNSPLYIKELKVPMLGICLGHQLIAYVLGGVVRRALNPEYGLTRINIFDEDTILKGFSQQLNVWESHNDEVVEPPSGFRVLASSANARVQAMANSSNSIFGVQFHPEVKHTERGIEIFKNFLGVCRK

SEQ ID NO: 37193 - protein, 327 aa, Ralstonia metallidurans CH34
MPTTVRAVRLHEFGLPQVMRLESVELPPPAAGEARVRHTAIGFNFIDVYQRRGTYPLPVGTGLGHEAAGVVEAIGDGVTDVAVGDRVAYMNAGLGAYAEGRNIPVDKLVKLPDAISDEQAAAVIFKGMTAQYLVRHTYAVKPGDTVLVHAAAGGVGQILSGWAKALGARVIGTAGSAAKCEIARAVGCDVAIDYSHGDWVKQVRDATDGRGVNVVYDAVGKDTFLGSLDCAQTFGMVVLYGGASGPAPAIEPELLNKKGCLYLTRPSVFPHNADATRFRANAKDLFDAIAAGHVKVQIGARFPLADVARAHEAAEGRATTGAILLLP

SEQ ID NO: 37194 - protein, 491 aa, Ehrlichia canis str. Jake
MLHLQILLHSTIIIRFVSINKSMTKHEFLIIGSGPGGYIAAIRAAQLGYDVAIVEKENSLGGVCLNWGCIPTKSLLQSASVYHNIKKADIFGITVKDVKFDFNKIIERSRNVVEKLANGISGLMKKNNIKVYHGTAKLLGNATVEITDHSNKRISITSTHIVLATGSQAKNIPGIDFDNNIVWNAKNAMTPNKFPESILIIGSGAIGIEFASFYNTFGTQVTMVELKDNILPLEDHEVSKCMHNILSNKGIKIHTSSSITKLEKCNNYAKVQISDTIDLQVDNVILAVGIIPNSSNIGLENTKIKTDNAGFIITDKHCCTDEPGIYAIGDVAGFPCLAHKASHEAILCIENIAATENKIPQHKIHTINKNNIPSCIFSIPQIASIGLTEHQAKHQGYNFKVGKFNANCSGKAVAIDEVEGFVKVIIDKSTGELLGAHMIGAEVTEMINGYIIGKQVEITDQDITSAIFPHPTLSEMLHEAVLSSNNESLNS

SEQ ID NO: 37195 - protein, 226 aa, Glycine max
MATPASITNVTVEFLQFPALVTPPASTKSYFLGGAGVRGLNIQEEFVKFTGIGVYLEDKAVSSLGAKWKGKSAAELLDSLDFYRDIIKGPFEKLIRGSKLRTLDGREYVRKVSENCVAHMESVGTYSEAEEKAIEEFRNAFKDQNFPPGSTVFYKQSPTGTLGLSFSKDETIPEHEHAVIDNKPLSEAVLETMIGEIPVSPALKESLATRFHQFFKELEANPNIEN

SEQ ID NO: 37196 - protein, 442 aa, Synechococcus sp. WH 8102
MTLRLLLVRHGLSSFNKERRIQGRDDLSNLSEEGHEQARRLGASLTEVPFDAIYSSPLQRAASTTASLLEGRGGSAPTPVFDDGLLEVDLEPWSGMSIDELTERHPVDFATWKRQPLELDLQRRDGSSYRPLVELMDQARSFVDGLLQRHPVDQDGTVLVVAHNAILRCLMLTLLGEPEQGFRRLRVDNTSLSIFNLRPGVDQPQVQIECLNSTTHLQPLPDRGKGARLILVRHGETDWNKAGRFQGQIDIPLNDHGRSQAAAARDFLKDVSIDRAWSSTLSRPTKTAEIILEAHSGVPLTQIDGLVEIGHGLWEGKLESEIREGWSELLDTWKRSPETVQMPEGETIQDVWARSVTSWQEIAKGLKPEETALVVAHDAVNKTILCDLLGLTPADIWAVKQGNGGVTVVDITPDPSQPAVVTCLNLTSHFGSVIDRTAAGAL

SEQ ID NO: 37197 - protein, 484 aa, Haloarcula marismortui ATCC 43049
MSKSQTRSPEAELGLLDATMIGMGAMIGAGIFVLTGLAAEIAGPAAILVFALNGVVTAFTGLSYAELAASIPKSGGGYAFVREIFDDFASFIMGWMLWFAYMIAGALYALGFAPNFLELLHVYDVVPSPDEIGAVAVPVIDVGLPPAFLLAFIAVLGLVALNAVSTAASGSVETIFTIIKVSILVVFVAFGLTSPMFSGAEFQPLFPEGSGAAAVLPAMGLTFIAFEGYDLITTVTEEVQNPRENIPKAIFISLAVTVVVYLAVVTVAIGTLGAEGLADAGEAGIATAATSFMPTGLPIIQNGGALIVFGAVFSTLTALNAVVIASSRVAFSMGREGQLLPSIGQIHHRYGTPFVAILTSAIVMLGSVALPTQSAGNMSSLFFLLSFIIVNVAVIRLRRERPNMNRPYEMPFYPAPPIIGIALNLILTGVLIEFLLRTDPLALGLSVAWILLGAVVYFALKRIRQQSDREQATAVSEIKPEAED

SEQ ID NO: 37198 - protein, 183 aa, Corchorus olitorius
MASAMMSSATVVNRASPAQATLVAPFTGLKSASAFPTTRKNNRDITSIASNGGRVQCMQVWPPLGKKKFETLSYLPDLTPVQLAKEVDYLLRSGWIPCLEFELEHGFVYREHHHSPGYYDGRYWTMWKLPMFGCTDSSQVLKELEEAKKAYPDAFIRIIGFDNRRQVQCISFIAYKPPSFKSG

SEQ ID NO: 37199 - protein, 266 aa, Ehrlichia canis str. Jake
MLNYTLNYLNTNLNAIPLIGIELEFYFDNVEPNDISLLITNIKKKIFHFNCNIIKEQDNLQYEIQTSTTTNILNLILEINLIKEVLEDSINHFGGSINFAAKPYLDKPGSAFHIHINLLDANHNNLFYNQNNKMSNYLLYSIGGLCSLMKKHMIFFAPNNNSYLRYIHADIDTPTTISWGGNNRSTSIRIPSTSTDPTKCRIEHRVPGADCNYKQAITSILQGIIYGIENKIQPPPKTYGISSDIQYNLEKLPLSLNEAIKYNITD

SEQ ID NO: 37200 - protein, 226 aa, Glycine max
MAFPSVTSVTVENVTFPPTVKPPCSPNTFFLAGAGVRGLQIHHAFVKFTAICIYLQYDALSFLSVKWKTKSTHQLTESDQFFSDIVTGPFEKFMQVTMIKPLTGQQYSEKVAENCVAIWRSLGIYTDSEAEAIDKFLSVFKDLTFPPGSSILFTVSPNGSLTISFSGDETIPEVTSAVIENKLLSEAVLESMIGKNGVSPAAKQSLASRLSHLFKEPGVCDPQSHK

SEQ ID NO: 37201 - protein, 230 aa, Synechocystis sp. PCC 6803
MSKNIVVAPSILSADFSRLGEEIKAVDEAGADWIHVDVMDGRFVPNITIGPLIVDAIRPLTKKTLDVHLMIVEPEKYVEDFAKAGADIISVHVEHNASPHLHRTLCQIRELGKKAGAVLNPSTPLDFLEYVLPVCDLILIMSVNPGFGGQSFIPEVLPKIRALRQMCDERGLDPWIEVDGGLKPNNTWQVLEAGANAIVAGSAVFNAPNYAEAIAGVRNSKRPEPQLATV

SEQ ID NO: 37202 - protein, 127 aa, Thermotoga sp. RQ2
FLPGAEEFLERLKKKDLRMAAVTNGVRFVQEKRSRKLKLDRFFEFVLTSEEAGVEKPDPHIFWMALERMKLKKEEVLYVGDDLSSDLKGARNTGIDFVLFSPDGDSSGDFPVARNFEELEKIVEELL

SEQ ID NO: 37203 - protein, 276 aa, Brassica napus
METLPISAESFKVGFIGAGKMAESIARGVVASGMLPPNRISTAVHSNLNRRQVFESFGVNVFSSSEEVVRESDVVIFSVKPQVVKKAITEVRSKLSKDKVLVSVAAGIKLKDLQEWSGQDRFIRVMPNTPAAVGEAASVMSLGTAATEEDGALVAKLFGSVGKMFKADEKMFDAVTGLSGSGPAYIFLAIEALADGGVAAGLPRELALGLASQTVLGAATMVSKTGNHPGVLKDDVTSPGGTTIAGVHELEKGSFRATLMNAVVAAANRSRELSQS

SEQ ID NO: 37204 - protein, 367 aa, Propionibacterium acnes KPA171202
MSRRNVSASLPTFPWDTIAEARRKAQSHPDGIVDLSMGTPVDPAPGVAIAALTAAGDAHGYPQVWGTPALRAGILDHMKQVWGAPASLEETSVLPVIGTKELVASLPGQLGLGPDSTIVIPACAYPTYRVGAQLAGAKIVAVNEPDEVDVAPDLIWINSPANPSGRVLDLDEMKAWVDLARSTGAVLASDECYGEFVWEGESVSVLDERVNSGDVTGLLACLSMSKRSNMAGYRAGFAVGDAELTSELLTVRKHSGLMIPAPVVAAMQAALADRSHVLEQVKRYRLRRNVLKPALEKAGFRIDHSEGSLYLWATHDEDCRVTLDRLADLGILCSPGDFYVAGGSDHVRIGLTATDERINAAAQRIQP

SEQ ID NO: 37205 - protein, 299 aa, Arabidopsis thaliana
MVGGVEELSIEQLASSISTYKEQLEQVRQLLSEDPRNSEYADMEKELKEVIALTEEVLATAKQNEISLSDAGVSAEATPGSPDLEGAWEKTGLRNDPIHEGKFPVGTKVQAVFSDDGEYDATIEAHTANGYFVAYDEWGNKEEVDPDNVRPIEQNAIVEAERLAQATKNALKRKIEKAASSDYQTKTLPAKLKIDPNDPEDVKIAKRKKIHAFKSKARFEQLEVVQNKKQNDWQQFQTTKAKTKKVGFFTGRKKESIFKSPEDPFGKVGVTGSGKGLTDFQKREKHLHLKSGNAEGTDE

SEQ ID NO: 37206 - protein, 308 aa, Pseudomonas fluorescens Pf-5
MKVSCCFGTCLKHLDPACVKTSRRIAILHSALPRQRPPPALECPAFSFGDSDMTDQRKGSDAEPTTHFGFKNVPESQKAEKVAEVFHSVAAKYDLMNDVLSGGMHRLWKRFTIELSGVRAGNRVLDIAGGTGDLTKRFSHLVGPTGQVVLADINESMLKVGRDRLLDLGVAGNVEFVQADAEKLPFPDNHFDCVTIAFGLRNVTHKEDALRSMLRVLKPGGRLLVLEFSKPTNALMSKVYDAYSFAFMPLAGKLITNDSESYRYLAESIRMHPNQETLKSMMVEAGFDRVTYHNMTAGIVALHRGIKP

SEQ ID NO: 37207 - protein, 299 aa, Oryza sativa Japonica Group
MDGVVAASADATRDEIKIMNVYIWDMDETLILLKSLLDGSYAGAFDGLKDHDKSVDIGKRWENLILELCDEHFFYEEIENYNEPFLSAVKEYDDGKDLTTYDFEADCFSSPYDDLNKRKLAYRHRAIGEKYTKGLEKILDHHMIKVWNDLYSATDKYTDGWLSSAHKLLEEAMGKSTAESTAKHSSINCIVTSGSLIPSLAKCLLYRLDDVVAFENVYSSWEVGKLQCFKWIKERYDGPNVRFCAIGDGHEECTAAQIMKWPFVKIEFHPDAPHRFPGLNLPTIHRIMDTVYDSSSNDG

SEQ ID NO: 37208 - protein, 380 aa, Bartonella quintana str. Toulouse
MKVDYYEILGVTRECDDKKLKSAFRKLAMQYHPDRNAGDKEAERRFKEIGEAYEVLKDPQKRAAYDRFGHAAFENNNQGGGNPFGGFAAGGFSDIFEDFFGEIMGGGHRKRSDGRERGADLSYNMEVTLEEAFSGKTAQINIPSSIVCDSCEGSGAKKGSKPQICGTCHGAGRVRAAQGFFSIERTCHACNGRGEVITDPCPKCQGTRRVEKNRSLSVNIPAGIEDGTRIRLSGEGDAGIRGGPNGDLYIFLSVKPHEFFQREGADLHCRIPLSMVTAALGGEFEVSDLDGIKARVKIPEGTQNGRQFRLKGKGMPMLRRQQVRGDLYIHITIETPQKLTQEQRELLQKFEKLSNHENSPQSHGFFSRMKEFFENISGQN

SEQ ID NO: 37209 - protein, 443 aa, Ralstonia metallidurans CH34
MDAAKTVIPDLESLWMPFTANRQYKSAPRLLVSASGMYYTTHDGRQILDGCAGLWCVAAGHARKEIVEAIAQQAATLDYAPPFQMGHPLEFEAATKVASLMPQGLDRIFFTNSGSESVDTALKIALAYHRARGEGQRTRIIGRERGYHGVGFGGMGVGGIGPNRKMWSANVMPGTDHLPATLNIAEAAYSKGQPQWGAHLADELERLVALHDASNIAAVIVEPMAGSAGVLIPPVGYLEKLREITSKHGILLIFDEVITAFGRLGAATGAERLKVTPDLITMAKAINNAAVPMGAVAVRREVHDAVINATPQGGIELPHGYTYSGHPLAMAACIATLDIYKRDKLFERAAEMSPKFESAVHGLRGAPYVKDIRNLGLVAGVELESRPGAPGARAYEAFLKCLELGLLVRYTGDILAFSPPLIISEAEIDQMFDTVRQALHSIK

SEQ ID NO: 37210 - protein, 505 aa, Ralstonia metallidurans CH34
MNIAENRQIAEIHHYVGGTVRRAGTDRFADVFNPATGEVAARVAMGSADDVAAAVAAAKAAAPAWAEMPPLRRARILFKFKELLDRHHDDLAALITREHGKVFSDAKGEVTRGIEVVEFACGIPNLLKTDFTDNIGGGIDNWNLRQPLGVVAGITPFNFPVMVPMWMFPVALACGNTFVLKPSERDPSPSLLIADLLKQAGLPDGVFNVVQGDKVAVDALLAHPDVQALSFVGSTPIAEYIYTEGTKHGKRVQALGGAKNHLVVMPDADLDQAVDALVGAAYGSAGERCMAISVAVAVGDVADRLVPRLAERAATLKIRNGMEDDAEMGPLVTAAHKAKVEGYIAKGVAEGAKLVTDGRGHKVDGHENGFFVGGTLFDNVKPDMTIYKEEIFGPVLSVVRVHDFAEAVDLINRHEFGNGVSCYTSDGGIARAFARQIQVGMVGINVPIPVPMAWHSFGGWKRSLFGDHHAYGEEGVRFYTRYKSVMQRWPDSIAKGAEFTMPVAK

SEQ ID NO: 37211 - protein, 556 aa, Zymobacter palmae
MYTVGMYLAERLAQIGLKHHFAVAGDYNLVLLDQLLLNKDMEQVYCCNELNCGFSAEGYARARGAAAAIVTFSVGAISAMNAIGGAYAENLPVILISGSPNTNDYGTGHILHHTIGTTDYNYQLEMVKHVTCARESIVSAEEAPAKIDHVIRTALRERKPAYLEIACNVAGAECVRPGPINSLLRELEVDQTSVTAAVDAAVEWLQDRQNVVMLVGSKLRAAAAEKQAVALADRLGCAVTIMAAEKGFFPEDHPNFRGLYWGEVSSEGAQELVENADAILCLAPVFNDYATVGWNSWPKGDNVMVMDTDRVTFAGQSFEGLSLSTFAAALAEKAPSRPATTQGTQAPVLGIEAAEPNAPLTNDEMTRQIQSLITSDTTLTAETGDSWFNASRMPIPGGARVELEMQWGHIGWSVPSAFGNAVGSPERRHIMMVGDGSFQLTAQEVAQMIRYEIPVIIFLINNRGYVIEIAIHDGPYNYIKNWNYAGLIDVFNDEDGHGLGLKASTGAELEGAIKKALDNRRGPTLIECNIAQDDCTETLIAWGKRVAATNSRKPQA

SEQ ID NO: 37212 - protein, 301 aa, Bartonella quintana str. Toulouse
MDNVENCAADVFERQAAFLSSALPYMQKYENETVVVKYGGHAMGDSTLGRAFARDIALLKQSGINPVVVHGGGPQIAEILMKMGIESRFENGLRVTDERIVEVVEMVLAGSINKEIVALINAEGEWAIGLCGKDGNMVFAEKAYKTVIDPDSHIERVLDLGFVGEPVEVDRTLLDLLACSEMIPVLAPVAPGHDGKTYNINADIFAGAIAGALEAKRLLFLTDVPGVLNKKGKLLKELTISEVENLIKNGTISGGMIPKVETCMKALQNGVEGVVILNGKTPHSVLLELFTEQGAGTLIVS

SEQ ID NO: 37213 - protein, 469 aa, Ralstonia metallidurans CH34
MSLFRTKNIDAMLEVSEHDGLRKVLGAVDLVLMGIGAIIGTGIFVLTGTGALTAGPALTVSFVIAAMACGFAALCYAEFASAIPVSGSIYTYSYATLGEIVAWMIGWDLLLEYGLATSAVSVGWSGYFQSLIAGFGIHLPTVLTAAPGAVPGEHTLFNLPACLIMLAITWIVSYGVKESARLNNVMVAIKIGVVLLFIAVGVWHVKPANWQPFAPFGMTGVFNAAALVFFAFIGFDAVTSAAEEVRNPRRDLPIGIIGSLAVCTILYVTVAAIMTGIVPFMKFEGVDHPVSLALQYAGQNWVAGFVDLGAILGMTTVILVMTYGQTRIIFAMSRDGLLPEALSTVHPVHATPYTATWTVGIVFAAIAAFVPLNVLAELINIGTLAAFTLISIAILVLRRTRPDLRRGFRCPGVPVVPLLAVGFCLFLMAHLQALTWIAFLCWIGLGLIIYFAYSRRNAVLHNHGGDAEG

SEQ ID NO: 37214 - protein, 386 aa, Ehrlichia canis str. Jake
MNIHEYQAKHILSRFGVSVPKGAIVHSLSEVDDAISKLHSKVIVVKAQIHAGGRGKAGGVVVCRTSDEAKASIKNMLGSTLVTHQTSKDGQKVRKVYLEEGCDIKKEYYISAIVNRKQSQVSIIFSTEGGVDIEEVASTSPEKVIVCNIDPLFGFQSFHGRNLCFDSNLSLDQTRKISDIAEKIYKVMLSTDANQVEINPLVETSSGNFIALDAKINFDDNALYRHPDIQELRDYDEEIKEEIEASKYGLNYIKMDGNIGCMVNGAGLAMATMDIIKYYGAEPANFLDVGGGASQKTVTEAFKIILSDKVDGILVNIFGGIMRCDIIANGIIAAIEEIRINVPLVVRLSGTNFELGKKLLDDSSLNIITANDLSEAAYNIVNIVKK

SEQ ID NO: 37215 - protein, 103 aa, Corchorus olitorius
MAYSGVLKTLIRSSNLGSTTRNFSLVGSQISKHTAKWMQDTSKKSPMELINEVPPIKVEDRIVACEGDTNPALGHPIEFICLDKKEPAVCKYCGLRYIQEHHH

SEQ ID NO: 37216 - protein, 361 aa, Frankia sp. EAN1pec
MSRQVKGIVSVRKGAQVELRTITVPDPGAGEVTVDILACGVCHTDLHYREGGISDDFPFLLGHEAAGTVAQVGPGVTHVAPGDYVILNWRAVCGRCRACERGRPWYCFDTANATQKMTLEDGTELSPALGIGAFAEATLVAAGQCTKIDASAPPEVAGLLGCGVMAGIGAAINTGEVTRGDSVAVIGCGGVGAAAVAGSLLAGATKIIAVDLDDRKLAVAKTLGATHTINSREADPVAAVQGLTGGFGVDVVIDAVGRAETWKQAFYARDLAGTVVLVGVPTPEIMLEVPLLDVFGRGGRLKSSWYGDCLPERDFPMLINLYLQGRLPLDRFVSEKIGLEDVEAAFDAMSRGDVLRSVVML

SEQ ID NO: 37217 - protein, 199 aa, Pseudomonas sp. Y2
MTCYSIDGLTPVVHPTAYVHPSAVLIGDVIVGPHCYIGPLAALRGDFGRIVLEEGANLQDTCVMHGFPASDTVVERNGHVGHGAVLHGCRVGEDALIGMNAVVLDNAHIAPRCIVSAGALVKAGFHCEEQSLVLGSPAKVTRRLSDDEVAWKQTGTRAYQQLTRRCLESMRECQPLSEIEDGRGRYRDDAVRPKVPGGA

SEQ ID NO: 37218 - protein, 346 aa, Neisseria gonorrhoeae FA 1090
MQAVVVNKNVAGDVEVVEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGTHVVAIDINDDKLAFAKETGADLVVNAAKEDAAKVIQEKTGGAHAAVVTAVSAAAFNSAVNCVRAGGRVVAVGLPPESMDLSIPRLVLDGIEVVGSLVGTRKDLEEAFQFGAEGLVVPKVQLRALDEAPAIFQEMREGKITGRMVIDMKKECGCDHHH

SEQ ID NO: 37219 - protein, 284 aa, Zea mays
  misc_feature (43)..(43): Xaa can be any naturally occurring amino acid
MADRVHPAPPPLPLSSTPPQHPPTTETTPLQQHPSFARPPPPXPGTYIVQVPKDQVLRVPPPDRARRYKKLAARPARRRALRRACCCACAAAILAVLVAAAFAGAVYLAYRPRAPTFSVTSLSIRGLDAASLLRSSSSSSETLSPRLDAAVRADNGRNAKVGVEYRGSGSVAVSYSGARLAAGPWPAFRQPPRNVTAFAVAMSGRGVRLTEDQATRIAAEQAAGAVPLQVETTVPVRLRFGSVLRTWTVPVRARCDVSVDRLDGDAVVVNRGCRVRVRPLWWWW

SEQ ID NO: 37220 - protein, 77 aa, Glycine max
  misc_feature (15)..(15): Xaa can be any naturally occurring amino acid
LNLPMANGLILFHTXYPNPLSKHPLFYTSILPFIPYFPAFIFELHPLRHSIYPQSSTDNLLNLLRPYFLFPLTIMIT

SEQ ID NO: 37221 - protein, 190 aa, Bradyrhizobium sp. BTAi1
MAGERERGGRDRKEREERDSEFVDKLVHINRVAKVVKGGKRFGFAALVVIGDQKGRVGFGHGKAREVPEAIRKATDSAKRNLTRVALREGRTLHHDIFGRHGAGRVYLRAAPAGTGIIAGGPMRAVFETLGIQDVVAKSIGSSNPYNMVRATFNALKHQDSPRSVAARRNIKVSTLQARRVGGDAEAAAD

SEQ ID NO: 37222 - protein, 170 aa, Symbiobacterium thermophilum IAM 14863
MDFKSKIRTVDDFPKPGISFKDITTLLKDGEAFHAAIETMAAHFEPLGINMVTGPEARGYIFASALAFRLRAGFVPIRKPGKLPWKTRSISYQLEYGEDRLEVHEDAFQPGQKVLVVDDLLATGGTIRATIDLVESLGAKVVGVAVLIELSDLGGRKRLEGHDVISLVQF

SEQ ID NO: 37223 - protein, 268 aa, Physcomitrella patens subsp. patens
MGTLGRVVFSLGKAARSTGQALDRLGSRLQGGYVFKDEVSKHQTILGIFNKKPVIEESAFVAPGASVVGEVQIGENSSIWYGCVLRGDVHQIKVGAESNIQDNTVVNVPKTNVSSSIEPTIIGNRVTIGHNSVLHACTVEDESFVGMGSTILDGAVVEKGAMVAAGSVVAEKTRVPSGQIWAGSPAKFLRDLTAEERSSLTVNASIYTDLAEVHAFENRKTAGDIEADKALRRKWEIQSDDYDSHLGIVRSKKPDIAFPNNMISKGAH

SEQ ID NO: 37224 - protein, 406 aa, Wolinella succinogenes DSM 1740
MTEELLKKYPEVLEYHTGGKLQVVPKSKLKNQKDLSLAYTPGVAVPCKVIEADPFKAFDYTTKGNLVAVISNGTAVLGLGDIGALAGKPVMEGKAVLFKSFANIDSFDIEVDEKDPDKFIDIVRAIAPTFGGINLEDIKAPECFYIEDRLKELLDIPVMHDDQHGTAIISAAALMNAIELVGKKFEDLKVVVVGAGAAAISCSRIYKSLGVKNIVMFDSKGAITASRTDLNSTKQEFICQEEYKSYKEALQGADVLLGLSKADIIKGEDIEGMNPNPMVFAMSNPTPEIMPDVAKAARPDVIMATGRSDFPNQINNVLGFPYIFKGALKVRATKINEEMKIAAAKGLAALAKLPVPKELEEIHGRPLAYGKEYLIPSPFDPRLNEFVSEAVAKAAIKSGVARITTL

SEQ ID NO: 37225 - protein, 483 aa, Hordeum vulgare subsp. vulgare
  misc_feature (396)..(396): Xaa can be any naturally occurring amino acid
MERYNIITEVGDGTFGSVWRAINKESGEVVAIKKMKKKYFSWEECINLREVKSLRRMNHPNIVKLKEVIRENDMLFFVFEYMECNLYQLMKSKGKPFSETEIRNWCFQVFQALSHMHQRGYFHRDLKPENLLVTKELIKVADFGLAREIISEPPYTEYVSTRWYRAPEVLLQSSVYSSAVDMWAMGAIIAELFSHRPLFPGSSEADEIYKICNILGTPNQHTWAGGLQLAASIHFQFPQSGSINLSEVVPTASEDALNLISWLCSWDPRKRPTAVEVLQHPFFQPCFYVPPSLRYRSTGYATPPPSVGAKGAMDQKNARRYPVGTLSNGRPAVNNSYLSTNAPARAAGVQRKLELDHQVKPEGNHKLTTKENAMNQPWSRLPPAPVRNNMNYLAAXEQIPRGGAPDIAEKLSQLSMSSTTNRAPIMPSDRFVDLKATTRAHGEPVRRPVPLGPRDTWHARNDPFRRTYEMPGERALLQRKLVS

SEQ ID NO: 37226 - protein, 311 aa, Triticum aestivum
  misc_feature (286)..(286): Xaa can be any naturally occurring amino acid
MAATKLSSGHEMPAVGLGVWRMDSAAVRGLIHSALRAGYRHFDCAADYKNEAEVGDALAEAFQTGLVKREDLFITTKLWNSDHGHVVEACKDSLKKLRLDYLDLYLIHFPVATKHTGVGTTGSALGDDGVLDIDTTISLETTWHAMEDLVSMGLVRSIGISNYDIFLTRDCLAYAKIKPAVNQIETHPYFQRDSLVKFCQKHGICVTAHTPLGGSTANTEWFGSVSCLDDPVIKSLAEKYGKTPAQLVLRWGLQRNTVVIPKTSKVERLEENFAVSDFDISGEDMXEKIKALDRRYRTNQPAKFWGIDLYA

SEQ ID NO: 37227 - protein, 408 aa, Propionibacterium acnes KPA171202
MAKTRPKVLSIVLAGGEGKRLMPLTMDRAKPAVPFGGTYRLIDFVLSNLANSGLTQIAVLTQYKSHSLDRHISITWRMSTMLGSYVTPVPAQQRLGPRWYQGSADAIYQSLNLINDQSPDYVVVFGADNIYRMDVDAMLQYHIDSGLGCTVAGIRVPRKDASAFGIIDADQNHKITEFLEKPADPPGLPDASDESFASMGNYIFSREALVQALHDDAHSADSRHDMGGDVIPRFVNAADAQVYDFRDNEVPGNTEKDADYWRDVGTIDAYHDAHMDLVSVEPEFNLYNPDWPIWTMQEQAPGAKFVMRGSCDDTLVSAGCIISGTDIYRTVLGPRARIERWARVDESIVMNNVAIGSNATVHRAILDKNVIVPDGAQVGVDHDHDRARGFTVSPGGVTVVGKGITVPY

SEQ ID NO: 37228 - protein, 176 aa, Glycine max
MSLGSWSPRAEFGTRERTSLSVFHFIVHSMATTAALSGTMVSTSFMRRQPMTTTSLKTFPNVGEALFGLKSGRGGRVTCMASYKVKLITPEGEVEFECPDDVFIVDKAEDEGIELPYSCRAGSCVSCVGKIVEGNVDQSDGSFLDDEQIDSGWVLTCVAQPRSDVVIETHKEGEIE

SEQ ID NO: 37229 - protein, 252 aa, Zea mays
  misc_feature (180)..(180): Xaa can be any naturally occurring amino acid
  misc_feature (232)..(233): Xaa can be any naturally occurring amino acid
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQXAQEVHKAIRDLLRSISDKVADETRILYGGSVNEKNCGELSKQADIDGSLVGXXSQPAFVDIITLPAVTINSK

SEQ ID NO: 37230 - protein, 422 aa, Pseudomonas fluorescens Pf-5
MSDLKTAALEYHANPRPGKLSVELTKATATARDLALAYSPGVAEPVREIARDPELAYKYTGKGNLVAVISDGTAILGLGNLGPLASKPVMEGKGVLFKRFAGIDVFDIEVDSESPQAFIDTVKRISITFGGINLEDIKAPECFEIERALIEQCDIPVFHDDQHGTAIVTAAGMINALEIAGKTLADAKIVCLGAGAAAISCMKLLVSMGAQIENIFMVDRTGVIHSGRDDLNQYKAVFAHATDKRTLADALQGADVFVGLSGPNLLSAEGLKSMAPNPIVFACSNPDPEIAPELAHATRDDVIMATGRSDYPNQVNNVLGFPFIFRGALDVRAKRINEEMKIAAANALRDLAKLPVPQEVCDAYGGIKLEFGREYIIPKPMDARLITVISDAVAKAAIETGVATLPYPKNYPLKSVDDVFNG

SEQ ID NO: 37231 - protein, 227 aa, Vitis vinifera
MTSYLLKSLTKNPLSPSSPTLKSLLVSSLRSYAKASQKERVIVPEPEPEPERLDDVVPTSGISRPLSEILKELSKKVPDTLVKVRTEDGFSIKYIPWHIVNRIMNLHAPEWSGEVRSITYSADGKSVSVVYRVTLYGTDAEIFIGLLLKSRWNNNDIKVFMILEGVFKRTTQVVHLARLASLFQMYRESTGTALVEDTGYGDPVQKAEAMAFQACLCTLWSWPPSLS

SEQ ID NO: 37232 - protein, 480 aa, Oryza sativa Japonica Group
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 37233 - protein, 218 aa, Vibrio cholerae O1 biovar eltor str. N16961
MNQSSLLAEFGDPITRVENALQALREGRGVLLLDDEDRENEGDIIYAVESLTTAQMALMIRECSGIVCLCLTEAQADRLALPPMVVNNNSANQTAFTVSIEAKHGVTTGVSAQDRVTTIKTAANPQAKPEDLARPGHVFPLRARAGGVLARRGHTEGTVDLMQMAGLQPAGVLCELTNPDGSMAKTPEIIEFGKLHNMPVLTIEDMVQYRIQFDLKLA

SEQ ID NO: 37234 - protein, 160 aa, Medicago sativa
VQEMKCNLDLIHIIYSLSKDLGFPGFRVGIVYSYNDQVVNCGRKMSSFGLVSSQTQYMLASMLSDEKFVDKFLLESSRRLLKRHDKFTKGLKEVEISRFPSNAGLFCWMNLKKLLKEETIEEELKLWHVIINEVKLNVSPGSSFNCSEVGWFRVCFANID

SEQ ID NO: 37235 - protein, 508 aa, Pichia angusta
MQLSTLWEPPIVNPRNLKATSIPIFNLWNVYGRNFFFGWFGFFVCFLSWFAFPPLLHGMLKKDLRLTAVDISNNNICGLTGTLLGRFILGPLNDKYGPRITLTGVLVAGAIPTAFVPLVTNVAGLHAIRFFISFLGSSFICCSQFCAVFFDNNIIGTANAISAGWGNAGGGVAFFVMPAISNALENRGYSLHHSWSYSFVIGPFLILMITAILIFVFGSDCPRGRWSLRGDILGINMDNMLVKSVSVTRHFSKEGELTSVFVEPVNAIDKVVVEPNQDQEILEVADIINGDEIIEDPSLNDVVKICLSPRTMLVGLCYMCSFGTELAVESIISNLFGQKMTNWSTSKAGAWGSMLGLLNVVARPAGGIISDFLYQRFKTTKAKKFWMIFTGLMQGIFLIWIGLVPELSIAGLIVSVSFLCLWFEMGNGANYACVPVVNRHHSGIVSGVTGAMGNLGGILFSLVFRYTISNGVNNYFKAFWIIGIVCTAVNLVCVLIPIREERPRKAEN

SEQ ID NO: 37236 - protein, 334 aa, Ashbya gossypii ATCC 10895
MSDIPTEQKVVLIRETGGPEVLRYEEDYPVPEVRGSDILIKNRYAGVNFIETYFRTGLYPCEKPYVLGREAVGVVAAIGADVRRFKVGDRVACLSSGTFAQYTAVSEKSNVLKLPDDIQDGELQAVAGSLVNGLTALTLVDEAYKPQVGEIVLVYAAAGGVGQLLIQLLHARSVRVIAVASTDEKLQIAKSRGAEFLINSSREDIVAKVLEFTDGEGVGASYDSVGKDTFETTLQSVKRKGTIVSFGNASGAVPPFSIQRLTPKNLKILRPQLYGYLATREEWEYYSSKLLHLIRSKKLIINITNLSPLEEFKRLTQLLESRQTTGKLLLAIPD

SEQ ID NO: 37237 - protein, 439 aa, Vibrio cholerae O1 biovar eltor str. N16961
MSKSNNKIGVVQLTILTIVNMMGSGIIMLPTQLAQVGTISILSWLVTAAGSTALAFAFAKCGMFSKKSGGMGGYAEYAFGRSGNFMANYTYAVSLLIANVAIAISAVGYADVLFGFHLTPIETCIATILVLWVATVANFGGARITGQVSSVTVWGIIIPVIGVSIIGWYWFDFDLYRAAWNPHGLPFFQALGGSIAMTLWAFLGLESACANADAVENPEKNVPIAVMGGTLGAAVIYIISTNVIAGIVPNADLANSNAPFGLAFAQMFNPTMGAIVMACAIVSCTGSLLGWQFTIAQVFKASADEGFFPKLFSKVTKADAPVLGMLTIVSIQSVLSLMTISPSLNKQFEALVNLAVVTNIIPYILSMAALGVMQKQLNVPVSQAKVANVMAFIGAMYSFYALYSSGETAVMLGSIATFFGWVLYGAIYRSQQNTPLKHA

SEQ ID NO: 37238 - protein, 372 aa, Synechocystis sp. PCC 6803
MSTKSKIFLVLLVFCPLSFAAHWLGWGETTVFILAGLAIVPLAAFMGTATEEIAVVIGPNAGGLLNATFGNATELILAYIALKEGLIEVVKATLTGSIIGNLLLVMGFAVFLGGLRYKEQNFQPLAARLNASTMNLGVVAILLPTALQYTSTGVEETVLQNLSVAVAVVLIGVYLLSLVFSMGTHAYLYDVGVAENMEMPELGEDVSEPEPPTEEEKPNLWLWTGVLLVVTLGVAVESELLVGSLEVATESLGLTALFTGVIVLPIIGNAAEHATAVTVAMKDKMDLSMSVVMGSSLQIAFFVAPVLVIVGWAIGQPMDLNFNPFELVAVLVAVLIVNSISSDGTSNWLEGILLLATYAIVALAFFFHPTLV

SEQ ID NO: 37239 - protein, 397 aa, Ralstonia metallidurans CH34
MNVITLKPGKEKSLLRRHPWVYATGIAATEGRCEPGSTVVIRSADGRFLARGAYSPESQIRARVWTFDENEPVDHAMFKRRVSAALAHRKQWVRDTNAVRLIFGESDRLPGLIVDYYGQGERGQLVCQFNAAGVEQWKDALVQALIKETGCPNVYERSDAAVRQREGLPLVTGVLAGAEPDPELSVTEHGVRYHVDVRNGHKTGFYVDQRDNRKLVGDLAEGREVLNCFCYTGGFSLAALRGGATSVTSIDSSGEALKIAASNVTLNGFDPARATWLDADVFKTLREFRAEGRQFDLIVLDPPKFAPSAQHIDRAARAYKEINLVGMQLLRPGGLLFTYSCSGAISMELFQKIVAGAATDARSDARILRRLSAGTDHPMSAAFPEGEYLKGLLLEKI

SEQ ID NO: 37240 - protein, 409 aa, Porphyromonas gingivalis W83
MVLSEKAKYYVDLEHRYGAHNYHPLEVVLSRGQGAYVWDVDGKRYFDFLSAYSAVNQGHCHPKIIAALKEQAEKICLTSRAFYNDCLGEYEEFMHHYFGYDKMLPMNSGAEAVETALKLSRRWGYRVKGIPEEKAVIIVCDGNFHGRTISIVSMSSDPDSYTDYGPYTPGFVNIPYNNIEALEKALEEHKDHVAAFVVEPIQGEAGVFVPDDGYIRRAAELCRKYHALFVADEVQTGIARTGRMLCCDHDDVRPDIVVLGKAISGGVLPVSCVLADDEVMLTIKPGEHGSTFGGFPLACKVAMAALTVVKEERLPERAEELGQYFRGELLKIKSPLLKLVRGRGMLNAIVIEPHNRHEAWDVCEAMAERGLLAKPTHRHIIRLAPPLCITREELAQAVEIIKESIKVLE

SEQ ID NO: 37241 - protein, 480 aa, Vibrio cholerae O1 biovar eltor str. N16961
MVQLSVVSRAESPEISSAIEALQAEFTRLKRQYANTPYPSLTHRLQRLTQLKQALLRENEALIAAVNQDYGFRSRFDSGLCDLLPTLNHLNYTAKQLKKWMKPQRRHAGWMLLPSRVEVQFQPLGVVGVMVPWNFPILLSIAPLITAVAAGNQVMVKLSEYTPATNQVLARVIAALGDIAVCVQGDAKVAAAFSALRFDHLLFTGSTAVGKLVAQAAAKNLTPVTLELGGKSPVIIADDADLARSVDNIMLGKTTNAGQICVAPDYVMLPQAKVATFVELYLQRFARRFIRHGRMDVTQIINQAQFDRLQHCLDDAQQKGAKLNTVVGKTVELEARQMLPHLLTEVSDDMLVMQQEIFGPILPVIGYRNIEEAIERVNQGPRPLALYVMTKESHLANHILQRTHSGGACVNDTLMHVAADDAPFGGIGESGQGHYHGIEGFKTFSHSKTVLRSAAWLPRSGWLLTYRQSMLRVLTRFFGR

SEQ ID NO: 37242 - protein, 211 aa, Gibberella zeae PH-1
MSIVQIDTKAQFDDLIKSHQLVILDASAEWCGPCKAMAPIFEKLSHENPDSEKVVFAKFDTDDVSDLAQELGIRSIPAFFIFRDGERVDNLNGANPPALTKLVKGAIEDSSRLVECCYNNLDDGTLQIISQFHISHKQLQALTNPMSINSSINADMRRRVVVDRGPRHATAGYTKTIDMMTCLEHDVDLDQFGGNVRHVGEIRPICEGGKS

SEQ ID NO: 37243 - protein, 421 aa, Porphyromonas gingivalis W83
MNNIRIAIIGLGYVGLPLARLFSTKFPTIGFDINPNRVEELMSGYDSTGEIGNELLQEALQKGLLCTTKIEEIRDCNFYIVTVPTPIDHNHTPDLRPLLAASETIGKVIGQGDVVVYESTVYPGVTEDECIPIIEKVSGLKYNVDFFAGYSPERINPGDKVHTVENIKKVTSGSTPEIADYVDRMYNTVLVNGTHKASSIKVAEASKIIENAQRDVNIAFMNEIAKIFNAMDIDTHEVLEAAATKWNFLPFQPGLVGGHCIGVDPYYLIQRAQVYGVYPRVLMSARRLNDSMGSYIASQTIKQMNKAGIMVKDARILILGFTFKENCPDIRNTKVIDTYSTLQEYTKNIIVHDPWANPSIAEQVYGIKIHNEFPKGKFDAIIIAVAHRDFSNIDLEKSSTANTIIYDVKGILPQGKKCHKL

SEQ ID NO: 37244 - protein, 348 aa, Zea mays
MEALRKQASKFKEQVAKQQQAVIKQFSTTGYERSDSIVIDEVELQRHQQLEKLYTSTRSVRDFQKDIVRAAEGLVSIGNKHIEVGTKFSEDCYRYGSENNASDEALRKAASLYGGALRNIEKEYEDFNRILSSQTIDPLRAMAMGGPLEDARGLAQRYSRMRHEAEILSTEIARRKARVREAPIAEHTTKLQQSEARMIEHKASMAVLGKEAAAALAAVESQQQRVTLQRLVGTAEAEKLFHLRLAAILDDVEAEMSSEKQRRESAPPIISSHKRAEKAQYFLAEVMHNFNGTTEKELSLIVGDYVVVRQIAPNGWAEGECRGKAGWFPAAYVERRENIPPNKVFPQV

SEQ ID NO: 37245 - protein, 391 aa, Leuconostoc mesenteroides subsp. mesenteroides ATCC 8293
MTNPTQPFNSIVLDMAPDKLLDFQLKVRDIPDILRLTFGEPGFAVDERIKQATIDAITNDRSHYAESQGETDLRIAAVAYFNREYHLNYNGPENIIITQGVSEAINVIFQTLLNDNDGLLVPEPAYGPYFSSLDLAHGVRLSIDTTANDFKLTPDMVEETIKNATVPVKAILMNYPTNPTGVTYSRDEIIALAETFTKHNLWVISDEIYSVLTYDQEHVSFAEYIPERTIYINGLSKSHAMTGYRVGFILGQAETIAQLQKTHGTLVFAVPTFVQDAALVALRDVTDTPVKMRDIYRQRRDKVLSQLQALGFDVVEPEGAFYLFAKLPADLGTDGDVFALQLAKEGKVAVIPGSAFSDAAQAYIRISYAASDEDLAEGMKRMTKYIEKVRG

SEQ ID NO: 37246 - protein, 799 aa, Xylella fastidiosa Ann-1
MALNGASYLNENILWLHELRLTDLARVGGKNSSLGEMIGNLTALGVSVPGGYATTAAAFKAFIAYNNLSKRIYDKLATLDVEDVKALTAAGKQIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGSKLVRMVYSDAPGERVKIEDTPTELRHCFAISDADVQELARQALIIEQHYDRPMDIEWAKDGISGKLFIVQARPETVKSRSHTTQIERFALQQRGEILTEGRAIGQKIGSGTARVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNAAVKKLLSMAIKAARSKGKYIGICGQGPSDHPDLAEWLMQEGIESLSLNPDTVVDTWLRLAKLKTVH

SEQ ID NO: 37247 - protein, 386 aa, Propionibacterium acnes KPA171202
MSTENPVVKAIADALSHVNDPEIKRPITDLNMIDEITVDEQGRAFVRILLTVAGCPLKTELREQATEAVRSVDGVTSVSVELGTMTDEQRDALKVQLRGDVPERVIPFAQPGNTTKVIAVSSGKGGVGKSSVTVNLALALAQLGREVGLLDADIYGHSVPDMLGLGDAHPTPLDDMLLPVPGLGIKSISIGMMKPNKSDVIAWRGPILDRALTQLLADVHWGDLDYLLIDLPPGTGDIAMSLGQKLPNAEVLVVTTPQQAASEVAERAGTMAGIMQQRVLGVVENMSWLEVTAPKSRETFRVELFGTGGGQKAADALSERLGTTIPLLGQIPLDVELRSGGDDGDPIVITHPDSPAAEAITELAKTIDARPRGLVGINLGVQPVSH

SEQ ID NO: 37248 - protein, 214 aa, Brassica napus
MYFPASANAGNTPPKCNKPTLSSLPLPDDISVICLAYVPRCDHPSLSEVCKTFNQIIAASSELNRVRSLHKSTENVLYLALRFSRDQKPIWYTLNQKPSKEESNSLNHKLVPYPSFPCLPCWGSNVIVIGQEMYVLGGCIDGELTTNAFAIDCITRTCRSLPSMRVARGCAAFGVVDEKIYVLGGCNKKKSSKDWLEVFDLKNQTWESFPGVCN

SEQ ID NO: 37249 - protein, 526 aa, Cryptococcus neoformans var. neoformans B-3501A
MAHNPRVFFDFAVAGQPLGRVVFELYANVVPKTAENFRALCTGEKGISPISSLPLHYKNSIVHRVIEGFMIQGGDFTKKTGAGGESIYGAPFEDERLNGEGCEVDTKGLLVMANRGPNTNGSQYFITLAAAPHLTGKHVVFGRVVFGMEHVETIGQLPTDEKDRPLSTVMITHCGELELRRPPPKSRARSASISSSFSSRSRSLSRSPSPSRSRSRDRSVSIKRRSRSRKYSDSGSESDYDSDDSRERRRRRKDRKRSKHAKHSSKSKSKSRRRSSKSDREETLSELDARLEREEKERLEKERLEKLAEMKRKIEEEKQRVKDAGGVVYKGRGAMKYLDPETINRQQLPQNFSIRGGRGRGDLPPPRGGSFRDRDQERYGDRDRGQDRRDRREQSDRGDRERDRGYPSSRSHSDPYSGRTGDPLDRYPRTTRRENGQDRRTKLDRDMDQWQHDRSQGSDVRGEGDKFKRGARNELERDREGKQEERKEEGEMTPEDEMERAGKIEREDRGERAMSEGSDMVMDKDD

SEQ ID NO: 37250 - protein, 541 aa, Triticum aestivum
MEVGTWAVVVSAVAAYMAWFWRMSRGLRGPRVWPVLGSLPGLVQHAEDMHEWIAGNLRRAGGTYQTCIFAVPGVARRGGLVTVTCDPRNLEHVLKARFDNYPKGPFWHGVFRDLLGDGIFNSDGDTWLAQRKTAALEFTTRTLRTAMSRWVSRSIHGRLLPILADAAKGKAQVDLQDLLLRLTFDNICGLAFGKDPETLAQGLPENEFASAFDRATEATLNRFIFPEFLWRCKKWLGLGMETTLTSSMAHVDQYLAAVIKKRKLELAAGNGKCDTAATHDDLLSRFMRKGSYSDESLQHVALNFILAGRDTSSVALSWFFWLVSTHPAVERKIVRELCSVLAASRGAHDPALWLAEPFTFEELDRLVYLKAALSETLRLYPSVPEDSKHVVADDYLPDGTFVPAGSSVTYSIYSAGRMKGVWGEDCLEFRPERWLSADGTKFEQHDSYKFVAFNAGPRVCLGKDLAYLQMKNIAGSVLLRHRLTVAPGHRVEQKMSLTLFMKGGLRMEVRPRDLAPVLDEPCGLDAGAATAAAASATAPCA

SEQ ID NO: 37251 - protein, 472 aa, Pseudomonas fluorescens Pf-5
MAERLNNDFQFIDVGRKDPKKKLLRQRKKEFVEIYEPFKPQQSADQAHRCLGCGNPYCEWKCPVHNFIPNWLKLVAEGNILAAAELSHQTNTLPEVCGRVCPQDRLCEGACTLNDGFGAVTIGSVEKYITDTAFAMGWRPDMSKVKPTGKRVAIIGAGPAGLGCADVLVRGGVTPVVFDKNPEIGGLLTFGIPEFKLEKTVLSNRREVFSGMGIEFRLNTEVGKDVTMEQLLAEYDAVFMGMGTYTYMKGGFAGEDLPGVYDALDFLIANVNRNLGFEKSPEDFVDMKGKKVVVLGGGDTAMDCNRTSIRQGAKSVTCAYRRDEANMPGSRKEVKNAKEEGVKFLYNRQPIAIVGEDRVEGVKVVETRLGEPDARGRRSPEPIPGSEEIIPADAVVIAFGFRPSPAPWFEQFSIQTDSQGRVVAPEQGQFKHQTSNPKIFAGGDMVRGSDLVVTAIFEGRNAAEGILDYLGV

SEQ ID NO: 37252 - protein, 151 aa, Triticum aestivum
MMGSNNPSGAGGGMAPGMGAGSSDGRHDDEAVLTEFLSSLMDYNPMIPDELVEHYLGRSGFHCPDLRLTRLVAIATQKFISDVASDSLQHCKARVAAPIKDNKSKQPKDRRLVLTMDDLSKALREHGVNLKHPEYFADSPSAGMGPSTREE

SEQ ID NO: 37253 - protein, 275 aa, Photobacterium profundum SS9
MSIKIKTADEIEKMRVAGRLAADVLEMIEPHVKAGVTTEEIDRICHDFITKEQNAIPAPLNYHGFPKSVCTSINHVVCHGIPAEKDEDVNGSYNKPAVLKDGDILNIDITVIKDGYHGDTSKMFEIGEVSLEDKRLCRVAQESLYLAIKKVKPGTKLGEIGTAIQKFIKTGNSRFSIVKDYCGHGIGNEFHEEPQVVHYKNNDRTVLKAGMCFTIEPMINAGKFGCVSDDNDGWTVYTVDGKKSAQWEHTLLVTETGCEVLTLRKDETLPRIIKA

SEQ ID NO: 37254 - protein, 724 aa, Frankia sp. EAN1pec
MSDASTGQSMIRWEQRPNGVVVLTIDDPTQSVNTMNALYTSAMNTVVGRLYAEKDSVTGVILTSAKKSFFAGGDIDLMIAATDAAALFAEIEQMKGPLRRLELLGRPVVAAINGAALGGGLEIALACHHRVALDARSSRIGLPEVTLGLIPGGGGINRTVRMLGLQKALTQVLLSGQQYSPAQALALGLVDDVVATPEEMMAAAEAWILANPDAAQPWDRKGFKIPGGTPASPALAASLPSFPATLRKQLKGANYPAPKAILAAAVEGTQVDIDSALRVESSYLTSIILDPAAKNMMQVFFLDKRAIDAGASRPAGFPRHAASKVLVLGAGMMGAGIAYMCAQAGLQVVLRDLSVSAAEKGKAYSAGLVAKAVAKGRLSQEKADALLDRILATDSIDDAAGADLVIEAVFEDPALKQKLFAEIESVVAPDAVLGSNTSTLPITMLAEGVQRQDSFIGLHFFSPVDKMPLLEIVVGGKTSDATLAKAFDIALQIRKTPIVVNDSRGFFTSRVIGKFLDEAIAMVGEGVDPASVEQAGLQAGYPAAPLALYDELTLTLPRKIREETKAAALAEGAMWQEHGSESVVDRMIDEFDRKGRSTGGGFYDYADGRRVGLWPGLREHFTRAGHTIPFEDMKERMLFAETIDTIRCFDEGVLRSVADANIGSILGIGYPSWTGGVLQYVNTYPGGASGFLARARELARLYGPRFEAPQSLIRLAAADGQYRD

SEQ ID NO: 37255 - protein, 393 aa, Haloarcula marismortui ATCC 43049
MLSIALAGKPNAGKSTFYKAATMADVDVGNYPFTTIDANRGVSHVRTDCPCLDREERCGDDNCRDGKRYVPVELIDVAGLVPGAHEGRGLGNQFLDELSTADVILNVVDASGGTDAEGEPVEVGEHDPVEDVHFVEEEMDLWLASIVERNWESIERQSRSPDFKLDESLVDMLAGVGASELDVARTLRDLEYPEDPIAWTDEHREALATEIRQRTKPLVVVANKADIAPEGNIEALQEAADVVVPATADGELALRNAAQAGVIDYDPGDPDFDIVGDVSDQQREGLNRIRGVMDDWGGTGVQGALDTAVYDLLDHLTAYPVQNETHWTDGQENVLPDAFLLRQGATPKDLAYAVHSDIGDGYIHAVDARENRRISDETELEEGAVIKIVSDAN

SEQ ID NO: 37256 - protein, 169 aa, Nostoc sp. PCC 7120
MDLSRIPAQPKPGVINILIEIAGGSQNKYEFDKDLEAFALDRVLYSSVKYPYDYGFVPNTLADDGDPLDGMVIIDEPTFPGCVIAARPIGFLEMIDGGDRDEKILAVPDKDPRYAHRKSLNDVAPHRLDEIAEFFRSYKNLEKKVTQSVGWQDVDQVKALVDHPVKAYT

SEQ ID NO: 37257 - protein, 1437 aa, Ashbya gossypii ATCC 10895
MLALKENLLSVGSAPDNWGDWTLAAALVRGAADGTVFYTARAKASRPLVAVAAEQQGVHAIRLLAANDPFCAVTAEAGDSVPATVFTDLATVITGAPHLATVKTPIVVHIETLAEEYAAIPGFKDLGSVILVSSSPSQLLRAASTATKLAQASQRPVLHFYTSDLNGFGEVDVGTADGTFDSTIEDAPERILDSLQSRLVSRGTPSTLILNLSAYGEQFAQYLPDDVALYDITVYKPFEFSQVLRELPVSVKNIAVVQGSTGGSKSNGFEPILLDVFSDFNLLVDRGIKNIVVSGIGRLQYFAHTLEKIVSNSRSLSPSTDLYISDVKHAVHSGIAEEFIKKAISLENAYLSVLQQVFEPNLQLLNQFNDSAINSLRPEYGFGKFLQQNRARRQLMKMVERSLDCSLYEYEGPSVVEGLAAWISYNKRALDSSLLKEANIFGRDVHELLQKNSNSEVAKSILASAPTLDSFSFSSSWLIGSDAWSYDLGNSGVHHAITSRENINILLIDSEPYGSLSKNSARKKDVGLYAMNFGTAYVASVAVYSSYTQLLTAVVEASRFPGPSIVLAYLPYNSEQDSPLTILKETKRAVESGYWPLYRYNPTASNEEDTFKLDSSVLRRQLQEFLDRENKLTLLAKRYPDLSSNIVQSQSDIITAKQQRKSKEAYDQLLQGLSGPPLSVYYASDGGNAASLAKILAKKATTRGLKSFALSMDDIVLEDLPREQNVVFITSTGGQGEFPQDGKAFWEELKSATDLDLASVKFSVFGLGDSQYWPRKEDERYYNKPGKDLYNKLLLFSGQTLIPLGLGDDQDPDGYRTGYEKWESELWAALGVSDIITGEEPKLITNEDIKLASNFLRGTIAEALVDDSTGSIPSTDQQLTKFHGIYMQDDRDIRDVRKAQGLEPYYIFMIRARLPGGIARPEQYLALDKIAASFGNNTIKLTTRATFQLHGVVKRNLKSSIRAMNSTLLDTLAACGDVNRNVMVSALPANARVHEQVANVAAEISEELLPNTTAYHEIWLEGPDRNDASPEWQAIWEGMKSGPKKKVLVGGNALQDIEPIYGPTYLPRKFKVNIAVPPYNDVDVWACDVGLIAIIDETTSNLVGFNVYVGGGMGTTHNNKKTYPRLGSSFGFAPKEDITSVVEKILLVQRDHGDRTNRKHARLKYTIDDMGIDIYRQKVEELWGDKFAPERSYKIESNIDYFGWVKDETGMNHFTAFIENGRIEDSSKLSHKTGLRKVAEYMKQSGSGHFRLTGNQHIVISAIPDQHLDAIKGILKAYKLDNYSFSGLRLASSACVAFPTCGLAMAESERYLPQLISRLEESLEEYGLRHDSVVMRMSGCPNGCSRPWVAEVACVGKAPGTYNLLLGGGYYGQRLNKLYRSSLKEAEILSILRPLFKRWSLEREESEHFGDFLIRVGVIKPTLEGRKFHDDLPDGAI

SEQ ID NO: 37258 - protein, 293 aa, Acetobacter tropicalis
MKGILLAGGSGTRLYPMTLAATKQLLPVYDKPMVYYPLSTLMLAGIKDIMIISTPADLPQFKRLLGDGSQFGVRFEYRVQPSPDGIPQAFLIAEDWLGNAPCALALGDNLIFADHPSAALQTAALRPTGATVFAYQVRDPERYGVVTFDSTGRAQSIVEKPKEAPSNWAVTGLYFYDNRVLDFAKRVKPSARGELEITDLNRFYLEEGSLHVDRLGRGCAWLDAGIPDSLMEAGQFVHTIQARQGMLVGSPAEVAYRMGFIDADQLRAHAQRMIKTELGRLLMQVADSAPVGC

SEQ ID NO: 37259 - protein, 482 aa, Pseudomonas fluorescens
MLDVPLLIGGQSCPARDGRTFERRNPVTGEVVSRVAAATLEDADAAVAAAQAAFPAWVALAPNERRTRLLKAAEQLQARSSEFIAAAGETGAMANWYGFNVRLAANMLREAASMTTQITGEVIPSDVPGSFAMALRQPCGVVLGIAPWNAPVILATRAIAMPLACGNTVVLKASEISPAVHRLIGQVLQDAGLGDGVVNVISNAPADAAAIVERLIANPAVRRVNFTGSTHVGRIVGELSARHLKPALLELGGKAPLLVLDDADLDAAVAAAAFGAYFNQGQICMSTERLIVDAKVADAFTAKLAAKVATLHAGDPAAADSVLGSLVDASAGTRIKALIDDALAKGARLVAGGQLAGSILQPTLIEGVTEQMRVYREESFGPVAVLLRGEGDEALLRLANDSEFGLSAAIFSRDTGRALALAQRVESGICHINGPTVHDEAQMPFGGVKSSGYGSFGGKASIEHFTQLRWVTLQNGPRHYPI

SEQ ID NO: 37260 - protein, 440 aa, Debaryomyces hansenii CBS767
MADIVKKTEDIKGSSIDTKDAKDVAAKDVKEKETSLSVTHEHEKKKQAFVTRTIWTIVMIAFFFTCLLSGHLALISVVFLLQTLTFKEIISLTAEPARDKKLPFNKLLNWYFLFATIYYLDSESFFNFFQESIYDNKILSLLAIHHKIISYTSYIAGFIFFVATLQKGYYKFQFAQLCMTHTTLILVVFQSHLIIDNILNGLIWFFLPVGLVIVNDIFAYLCGITFGRTQLIAISPKKTVEGFVGAWVCTGLFALLFAFFLSKSSYLICPATNLTTNIFNYPRCDPNPVFISQIYQLPANLVEIFHLETISLKPIYIHALNFATFASLIAPFGGFFASGLKRAFGIKDFGDTIPGHGGITDRLDCQFFMGSFSYLYIQTFVSISHVNIGNLLQLAIMNLSIPQVVQLVKSLLKYLNNSGVVDDNKLTKIFEILDVTIENA

SEQ ID NO: 37261 - protein, 181 aa, Helicobacter pylori
LVTKLAPDFKAPAVLGNNEVDEHFELSKNLGKNGAILFFWPKDFTFVCPTEIIAFDKRVKDFQEKGFNVVGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKA

SEQ ID NO: 37262 - protein, 654 aa, Hydrilla verticillata
MFSSYALARTGHLSCNPCTELRPKVSKGGSSCVYQRTFVRCCGNGAPSRRVATASLEARNSVVLKEPEAMEGALNGSAVVDSPSAVSGGVRDTYGEDRATEDQLLTPWTASVASGNSLLRDPRLNKGLAFTEKERDAHYLRGLLPPVFLTQEIQEKKLMTNLRQYQVPLQRYMAMMDLQERNERLFYKLLIDNVEELLPVVYTPTVGEACQKYGSIFRRPQGLYISLREKGKILEVLKNWPERNIEVIVVTDGERILGLGDLGCQGMGIPVGKLALYTALGGVRPSACLPVTIDVGTNNENLLQDEFYIGLRQKRARGKEYAELIEEFMSAVKQNYGERVLVQFEDFANHNAFELLTKYSKSHLVFNDDIQGTASVVLAGLIASLKLVGGTLAEHTFLFFGAGEAGTGIAELIALQMSKETGVPIEETRKKIWLVDTKGLIVSSRKESLQHFKQPWAHDHEPVQDLLDAVKMIKPTVLIGSSGVPNKFTQDVVEAMASFNEKPVIFALSNPTSNSECTAEQAYTWSKGRAIFASGSPFDPVEYEGQTYTSGQANNAYIFPGFGLGLVMSGAIRVHDDMLLAASEALAEQVTEENFEKGLIYPPFTNIRKISANIAAKVAAKAYELGLSGHLPRPENLVEYAESCMYSPVYRSYR

SEQ ID NO: 37263 - protein, 249 aa, Synechocystis sp. PCC 6803
MLNSLIADFRIIFERDPAARNWLEVLFCYPGLQALLIHRFSHRLYTLGLPFFPRLMSHLARFFTGIEIHPGAQIGQGVFIDHGMGVVIGETAIVGDYSLIYQGVTLGGTGKESGKRHPTLGENVVVGAGAKVLGNIAIGDNVRIGAGSVVLRDVPADFTVVGVPGRMVHPSGERVNPLEHGKLPDSEGKVIRLLLERIELLEQQVATLQQQQSEQAWESDYRSCSETDREPVLCRLGDREIEEFLGGTL

SEQ ID NO: 37264 - protein, 614 aa, Hydrilla verticillata
MLSHNRLRVLRKAVIPCCVGRRKGFAADRKGSAMERENEAYVDNHQVANGAAFVVDNAAALDQPITPWMSMVASGYTLLRDPHHNNGLAFTEKERDAHYLRGLLPPVSISQELQEKKLMRNLREYKVPLQRYMAMMDLQERNERLFYKLLIDNVEELLPVVYTPTVGEACQKYGSIFRRPRGLYISLREKNKVLEVLKNWPQKNIQVIVVTDGERILGLGDLGCQGMGIPVGKLALYTALGGIRPSACLPVTIDVGTNNENLLNDEFYIGLRRKRATGQEYAELLEEFMSSVKQKYGERILIQFEDFANHNAFDLLSKYRETHLVFNDDIQGTASVVLAGVVAALRLVGGTLAEHTFLFLGAGEAGTGIAELIALQMSKETRIPVEEARKKIWLVDSKGLIVRSRIQSLQHFKKPWAHEHESIKGLLDAVKSIKPTVLIGSSGAGQAFTQEVIETMALFNEKPIILALSNPTSQSECSAEQAYTWSKGRAIFASGSPFDPVEYKGRTFVPGQANNAYIFPGFGLGLVMSGAIRVHDDMLLAASKALAEQVTDENFEKGLIYPPFSNIRKISAHIAANVAAKAYELGLAGNLPRPDNLVKHAEKCMYSPIYRTYR

SEQ ID NO: 37265 - protein, 655 aa, Thermosynechococcus elongatus BP-1
MVSGRLSLLGILRGRVFMHLSELTHPNQLHGLSIAQLTQIAAQIRDKHLETVAATGGHLGPGLGVVELTLALYQTLDLEKDRVVWDVGHQAYPHKMLTGRYNNFHTLRQKGGIAGYLNRRESPFDHFGAGHASTSISAALGMAIARDLKGENFKVVAIIGDGALTGGMALEAINHAGHLPHTNLMVVLNDNEMSISPNVGAIPRYLNKIRLSPQVQFITDNLEEQFKHIPFFGENLTPEMQRLKEGMKRLAVPKVGAVFEELGFTYVGPVDGHNLEELIATFQHAHTIPGPVLVHVATVKGKGYAIAEKDQVGYHAQNPFDLVTGKAKPSSKPKPPSYSKVFGETLTKLAENDPRIVGITAAMATGTGLDILQKRVPKQYIDVGIAEQHAVTMAAGMATQGMRPVAAIYSTFLQRAYDQIVHDVCIQKLPVFFCMDRAGIVGADGPTHQGMYDIAYLRCLPNMVLMAPKDEAELQRMIVTGINYTDGPIALRYPRGNGYGVALMEEGWEPLEIGKGELLRSGEDLLLVAYGSMVYPAMQVAEILKEHGMSAAVINARFAKPLDTELILPLAKQIGRVVTLEEGCLMGGFGSAVLEALQEADILVPVLRLGVPDILVEHASPDESKADLGLTPPQMAETIMQKFGVPQRATVVTAS

SEQ ID NO: 37266 - protein, 382 aa, Gibberella zeae PH-1
MSDTKVYRASTTAPVNIAVVKYWGKRDAKLNLPTNSSLSVTLSQDDLRTLTTASCSSTFTDGDSLTLNGESSDISGARTQACFRELRSRRAALEQADSSLPKLSSYPLKIVSENNFPTAAGLASSAAGFAALVQAIAFLYELPDSPSDLSLIARQGSGSACRSLFGGYVAWRMGEKEDGSDSKADLVAPASHWPEMRALILVASAAKKGVSSTSGMQQTVATSGLFKERITNVVPANMALMEEAIKDKDFPKFAEVTMRESNSFHATCADTYPPIFYMNDISRAAIRAVECINEKVGRTVAAYTFDAGPNCVIYYEEKDADIIVGAFYQALQGVGGFKEGAASARSSIEFDATLASTLKEGVSRVISTGVGEGPVKTDEFLA

SEQ ID NO: 37267 - protein, 575 aa, Hydrilla verticillata
MEGNSNACGGVRDPYGEDCATEEQLVTPWTFSVASGYTLLRDPRHNKGLAFTEKERDAHYLRGLLPPVCITQERQEKKIMHNLRNYQVPLQRYMAMMDLQERNQRLFYKLLIDNVEELLPVVYTPTVGEACQKYGCIYRRPQGLYISLKEKGKILEVLKNWPEKNIQVIVVTDGERILGLGDLGTQGMGIPVGKLALYTALGGIRPSSCLPITIDVGTNNETLLNEEFYIGLRQKRATGKEYADLLHEFMISVKQNYGERVLVQFEDFANHNAFELLSKYSKTHLVFNDDIQGTASVVLAGVVAALKLVGGALAEHTFLFLGAGEAGTGIAELIALEISKQIKAPVEETRKKIWLVDSKGLIVSSRKESLQHFKKPWAHEHEPIKHLVDAVKTIKPTVLVGSSGVGRAFTKEVIEAMASFNEKPIILALSNPTSQSECTAEEAYTWTQGRAIFASGSPFDPVEYEGKTFVPGQANNAYIFPGFGLGLIIAGAIRVHDDMLIAASEALANQVSEENFEKGLIYPPFSNIRKISANIAANVAAKAYELGLASHLPRPANLVKYAESCMYSPVYRTYR

SEQ ID NO: 37268 - protein, 200 aa, Zea mays
  misc_feature (69)..(69): Xaa can be any naturally occurring amino acid
  misc_feature (83)..(83): Xaa can be any naturally occurring amino acid
TTTRRRGHRSRERGRRRGLRARRRRRGNGGSPDSGDSARWLLDTKPPYPEAAVAPYVGDIDRYLRSLEXEDLLRFPPFPLSRXQKDICPKMRAAVVDWLVVLAEEFELHAETLHLAVSYVDRFLTMNVVARDKLQLLAVTALLVAAKYEEIESAEMKVNIYINSMDNTYTKQQVVKMEADLLKSLNFQIGGPTVTTFLRT

SEQ ID NO: 37269 - protein, 95 aa, Schizosaccharomyces pombe 972h-
MGIFGGNSGNAPSSEDKKSIFMKQIRQELAVAQAGELISKINENCFDKCIPEPGSTFDPNEKSCVSKCMERYMDAWNIVSRTYISRMQREQKNLN

SEQ ID NO: 37270 - protein, 535 aa, Brassica oleracea var. alboglabra
SFKDKLFQTNNSTKLEDNSKTSTNVTSNRSSSTNTEEFSSPKKDSKNSPLVIPSKEPIMRRNMDNQAYYVLGHKTPNIRDLYTLSRKLGQGQFGTTYLCTELATGVDYACKSISKRKLISKEDVEDVRREIQIMHHLAGHGNIVTIKGAYEDSLYVHIVMELCAGGELFDRIIQRGHYSERKAAELTKIIVGVVEACHSLGVMHRDLKPENFLLVNKDDDFSLKAIDFGLSVFFKPGQIFTDVVGSPYYVAPEVLLKRYGPEADVWTAGVILYILLSGVPPFWAETQQGIFDAVLKGYIDFDSDPWPVISDSAKDLIRRMLSSKPAERLTAHEVLRHPWICENGVAPDRPLDPAVLSRLKQFSAMNKLKKMALKVIAESLSEEEIAGLREMFQAMDTDNSGAITFDEPKAGLRKYGSTLKDTEIHDLMEAADVDNSGTIDYSEFIAATIHLNKLEREEHLVAAFQYFDKDGSGYITIDELQQACVEHSMTDVFLEDIIKEVDKNNDGQIDYGEFVEMMQKGNAGVGRRTMRNSLN

SEQ ID NO: 37271 - protein, 621 aa, Oryza sativa Japonica Group
MDLPKLLFTVLILSLLNYESSSATAWDDEDFFKTCSSHRCSKHGPEIRFPFRLSTQPPSCGAPGMHLSCSGQDTILNHPVLGPCKVTEISYSYATMNVIPPVDSSPHCPLQKLMSKNQSTSVYKPQGPQSQGATLVVCSRDPIPANQYDIVGPISCLGHNNQFWYLADPYTYMSVLPLDCTVISKGIPMPYSYDKKGRINWDTSNFKETANRVINDGETVFMWYSSNITSICQRCEYEGRPCGFSSQSGQAFCRRHGPRVTLVAATSSVATFVILSLVVATAFYISLKSRYNKEIHLKVEMFLKTYGTSKPMRYTFSDVKKITRRFKNKLGHGGFGSVYKGELPNGVPVAVKMLENSLGEGEEFINEVATIGRIHHANIVRLLGFCSEGTRRALIYEFMPNESLEKYIFSNGSNISREFLVPKKMLDIALGIARGMEYLHQGCNQRILHFDIKPHNILLDYSFSPKISDFGLAKLCARDQSIVTLTAARGTMGYIAPELYSRSFGAISYKSDVYSFGMLVLEMVSGRRNTDPTVENQNEFYFPEWIYERVINGQELVLNMETTQGEKETVRQLAIVALWCIQWNPTNRPSMTKVVNMLTGRLQKLQVPPKPFISSENHLAT

SEQ ID NO: 37272 - protein, 194 aa, Chlamydomonas reinhardtii
MLANIFQQTRLAGRQMQRAAVRSSHGRVQVVTRAIAVGQKLPEGKFKYFDGEGQMRDVTTDELCKGKKVVLFAVPGAFTPTCSLKHVPGFVDKADEFKTKGVDTIACVSVNDAFVMAAWGKDLKAGDKVLMLADGNGQFTKALGVELDLVDKGLGLRSRRYSMYVEDGVVKVLHLEEGGAFTVSSAEDMLGSLP

SEQ ID NO: 37273 - protein, 284 aa, Propionibacterium acnes KPA171202
MSAIKPYPQSPRRHVPGNIARPPYVGLGDVPETYDGSHVQSAETIAAMEEAGRIACGAMYEAGKAVEPGVTTDELDRIAHEYMCDHGAYPSTLDYRNYPKSCCTSVNEVICHGIPDSRPLEDGDIVKIDVTAYKNGVHGDNCYTFGCGNVDQASLDLIDHTQQAMNRAIKAVKPGRSISIIGRIIENYAKRFGHGVVRDYTGHGVHSAFHSGLVVFHYDEPRYDVTLEEGMTLTIEPMLTLGDQSNHQWDDGWTVLTNDGSRCAQFEQTLVVEKDGARILTTLE

SEQ ID NO: 37274 - protein, 301 aa, Oryza sativa Japonica Group
PQFAAASTPPPPPPPPLLLLLALTVSSTSPSLVLVCLLLAMDVKPVRTVKVTNVSLSATVQDIKEFFSFSGDIEHVEMQSGDEWSQVAYVTFKDPQGAETALLLSGATIVDLSVIIAPAPEYQPPPTSSAPPMYSATSVPVSEDNNVVHKAEDVVSTMLAKGFTLGKDAVGKAKAFDEKHGFTSTAGAKVASIDRKIGLSEKFTIGTSIVNEKVKEMDQKFQVSDKTKSAFAAAEQKVSTAGSAIMKNRYVFTGASWVTNAFNKVAKAATDVGTMTKEKMAAEDQHKGSGPSGGHSYTPIQ

SEQ ID NO: 37275 - protein, 284 aa, Vibrio fischeri
RDKIEVVAVNELSQPEAMAHLFQYDSTHGRFQHKVTHDQEYLYIDLPNGSQDKVRILHQADLSLLPWQSLEVDLILDCTGVYGSKADGEKHINAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNRFEAISVRVPTVNVTAMDLSVTINTNVKVNDINQTIVNASRCTLHNIVDYTEAPLVSIDFNHDPHSAIVDGSQTRVS

SEQ ID NO: 37276 - protein, 284 aa, Vibrio fischeri
RDKIEVVAVNELSQPEAMAHLFQYDSTHGRFQHKVTHDQEYLYIDLPNGSQDKVRILHQADLSLLPWQSLEVDLILDCTGVYGSKADGEKHINAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVS

SEQ ID NO: 37277 - protein, 765 aa, Bartonella quintana str. Toulouse
MKKSEQDQKMPQMVYNVNEREALDFHSRGRPGKLEIVATKSMATQYDLALAYSPGVAVPVKAIAQNPALAYDYTAKGNLVAVISNGTAILGLGNLGALASKPVMEGKAVLFKRFADIDSIDLEIDTNDTESFINLVRHLEPSFGGINLEDIKAPECFMIESRLREVMNIPVFHDDQHGTAIIVAAGVLNALYLTGRNMENTRLVCNGAGSAGIACIELIKAMGFRPENIILCDTKGVVYEGRKEGMNQWKSAHAVPTDKRTLAEAMEGADMFFGVSAKGAITPEMVKSMAPKPIIFAMANPDPEITPEEVMQVRNDAIVATGRSDYPNQINNVLCFPYIFRGALDVRATVINEDMKIAAARALANLAHEEVPDSVAEAYRGKRLKFGPNYIIPVPFDPRLFTVVSIAVAKAAMESGVAQKHIDDLEAYERDLNARRDPISSMMRGVYNHVRQAPKQIVFAEGEEEQVMRAAVSYVHQKLGQAILVGREEQVKETAAISGIDLEREGISIMNAKLSCRLDAYAHYLYKKMQRQGWLLRDCYRRINNDRNYFAACMVALGDADAMVTGVTRNYETALIDIRRVIDEKPKERLIGISMAICRGRTVFIADTAVYENPNAEELADIAEQTASFVRKLGSQPRVAFVAFSTFGYMKGQITRHIQDAVNILHERKVGFEFDGEISADVALNVKLMQQYPFMGLTEPANILVMPGYHASSIASKMLQELGEATIIGPILIGLEKSVQIVPFSGSDTDVVNIATLAAYHAKKL

SEQ ID NO: 37278 - protein, 434 aa, Chlamydomonas reinhardtii
MGDTFTDDLKGKVVRQIEFYFSDSNLPKDKFLKERIAEDPNGFVPLNVICAFQRMRDLIGVKSQSPDAVPADKLQQVAEALAGSESLEVDESKTKVKRKQPLAPEAEIAKAVDARSLYARPFPMDATVDTITELFNGHGTVNCVRMRRHVRSKMFKGSVFVEFSSVEEAEKVLAKAVEFAGATLRLQKKNDYLEGKRKARKAAGGHNVGYESDDSNAGQGLPDGAGGEVGGEVVESAKAKIREAPKSVDRRQGQGQKRKQAPEPAEPTFTPGCLISFTLEAELPELTGPRVISDVLGGRDKVKFVELLEGRKGGFLRFATPELAAAALAEFEGRPEDERAIAGIKGTMTKTEGDDEVNYYKRHHIYLKASDRGHGAGSCHPTMIIPSHSSASAETLLHVSNAGAIPSTAMMSGAGRVKLKATQQSPMMAFRVCK

SEQ ID NO: 37279 - protein, 183 aa, Triticum aestivum
ALAQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLTVRSYRYYDPATRGLDFKGLLEDLSSAPSGSIVLLHACGHNPT

SEQ ID NO: 37280 - protein, 551 aa, Physcomitrella patens subsp. patens
MEAARGDGGAFDHTSDGDVNVPSGIFFKGSTSEAIARAQQDDLVLIVFVAGDDEESVSMELTTFHDSAVGSWAFIFIFMIIVRGNYWMSGYRVLDEVKQHSLILRLQEGTIDAAYFQAICILFIKKGYQGTEELLTALRQAVATAKTQLQQARAASAMVALLSSANMTASGTASSAPESQSAGNCTDEGTPVQSNSSTVANSVAPEREVMPTGQNEGSSMGVDVASRKERTVVTSSPVNPVAHPIQEAGPSRVESRDERGSGGSTSTETNTLASKSSAAKNDSQVLKAAEARTVVKQGSGNGNGKNTSMRREQSVEKLVSVPRVRTGPFPLQVKLTNGETIQGTFESYQLLRDVKNFIDLQRTDGNMDYRLAVPFPRKIFTEEDMDKALSKLDIGPRSALLLVGNGTPSDNSYHSRTLQNNDSHSSAQSEANEGGGSYVGRFLSFLSPYVYGRSNSPQDHKSSSSAPPSESNPGTTRALRESSHPTIVNSSRPEPPVQENSAQAGRLSQRRGGSSNVHTLRGNDEDPSQGKNTYWNGNSTQFGGNDEAKED

SEQ ID NO: 37281 - protein, 397 aa, Bartonella quintana str. Toulouse
MDATTLQPLYECFARRNLRFEQGNGVWLVSDKGERYLDFTSGISVNALGYAHPKLVDTLKIQAGKLWHVSNLFQSPEQEALAARLCANSFADKVFFCNSGAEALECAFKTARHYHYTSGHPTRIEIITFEGAFHGRTLATLAATGHEKYLEGFGPKVDGFIQIPFCDESALRNAINKNTAAILIEPIQGEGGIRTVPREYLSFLRKICNDNDLLLILDEVQTGIGRTGKLFAYEWSAITPDILTLAKGLGSGFPLGACLATEKAAKSMIPGTHGSTFGGNLLGMAVSNSVLDIILESGFLHHVQHMGNKLKNGLSSILSAYPDIICAIQGVGLMLGIQCVVPSNIVVSALENEYLLSVGANNNVVRFLPPLIIKEEEVDESLHRIQKAIAYLSQTKK

SEQ ID NO: 37282 - protein, 710 aa, Neurospora crassa
MPAAVHGTPYLPDGAHQGGGGLSGADQKIKTLSPAVAAHLQRIYSAHADTVTKAWRQEDVSVWLRCCQGDDEAELARDFPLHQDWDYESFFQYTTSSAANSIAPPRSQDLSYPLSSYFISSSHNTYLTGNQLSSDSSVDAYRNVLLRGCRCIEVDVWDGSDSESEDDDGDAESVTSSSSSSSDDAYGSGEEGIASKLKRKAKRKLPSFLGGRKKSKDKKVPEPTTATPPPPPPAAATTTEAAPVGLSAETNPLERCKSGGSASLFQTLSRKSTKEPRVLHGYTLTKDITFRDVCEAIKDYGFATTDLPLIVSLEVHCSAEQQEMMVDIMRQIWGDLLLPEPEEDAKYLPTPEELRGKILVKVKYAPPNNEGGSTGSTTPEELDNTAAAASGRLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37283 - protein, 531 aa, Synechocystis sp. PCC 6803
MNNQQLWQRYQDWLYYHGGLDFYLDVSRMGFSDALVEDLQPKFAKAFQDMVALEKGAIANPDEQRMVGHYWLRNPALAPNDGIRAEITEPLRQIKAFVADVHQGNIKPPTAPKFTDLLAIGIGGSALGPQFVAQALAPNFPPLAIHFIDNSDPDGIDRVLNCLKAQDKLKSTLVVTTSKSGGTPEPRNGLAETKAVFEAQGLHFADYAVAVTMPGSKLSQQAQTEQWLQAFPMQDWVGGRTSELSAVGLLPAALQGIDIQAMLDGAKTMDEATRVRELRQNPAALLALAWYYAGDGQGKKDMVILPYKDRLLLFSRYLQQLVMESLGKERDLDGNVVHQGIAVYGNKGSTDQHAYVQQLRDGVPNFFATFIEVLHDRQGPSLELEPGVTSGDYLSGFLQGTRQALFENQRDSITVTIPEVDATSVGALIALYERAVSFYGSLVNVNAYHQPGVEAGKKAAASILELQKAILSTLQNESGPIALEALATKVQAPEQVETVYKIVRHLAANDRGVTLQGDRQFPQRLQIQWRS

SEQ ID NO: 37284 - protein, 313 aa, Microcystis aeruginosa PCC 7806
MIDKILTKVRSLAKPLLVLGLVTTLVFGNIPSALAASGGRMGGGSFRAPSRSVSPSRGGGYSSPGYGGGIGFPFLLPFFWGGGGGGLISLLIFFAIANFLVNAFRNGGGSDENGMTIESGYETVSVAKVQVGLLANARYLQQELNQIALTVDTSTSEGRVEVLQESALALLRHPEYWVYGNVDCQQTSLSSAEAKFNQWSLNERGKLTAETLTNYNNQLRQGSRDNILPESAGELSKTAPEGYILVTILAGIVGKFSLPKINDSQDLKQALQQIGSMGGDRLLAVEVIWTPQSEGDILSQDDILANYPDLKLV

SEQ ID NO: 37285 - protein, 710 aa, Neurospora crassa
MPAAVHGTPYLPDGAHQGGGGLSGADQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQLSSDSSVDAYRNVLLRGCRCIEVDVWDGSDSESEDDDGDAESVTSSSSSSSDDAYGSGEEGIASKLKRKAKRKLPSFLGGRKKSKDKKVPEPTTTTPPPPPPAAATTTEAAPVGLSAETNPLERCKSGGSASLFQTLSRKSTKEPRVLHGYTLTKDITFRDVCEAIKDYGFATTDLPLIVSLEVHCSAEQQEMMVDIMRQIWGDLLLPEPEEDAKYLPTPEELRGKILVKVKYAPPNNEGGLTGSTTPEELDNTAAAASGRLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37286 - protein, 524 aa, Debaryomyces hansenii CBS767
MNTVYYGVKTNNYEEDALINLLKNGVSLLVIPWNDFKKHTNELILLNSIVVLSSEIKDFWENITFQMRQVRCKYYCFLVPEEFYHLAHDQVRLQLTELVANLPASAHISLIVPLTGNFMHWEFWNNIKIENVHVMLYLSQEVDEGILTRWSTEPISSIMLPAAKFVHEYELPVLPDYLQAMLRKFISQKPPAIIIASDKDQTTYIKGIKWLISKIKIDPASDILIDPLQPLKDNLSLGIYEVFETDTVKYEQYEKAIFRALKDIDLPCVKILVIGPGRGPLIDILLKVIKELRCEFRIDAVEKNPNCYVVLQERNRIEWKEKINLVNEDVRTWKHTNYNLVISELLGSFGCNEVCPEILQDFTNEDTIMIPQSYENYLQPIYSPLLSSLKNEQLERPYLIKLNSFYIMSGIQPIWKFSHPTRANNSRYRAINFHVPHKGKVNALQGFFIANLYGSTQIGIHPQLAEGFCHSWYPFLFPILELVCNGDSILSFQIERICNNKVWYEWSVNNKVYDKHGLYYSIGL

SEQ ID NO: 37287 - protein, 181 aa, Helicobacter pylori
LVTKLAPDFKAPAVLGNNEVDEHFELSKNLGKNGAILFFWPKDFTFVCPTEIIAFDKRVKDFHEKGFNVIGVSIDSEQVHFAWKNTPVEKGGIGQVSFPMVADITKSISRDYDVLFEEAIALRGSFLIDKNMKVRHAVVNDLPLGRNADEMLRMVDALLHFEEHGEVCPAGWRKGDKGMKA

SEQ ID NO: 37288 - protein, 710 aa, Neurospora crassa
MPAAVHGTPYLPDGAHQGGGGLSGADQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQLSSDSSVDAYRNVLLRGCRCIEVDVWDGSDSESEDDDGDAESVTSSSSSSSDDAYGSGEEGIASKLKRKAKRKLPSFLGGRKKSKDKKVPEPTTTTPPPPPPAAATTTEAAPVGLSAETNPLERCKSGGSASLFQTLSRKSTKEPRVLHGYTLTKDITFRDVCEAIKDYGFATTDLPLIVSLEVHCSAEQQEMMVDIMRQIWGDLLLPEPEEDAKYLPTPEELRGKILVKVKYAPPNNEGGSTGSTTPEELDNTAAAASGRLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37289 - protein, 501 aa, Schizosaccharomyces pombe 972h-
MGKLSMLYNAAIASTFVKVFLFPSYRSTDFEVHRNWLAITHSLPISEWYKSSISEWTLDYPPFFAYMECVLSWIAYFFGFDKAMLDPYNLNYVSPSTVVFQRGSVIVLELVLLFALREYVLSSNVKDQRNALLTAIDIFLSPGLLIIDHIHFQYNGFLFGLLLWSIVLAKPEKNMLLSAAIFSALICFKHIFLYVAPAYFVYLLRVYCFTPNFRPQFLNILKLGSTVISIFLLAFGPWIYMKQIPQLLSRLFPFSRGLCHAYWAPNFWALYSFVDRVAFAVLPRFGYALNQGTSINAPTRGLVGESSFAVLPNIPPALTFYICLGLQITVLIKLFIKPTWRVFVGAVTLCGWISFLFGWHVHEKAILMVILPFSILSLIDRRYLEAFRPLAVSGYLSLLPLLFTLNEAPIKYLFTGAWIAMLLTFDKCAPVPVKRVFLLNRVNIAYISGFVPLFIYNCFIHKLVMGDKFEFLPLMLLSTYAAWGIFWSFVSLLWLYFTDLK

SEQ ID NO: 37290 - protein, 537 aa, Brassica rapa subsp. pekinensis
SFKDKTYEGNNNNLPEENSTTITHVSSVHSPTTEQDFPKEDNNNNNNKSPVLVLPVKEPFMRRNMDNQAYYVLGHKTPNIRDLYTLSRKLGQGQFGTTYLCTEVATGVDYACKSISKRKLISKEDVEDVRREIQIMHHLAGHKNIVTIKGAYEDPLYVHIVMEVCAGGELFDRIIQRGHYTERKAAELTKIVVGVVEACHSLGVMHRDLKPENFLLVNKDDDFSLKAIDFGLSVFFKPGQIFKDVVGSPYYVAPEVLLKHYGPEADVWTAGVILYILLSGVPPFWAETQQGIFDAVLKGDIDFESDPWPVISDSAKDLIRKMLCSNPSERLSAHEVMRHPWICENGVAPDRALDPAVLSRLKQFSAMNKLKKMALKVIAESLSEEEIAGLRAMFEAMDTDNSGAITFDELKAGLRRYGSTLKDTEIQDLMEAADVDNSGTIDYSEFIAATIHLNKLDREEHLVSAFQYFDKDGSGYITIDELQQSCVEHGMTDVFLEDVIKEVDQDNDGRIDYGEFVAMMQKGNAGIGRRTMRNSLN

SEQ ID NO: 37291 - protein, 533 aa, Dehalococcoides ethenogenes 195
MEIAKEKSGAKPEFIDNEDESLRESIVIFDFGSQYSLLIARRIREMHVYCELVSHDTPWEKIAHLNPRGFILSGGPSSVYEAGAPLAPAYIFESKLPVLGICYGMQAITHQLGGVVEHSEKREYGHALLHSSVANSDLLSDMPEPSPVWMSHGDRIEKMPAGFTALAYTENCPVAVMGNEADIYGLQFHPEVVHSPNGKIILKNFVFNICKCHANWTMGNYIQESIHNIREQVGDGQVICALSGGVDSAVVASLIHKAIGDQLTCIYVNNGLLRREEADRTLHVFKNHMGMKIIYVDAVDRFLDSLSGVTDPEQKRKVIGSEFIKVFEDEACKLGKIDFLAQGTLYPDVIESVSSVSKASAKIKSHHNVGGLPAHMKLKLIEPLRYLFKDEVRLLGKELGLPDEMIWRQPFPGPGLAIRIIGEVTREKLEILRAADWIVMSEIKKAKMYHQVWQSFAILTDVKSVGVMGDFRTYGYLVAIRAVTSEDAMTADWAKLPYDLLSVISNRIVNEVKEVNRVVYDISSKPPSTIEWE

SEQ ID NO: 37292 - protein, 710 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKRKLPSFLGGRKKSKDKKVPEPTTTTPPPPPPAAATTIEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPRQRAKKPSKVIWSLSKMGIYTRGVSFKSLMQPEANMPTHIFSLSESGVMDVHKESRSALFEHNKHYLMRAYPSGMRILSSNSDPAVFWRKGIQIVALNWQNWDEGMMLNEGMFAGTGGYVLKPVGYRCAKLTDSNPSPSPSPLASDTQADAVQHYTMDLTINVPAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37293 - protein, 261 aa, Streptomyces peucetius
MSEAADRVALVTGGTSGIGLAVVRKLAQDGTRVFLCARDESAITGTVKELQASGLEVDGAPCDVRSTADVDRLVQTARNRFGPIDIVVNNAGRGGGGVTAEITDDLWLDVVDTNLSGAFRVTRAVLTGGAMQEHGWGRIISIASTGGKQGVALGAPYSASKSGLIGFTKAVALELAKTGITVNAVCPGYVETPMAQGVRQRYAAFWGITEDDVLEKFQAKIPLGRYSMPEEVAGMVHYLASDSADSITAQAINVCGGLGSY

SEQ ID NO: 37294 - protein, 453 aa, Emericella nidulans
MTSNGTNGSATAYHASSTQEAIQAENDFAAHNYHPLPVVFARAQGTSVWDPEGRHYLDFLSAYSAVNQGHCHPKLVAALVDQASRLTLSSRAFYNDVFPKFAEMVTKYFGFDMVLPMNTGAEAVETGIKIARKWGYKVKGIPENEAIILSAENNFHGRTMAAISLSSDPESRENYGPYVPNIGCTIPGTEKPITYNDKAVREAFEKAGSNLAAFLVEPIQGEAGIIVPDDDYLQLARSLCDQHNVLLICDEIQTGIARTGKLLCHEWSGIKPDMVLLGKAISGGMYPVSCVLGRKDVMLTVEPGTHGSTYGGNPLACAVAIRALEVVQEENMVERAEKLGQAFRSGLEAIQNPIIQTVRGKGLLNAIVIDESKTNGHTAWDLCMLMKEKGLLAKPTHQNIIRLAPPLVITEEEIAKALEIIKAAVAELPNLKGAAEDKVVPPPEKKVKITLEN

SEQ ID NO: 37295 - protein, 161 aa, Vibrio cholerae O139
LPWRDLGVDLVLDCTGVYGCQEDGQQHIDAGAKLVLFSHPGASDLDNTIIYGVNHETLTAEHKIVSNGSCTTNCIVPIIKVLDDAFGIDSGTITTIHSSMNDQQVIDAYHNDLRRTRAASQSIIPVDTKLHKGIERIFPKFSNKFEAISVRVPTVNVTAMD

SEQ ID NO: 37296 - protein, 359 aa, Leuconostoc mesenteroides subsp. mesenteroides ATCC 8293
MIRHLILEDGTVFEGLGFGAPATTFGEIIFHTAMTGYQEIITDPIYDGQMIVFSMPVIGAAGIHAEAYESVKPMIRGMIVHDLAEVSVNRQRRMNLDRFLKQHNIPGLYQVDTRKLIRHLRETGPQKATIVDYADDHAVDQLVATVLTNKQVQNTATSKPYANPGRGRHIVVIDFGLKHGILRMLGDYDANVSVLPYTTSVDEVLTLDPDGIILSTGPGDPRSLPESVLTLIRVLQTKAPLLGIGLGHELFALANDATLVALPSEHHGMNHPIQEIISRQIFYAMQGQGYAVDEELLDHKKLFVTYRDLVDGAVQGLRHRDYPAFSVQFFPDAAPGPYEATAVFADFFETVEDYVEHHS

SEQ ID NO: 37297 - protein, 468 aa, Propionibacterium acnes KPA171202
MSAVYRSHDQPCYQLETHNGHTGKVSRQTEFVLRSMEERNIRFVRLWFTDVLGSLKSVAIAPAEVEGAFVEGVGFDGSAIEGYARVYEADMVAHPDPATFQVLPWRSGTSTARMFCDITNPDGTSSAADPRHVLKRTMGRAAEMGFTFYVHPEIEFYLLNDEHHPGESPVALDNGGYFDHTTLGAGTDFRRDAINVLEQMGISVEFSHHEAAPGQHEIDLRYADALTMADNIMTFRVVIREIASLKGIKATFMPKPFTDHAGSGMHSHVSLFEGDTNAFYDAADEARMSPVAKYFVAGLLHHAPEIIAVTNQWVNSYRRLSGGGEAPNYICWGRNNRSALVRIPMYKPDKASSARVELRSIDSAANPYLAYSLVLAAGLDGIEKELPLPEEASDDVWQLSARERHALGIKQLPQSLGAAIRCMEESELVAETLGEHVYDYFLRNKRAEFEEYNRQVSQFELDRYLPHL

SEQ ID NO: 37298 - protein, 267 aa, Triticum aestivum
MGFAQLVIGPAGSGKSTYCSGLYQHCETVGRRIHMVNLDPAAEHFSYPVSTDIRELISLDDVMEELGMGPNGGLIYCMEHLEDNLDDWLDEQLENYLDDDYLVFDCPGQIELFTHVPVLRNFVEYLKRKNFTVCAVYLLDSQFVSDVTKYISGCMASLSAMIQLELPHINILSKMDLVSNKKDVEDYLNPEAQVLLSQLNRQMAPRFHKLNKALAELVDDYNMVNFIPLDLRKESSIQYVLSNIDNCIQYGEDADVKVRDFIPEEDD

SEQ ID NO: 37299 - protein, 169 aa, Zea mays
MEPQHGEKELQLLLLPTTTPLNAAFLHAPRPAAASSPSDHPQLDLSLSISIGPPTPHAAEQAGRGRTATAAEQSKRAADVQALKQQAAEQARMASAERAYAERVKELARRELELAEREFARARAIWERARGEVEKVERVKAMAARRIAAGASAAALEITCHACMQRFHP

SEQ ID NO: 37300 - protein, 426 aa, Vibrio vulnificus
MSFILDNAKVGIIGLGYVGLPLAVEFGKQRQTIGFDINQSRINELSTGHDSTLECSDTELAEATKLVYTTSLDALKECNVFIVTVPTPIDEHKQPDLTPLIKASETLGKVIKQGDVIIYESTVYPGATEDDCIPVVERVSGLKFNQDFFAGYSPERINPGDKEHRVTNILKVTSGSTPEVAEYVDQLYKTIIVAGTHKASCIKVAEAAKVIENTQRDVNIALINELSIIFNKLGIDTLEVLEAAGTKWNFLPFRPGLVGGHCIGVDPYYLTHKAQSVGYHPEMILAGRRLNDGMGQYVVSQLVKKMLKKRIHVEGANVLVMGLTFKENCPDLRNTKVVDIIAELKEYNINVDITDPWCSNEEAMHEYGLSLCEKPKQSHYDAIIMAVAHNEFREMGAEAIRALGKAEHVLYDLKYILNKQNVDMRL

SEQ ID NO: 37301 - protein, 419 aa, Lactococcus lactis
MGSSHHHHHHSSGLVPRGSHMSIVVENSTVLSALTEKFAEVFGDTKEVEYFFSPGRINLIGEHTDYNGGYVFPASITIGTTGLARLREDKKVKLYSENFPKLGVIEFDLDEVEKKDGELWSNYVKGMIVMLKGAGYEIDKGFELLIKGEIPTASGLSSSASLELLVGVVLDDLFNLNVPRLELVQLGQKTENDYIGVNSGILDQFAIGFGEVKKAIELDCNTLKYEMVPVELRDYDIVIMNTNKPRALTESKYNERFAETREALKRMQTRLDIQSLGELSNEEFDANTDLIGDETLIKRARHAVYENNRTKIAQKAFVAGNLTKFGELLNASHASLKDDYEVTGLELDTLAETAQKQAGVLGARMTGAGFGGCAIALVAHDNVSAFRKAVGQVYEEVVGYPASFYVAQIGSGSTKLDVE

SEQ ID NO: 37302 - protein, 340 aa, Chlamydomonas reinhardtii
MALLAAKTTSPSVTTRRSVTGLPSVSGFRASRPTRKHGIYVRAMAAATAEEAELRKQLTNLDRVTILSEALPYLQKFRGKTVVVKYGGAAMKDPTLKAGVISDLVLLSCVGIRCVLVHGGGPEINSWLAKVGIEAVFKNGLRVTDAATMEIVEMVLGGRVNKSLVSLIQQAGGKAVGLTGKDGQLLRARQMVELDIGYVGEVTKVDPTILNVLVEDEYIPVVATIATDYSGQALNINADTAAGEIAAALKAEKLVLMTDVPGVLRDKNDIGTKIQALDIRSCRELIQDGVIAGGMIPKIECCIRCLSQGVKAAHIIDGRASHSILMELLTDEGVGTMITG

SEQ ID NO: 37303 - protein, 343 aa, Vibrio vulnificus
MTKYEKIQQDLVESPKTWLITGVAGFIGSNLLEKLLKLDQTVVGLDNFATGHQHNLDEVKSLVTEAQWQRFTFIEGDIRNPETCVAAVQGVDYVLHQAALGSVPRSINDPITTNSANITGFLNMLVAAKDQQVKSFTYAASSSTYGDHPALPKVEENIGNPLSPYAVTKYVNELYANVFARTYGFKSIGLRYFNVFGKRQDPNGAYAAVIPKWTAAMIQGDVIYINGDGETSRDFCYIANTVQMNILAATAPEEAKDKIYNVAVGDRTTLNDLFSAIKLALSNNTVVVSQEPIYREFRTGDVRHSQADVNKAKQYLGYAPSHRILDGINEAMPWYISFINDKK

SEQ ID NO: 37304 - protein, 312 aa, Oryza sativa Japonica Group
MASFTAGGGGANNNPNKSLEVNPAPGDSVSSLSFSPKANHLVATSWDNQWNPEIAVGILQVLCSAWKDDGTTVFSGGCDKQIKMWPLLSGGQPMVLSGHEAPVKELAWIPQMNLLVSGSWDKTLRYWDVRQPQPAHVQQLPERCYALSLSYPLMVVGTADRNVIVFNMQNPQFYQVTFRESSKFCVQISVFITVTLDTLNVICKLQLTLPMLQQAEFKRIVSPLKLQTRCLAAFPDQQGFLQVGSIEGRVGVHHVDDGQQGKNFTFKCHRDGNDIYAVNALNFHPVHHTFATSGSDGGFNFWDKDSKQRLKT

SEQ ID NO: 37305 - protein, 275 aa, Chlorobium tepidum TLS
MSETKHDTLRFGIVTDIHYNPESKTGNQTQAGLERCIEHWTREGAEFVIQLGDLISREGPEAESDLIAVRDMLARFPGKVYHVAGNHCLAVPPERYKTIMGLDSLYYTFSSHGIRFIVLNGMDVSAVNDPQTKADRHLLEYYRDNVKAPFYCGAIGARQLEWLVNELDLALKNEEPVIILSHLPLLEETTDEKHGLLWNHEELTAILFRYPNIRACLSGHYHSAAHARSDGIHFIVLPAFAGWPPGECCLTVKITGENINIGRQDAPPLFDIPLP

SEQ ID NO: 37306 - protein, 461 aa, Helicobacter pylori
MIKQTLIILAPFFIATLLYFLGAPDGLRPNAWLYFCIFMGMIIGLILEPVPSGLIALSALVLCIALKIGASDKVASANKAISWGLSGYANKTVWLVFVAFILGLGYEKSLLGKRIALLLIRFLGQTPLGLGYAIGLSELCLAPFIPSNSARSGGILYPIVSSIPPLMGSTPNNNPDKIGAYLMWVALASTCITSSMFLTALAPNPLAMEIAAKMGVNEISWFSWFLAFLPCGVVLILLVPLLAYKTCKPTLKGSKEVSLWAKKRNRAWGGFLKKFCSALPYWLYWVGFLANLACMRVRRLLSWFWRFVRLAMKTSLKTRARSIFFYCLDRCSRWLAGLKMGFILSAMRLKIFSMLTWIRRSCLLPSFICRIIFSQASPLMARYSRFLGLVRTFKGSICKNACFCFLGLWGFRPMAQAHPPFITGAGIFKARIFGNGGLFLAFCISCFACAHLGSNSSLIGG

SEQ ID NO: 37307 - protein, 484 aa, Oryza sativa Japonica Group
MALSTAQTGESMHSSTFASRYVRTALPRFRMPEKSIPKDAAYQIINDELMLDGNPRLNLASFVTTWMEPECDKLMMAAINKNYVDMDEYPVTTELQNRCVNMIAHLFNAPIGDDETAVGVGTVGSSEAIMLAGLAFKRKWQNRMKAEGKPHDKPNIVTGANVQVCWEKFARYFEVELKEVKLTQGYYVMNPEKAVEMVDENTICVAAILGSTLNGEFEDVKMLNDLLTAKNAETGWNTPIHVDAASGGFIAPFIYPELEWDFRLPLVKSINVSGHKYGLVYAGVGWVIWRNKEDLPDELIFHINYLGADQPTFTLNFSKGSNQIIAQYYQLIRLGFEGYKDIMQNCRDNATVLREGIEKTGHFDVVSKDSGVPLVAFSLKDSSRYTVFEVAESLRRFGWIVPAYTMPADAEHVAVMRVVIREDFSRGLAERLITDLTKTVADMDAHAVKKAAAEPAKKTVREIEKEVTTYWRSFVARKKSSLVC

SEQ ID NO: 37308 - protein, 450 aa, Vibrio sp. Ex25
MLQIESSMSVYHTLCFLSAAAMLIAFVNSKIGKMQTTIAITAGSMVLSLLILIAGQNNWFHLTEIATETVTRINFEDFLLKGILGFLLFAGGLGIKLPNLKDQKWEITVLALGATLFSTFFIGFALYGFCQLIGIQFDLVYCLLFGALISPTDPIAVLAIVKKLDAPKRISTQIEGESLFNDGFGLVIFVTLFTIAFGTEAPTVGSVTLLFIQEAIGGITYGFVLGLLFHYLISATDDHSMELLLTIGVPTAGYAFAEYIHVSGPLAMVVSGIMIGNWTRFIGFSKESEDHLDHFWELVDEFLNGVLFLLIGMSMLLFEFHKEDWIMMAISVPLVLAARYLSVFLSYIGFKRYRKYNPWSVRILTWGGLRGGLALAMALSIPSGIWVIQDKLIDVKEIILVMTYSVVVFSILIQGSTITPMIEKAKDEEKKMEENNQAITTPEHTEPVDS

SEQ ID NO: 37309 - protein, 463 aa, Vibrio sp. Ex25
MDVQFFRKSWENAVSAFNVAKFGGTSVANFEAMSRCATIIENNPNTRLVVSSACSGVTNLLVELANGVQDQTHRTELLQNLANIHDAILTQLEDSTKTAAEVYGILDTVTSLAEAASIQASAKLTDHLVACGELMSTHILTQLMCERGIQAVRFDIRDVLRTDDNFGRAEPNIEAISTLAQDKLIPLCQQSVVVTQGFIGSDEAGNTTTLGRGGSDYSAALIAESVKAAGLEIWTDVPGIYTTDPRIAPKASPIPEISFSEASEMANFGAKILHPSTLVPALRHDIPVFVGSSKEPEKGGTWIRHQVESSPLFRALALRCNQTMVTLRSANMFHAYGFLAKVFEILAKHKISVDLITTSEISVSLTLDQTDTSGGAPQLPQAVREELEELCKVEVEHDLCLVALIGNNMSESKGYAKQVFGTLEDFNLRMICYGASPHNLCFLLHESVSKQAIQKLHTELFEK

SEQ ID NO: 37310 - protein, 392 aa, Vibrio sp. Ex25
MLLNRTFRMLRIKDNQGADMSIQSFIPPHRILMGPGPSDIYPQVLQALSRPTVGHLDPLFIGMMDELKQLLKYAFQTDNEFTIAVSAPGSAGMETCFVNLIEKGDKVIVCRNGVFGERMRENVVRAGGEVVIVDDEWGTPVSIDKVEQALEQHPDTKILAFVHAETSTGAVSDAQALGKLAKQHNALSIVDAVTSLGGVPLKVDEWQLDAVYSGSQKCLSCVPGLSPVTFSPAAIEKIQARTTPVQSWFLDQSLVLGYWSGEGKRSYHHTAPVNSLYALHEALLILKNEGLENAWARHQLMHEKLKNGLQKLGFEFVVDEAHRLPQLNAIYVPEGIDEAKVRAHLLETYNLEIGAGLGALAGKAWRIGLMGYGARPENVALCLKALEESLTE

SEQ ID NO: 37311 - protein, 585 aa, Ralstonia metallidurans CH34
MPFALHGIPVSRGVAIGRAHILAPAALDVSHYLVDEDRLEAEVERLRSARAAVRAELITLKRDLPRDAPEEMGAFLDVHAMILDDEALSREPETLILQRRYNAEWALTTRLEELMRQFDEIEDEYLRERKADIEQVVERILKVLAGAPVLAPAPVPTLAPDGEATPGVIVVAHDIGPADMLQFKHTVFHGFVTDLGGRTSHTAIVARSLDIPAAVGVKNASELIRQDDWIIIDGDAGLVIVDPSAIILEEYRHRQSERALEKKRLQRLRHMPAVTLDGLEIELLANIEMAEDAGAALSAGAVGVGLFRSEFLFMNRRDELPDEDEQFHAYRNAVEAMHGLPVTIRTIDIGADKPLDGRGDDFETALNPALGLRAIRWSLSEPGMFLTQLRALLRASAFGPVRILIPMLAHAGEIDQTLDLIEQAKRQLDERGLPYDPGIKVGAMIEIPAAVLLLPLFLKRMDFLSIGTNDLIQYTLAIDRADNAVAHLYDPLHPAVLQLIARTIREANHAGVPVAVCGEMAGDPAMTRLLLGMGLREFSMHPAQLLRVKQEVIHADCERLSKAVDQILNCYEPDELTAALKQLTA

SEQ ID NO: 37312 - protein, 361 aa, Arabidopsis thaliana
MLFYMPTLYKKAGCLGIREFMKQASSSSSSRNSTSLTNRLKTIFKKAEELSILCAIEVCVIYYGPDGELRTWPKERETVKDMALRYKEARKRKKSRNLHEFLEKEKDKDKGKTNLKKNWYPNFDHYSPQQLSQLIQSLERTLSTLQERLRIVEAQKLQNTNLVHQSLTPSYLNQTQHLNPSKFSLFMYNHGDATLSQLPLSAPHSNQLINYQNHLMQHGFGQNMCSDNITNNNFEHPGVSNTQDYSPLLSVQASAVNNYGLNNHLMQQQDQLHGFDQNMCMVSEIINNNNGLQHPNLSNTVPHEFSSDFNQNPYGNAVGNISFSQDMFSSYDASSLLQTSSLPPLHNIPSSYCFPGNSRLL

SEQ ID NO: 37313 - protein, 710 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKRKLPSFLGGRKKSKDKKVPEPTTTTPPPPPPAAATTIEAAPVGLSAETNPLERCKSGGSASLFQTLSRKSTKEPRVLHGYTLTKDITFRDVCEAIKDYGFATTDLPLIVSLEVHCSAEQRERMVDIMRQIWGDLLLPEPEEDAKYLPTPEELRGKILVKVKYAPPNNEGGSTGSTTPEELDNTAAAASGGLSEEAGQPRQRAKKPSKVIWSLSKMGIYTRGVSFKSLMQPEANMPTHIFSLSESGAMDVHKESRSALFEHNKHYLMRAYPSGMRILSSNLDPAVFWRKGIQIVALNWQDWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISRKLRL

SEQ ID NO: 37314 - protein, 436 aa, Ralstonia metallidurans CH34
MGLLDDRKSGLLPGGHAAFERIDLTVPGFLQGCLSLARALAVLAYHDDGDGLILCKTARPVGQVVEWRALRLRHVALGELGSVADIHHHRIALVDQLRGGGRIDAFSARAALDRRPGQQAARDHGDGDQGQVIVIGEEIHVGIPLGWVGGIIKYAVSCPRRYLSVASRPPPALRRIVRTAGHLLPGSSMYKLVLIRHGESTWNLENRFTGWVDVDLTDTGAAQAKQAGTLLKEAGFAFDVAYTSVLKRAIRTLWHVQDEMDLMWIPVRNEWRLNERHYGALAGLNKAETAKKYGDEQVLVWRRSYDTPPPALEPTDERASFGDPRYANVPRAEIPLTECLKDTVARVMPLWNESIAPDIKSGKRVVIAAHGNSIRALVKYLDQISDDDIVGLNIPNGTPLVYELDADLRPLRHYYLGDQEAIAASLAAVASQGKAR

SEQ ID NO: 37315 - protein, 710 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKRKLPSFLGGRKKSKDKKVPEPTTTTPPPPPPAAATTIEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPRQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37316 - protein, 679 aa, Dehalococcoides ethenogenes 195
MSIWIALVVGLAGLVVAGLLARFVLRQDEGISKVREIASAIREGAMAFITREYTVMAIFVAAVTIILALLPSLGWPVSVSFLFGALCSGLAGFIGMSIAVRANARTTTAASHSLNQGLKFSFRAGSVMGMSVVGIGIIGLSIMYFAFGSNADFLQILPGYGFGASSVAIFARVGGGIFTKAADTGADIVGKVEKGIPEDDPRNAAVVADFVGDNVGDVAGMGADLFESYVDSIIATMALATVGAFSMKLGYSLVPSEEAAFFLPMLVAAGGILASVIGIFLVRTGEKLQMKALLAALRKGTLAAAFLSAVFSFLAVWYLQADLGLFVAILAGLAAGVFIGESTNYFTSYVYKPTLGIAASCQTGAATNIISGFSVGLLSVVPPIILVVAAIVIAYTFGDVYGVALAGVGMLATLGIQDATDAYGPVADNAGGIAEMAGLPKEVRERTDALDSLGNTTAAIGKGFAIGSAGLTSLALLLSYTQAVGITASQVSLLDVKVLAGLLLGVMMPAVFCSLTLKAVGVTSFSIVNEVRRQFKEIAGIMDGTAKPEYGKCVDICTRDSIKQMILPGIITVVSPVIVGWLLGSVAVVGFLAGIILCGFVLAVTFANAGGAWDNAKKWVETGAYGGKGSDAHKAAVVGDTVGDPMKDTAGPSLNIMIKLVAIIALVMAPILANFSGII

SEQ ID NO: 37317 - protein, 626 aa, Magnetococcus sp. MC-1
MSAPQAATTQSEAEPQTVFTSKRMKLLKYLPKPELPKWLRTTTRASLRQDLFAGLTGAVVVLPQGVAFAAIAGLPPQYGLYTAMVPAVIAALFGSSHHLISGPTTAISIVVFATLAPLAEPGSAPYIAMALTLAFLAGLIQFGLGVSKLGGLINFVSHSAVVGFTSGAALLIATSQMKHLFGVHLSDSSTFISTWESLADQLPHINPYVLSVGLVTLVVSVAIKKIRPQWPDMLLAMIVGSLFAAGLGVEAHHITLVGAIPSHLPPLSHPQWDLQIVRELASGALAIALLGLIEAVSIARSVALRSGQTLDGNQEFVGQGLSNVVGSFFSAYPASGSFTRSGVNYRAGAKTPMSAIFASLALMLIVLLVAPLAAHLPIAAMAGIILKVAYNLIDFQHIHKIFTATRGGLAVMLVTFLATLLLELEFAIYIGVMLSLLFYLNRTSHPRVVSRVPNPHSPWRMFVTDPDLPECPQLKILRIDGSLYYGSVPHVESKLKDLLEQKAHQKNLLVIGSGINFTDLSGAELLLRESVRRREQGGHLFLYDIKEQVRGMFKRSGCIQTIREDHLFQSKTEAISTIVSHYLDGAICEKCPAQVFMECPYASKPKNDADGTSEPQPVKAVPLSDP

SEQ ID NO: 37318 - protein, 711 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPPPLPAVAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQQAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37319 - protein, 640 aa, Candidatus Protochlamydia amoebophila UWE25
MSHSHHDEVSLIAFQKDFEKYSWSAFRLDLLSGLSVSMLTVPQVMAYALVAGLPVSCGILASVFSAIVVAIFCSSRHLIVGPSNAIAILIQACISEILFTYYRDISGPEKEQLILQILSQLMLLVGAIQILAAFFKLGRLTHFVSHTVIIGYISGVALALVINQIFPLLGMPVPRHLSSLYEMSVYILTHLTTINWPTALIGVTCLSLLLILRRIDRKLPSGAIVLAIVALVAYFFGYIYNYFIVNEYQFFNWEYIGKIMEPIALVGETNGEGLIPNWGLPYFNTGIMNNLLPVAFAIALLSVMEATTASKSIAVKSGQHLSTNQEIFGVGLGNFFGAFIGAMPVSGSAARSSLNFENGAKTRLAAIVSSLTVALILFAFGFLIRHIPVAAFAALLVASASNIVNLKQLFVCLKATRSDAFVLILTILSCIFFRLDIAFYIGVIMSISLYLKKAAIPQLVEFTVDNEGVLHTIDHHHLQEPRSIRFIKVEGELFFGSADLFQAALKSITEDDTTTRVLILQLKNARDIDATTCLALQQLHHYLKSSGRHLIGCGLTHQIWDVLSDSGIIDIVGKSNLFIFDEKHPQLSVQKAFIRAHELLSIDTANISEIVPPITAMPMPEAISDSQVIDPSSVISPVAN

SEQ ID NO: 37320 - protein, 711 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPPPLPAVAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQQAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37321 - protein, 458 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGI

SEQ ID NO: 37322 - protein, 750 aa, Schizosaccharomyces pombe 972h-
MIMETESPLSITSPSPSDSTFQVDMEKTMHALPSSLLDSPLLSTNEHYPPKSTLLLSGPSPIRNIQLSATKSSESNSIDYLTDTQNIFPNFVNNENNYQFSTAPLNPIDACRVGERKVFTTGNVLLSADRQPLSTWQQNISVLSESPPQNGIQSYISSSEQAAQALTRKPSVTGFRSSSLNSNSDDIDIFSHASRYLFVTNLPRIVPYATLLELFSKLGDVKGIDTSSLSTDGICIVAFFDIRQAIQAAKSLRSQRFFNDRLLYFQFCQRSSIQKMINQGATIQFLDDNEGQLLLNMQGGSVLSILQLQSILQTFGPLLIMKPLRSQNVSQIICEFYDTRDASFALDELDGRIIHNCCLQVAYYDAMADSVSTSSASSLSVPRGFSGMLNNNSEWNNSMTMSSNQETPTAASCAVSRIGSSYGMSNNFGSVPLGRTESSPAWGTSGYYDVSSTSPVAPSDRNPSRQYNSIRYGLDVNPIAPPNSSRLKQRNSDLLNGINPQWSPFSSNTGKVFDSPTGSLGMRRSLTVGANASCSNPTNLSFASLTLHDSKADSTLSASSLNPDLNLQRYTPTVEKHASDRNSVDYAQIASGIDTRTTVMIKNIPNKFTQQMLRDYIDVTNKGTYDFLYLRIDFVNKCNVGYAFINFIEPQSIITFGKARVGTQWNVFHSEKICDISYANIQGKDRLIEKFRNSCVMDENPAYRPKIFVSHGPNRGMEEPFPAPNNARRKLRSIASAQQIGLFPPTASKC

SEQ ID NO: 37323 - protein, 439 aa, Magnetococcus sp. MC-1
MSDFASLNLVKPLLNALTQAGYTTPTPIQAQAIPHLLAGRDLLGIAQTGTGKTAAFALPILNKLSQIKGRPAPNAPRALILTPTRELASQIGNSIAVYGKHVPTTHTVVFGGVGKQPQIRALSRGVDILVATPGRLLDLMGERHVRLDQIQVFVLDEADRMLDMGFIHDIRRIIKVIPAKRHTLLFSATMPKDIAELAEGLLTNPAKVEVTPESTTVERITQKVLFVDKQNKRSLLKNVLEHESIEQVLVFTRTKHGANRVAEYLDKHRIASAAIHGNKSQSAREKALDGFRKGKLKVLVATDIAARGIDVAGISHVINFDLPNESESYVHRIGRTARAGRDGNAISFCDAEERGYLLDIEKTIRQTVPVDIDHEFHCEVVANAAPIKPSRKRSSGHGAGGGNPHGGGHRRGNPSTASKPRQHSGRRTPSSKGRSGSVA

SEQ ID NO: 37324 - protein, 711 aa, Neurospora crassa
MPAAVRGTPYLPDGAHQGGGGLSGAEQKIKTLSPAVAAHLQRTYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPSPLPAVAATTTEAAPVGLLAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37325 - protein, 400 aa, Leuconostoc mesenteroides subsp. mesenteroides ATCC 8293
MIKSKLEQVGIFNDNLDKVKPSPIHSFDEKVSDIPNILKLTIGEPDFSVPQHIKEAALAAISADDSHYSVSAGKKTLRQAASDFLNDRYGLDFDPAEEIITTVGATEGLYTLLAAILNPDDKVLIPTPAYPVYAEMTRINGGHPVFIDVSEDEFVLTPDHLREIIATEDHIKAIIITNPSNPTGVTYTAEQLKALADVVRETDILIISDEIYSELSYDAPHVSMASILPEQTIVVNGVSKSHAMTGYRIGILAGPAALMKKINMVHGFVIMTPSNPAMAAATEAFKSAESKDDTLWMKEQYKKRRDYLVEKMTKLGFEMATPSGAFYMFAKIPVDLNQNDVEFAYDLVDRQQLAVVPGSGFGPGGAGYVRISYAASLDMLETAMNRLESYCEEKRTVKIL

SEQ ID NO: 37326 - protein, 88 aa, Glycine max
  misc_feature (53)..(53): Xaa can be any naturally occurring amino acid
CDKSLNLISTKKDNPAMGTVESLKFVVWSEYIRDRATLVVAYGISINLVEVTXKSKLKAQFPSPIEYAGFTGDFAPAPGIATFRGMRC

SEQ ID NO: 37327 - protein, 64 aa, Glycine max
  misc_feature (9)..(9): Xaa can be any naturally occurring amino acid
DVSPSFGYXYTPRQSPPRGKSDFPGCVSAFLEGRVNMGVKFILFAQLVPTEKGSTFGVGLTVGE

SEQ ID NO: 37328 - protein, 235 aa, uncultured Geobacter sp.
VAVNNLGHCHPAVSAALAKQAHELIHCSNYYHIPQQIELAELLCGLSFADKAFFCNSGAEANEAAIKLARKYSREKYGLDRYEIITAISSFHGRTMATVSATGQEKVQKFFDPLLHGFRHVPFNDAKSLREAIGPCTCAIMLEPIQGEGGVVVPDAAYFQEVRDICDEHGLILIFDEVQVGMGRTGKMFAHEHFGITPDIMTLAKALAGGAPIGTMLATDKLAESFSPGTHGSTF

SEQ ID NO: 37329 - protein, 397 aa, Leuconostoc mesenteroides subsp. mesenteroides ATCC 8293
MKTFSNRVNAITASPTLVMNGLAKQMQAEGIDVINLGVGEPDFQTPKNISDAAIEAIQAQKTSFYTPASGLPALKQAIVENVSQRYEAAITTQNVSVTTGAKLSLYVLMQVLLNPGDTVVTAAPEWVSYVEQIKLAGGELIEVHSESSSMKLTISDLDKIKETVKLVIVNSPTNPTGQVYSKQEIQDILDWSNTHGVYVILDEIYGQLVYNGAEFTSGLQLQHLENSAMIIVDGVSKAYSMTGWRIGWTLASSEIISAMNKLLGHMTSNPTVAAQYAAIEALNGEQDTVENMRQAFEQRLNTTFEAINKINGVHVDVKPQGAFYLFPQVDEKLKKLVGVSNTVELSTKILEEAHVALPAGEGFGMPGYLRLSYAKDQDTLNEAVLRLTQFFKKYTKD

SEQ ID NO: 37330 - protein, 240 aa, marine gamma proteobacterium HTCC2143
MINLEKNDNVFTLTMDDGENRWNTTFVREISKILDEVEASTGAAALVTQSSSPKFFSNGLDLDWVNAPAEHPAAGDYRVFGGEFMALMGRVITLPIPTVCAINGHAFGAGFMFALCHDVRLMREDRGFICANEMQIGLTIPNPELALFRHKLPANTFFETVQLAKRWGGPQALQAGIVQQTTDIDNLAASAFQRAQELAPLGANRANYGGQKERLFGENAILNNSHGAAYHLKHASEQGH

SEQ ID NO: 37331 - protein, 146 aa, Glycine max
MAERGGERGAERGGDRGGFGRGFGGGRGDRGGRGGPRGRGGRRGGRPTEEEKWTPVTKLGRLVQAGKIQKLEQIYLHSLPVKEYQIIDLLVGPTLKDEVMKIMPVQKQTRAGQRTRFKAFVVVGDTNGHVGLGVKCSKEVATAIRG

SEQ ID NO: 37332 - protein, 130 aa, Arabidopsis thaliana
MKRSPSSKLGHVLMLLLLLSFLLHHTESTLPPDHEQLSINGRRIMAYYKHDGAIAAPPSRSGRGGGHGKRMMPYHKPNAPIQTPPSRSRRREGGHNGSRQMGIYRPNGDIYTGPSNSGHGGGHIHQNSSP

SEQ ID NO: 37333 - protein, 339 aa, Triticum aestivum
  misc_feature (217)..(217): Xaa can be any naturally occurring amino acid
  misc_feature (243)..(243): Xaa can be any naturally occurring amino acid
  misc_feature (248)..(249): Xaa can be any naturally occurring amino acid
  misc_feature (251)..(252): Xaa can be any naturally occurring amino acid
  misc_feature (265)..(266): Xaa can be any naturally occurring amino acid
MSAKAGKPLVQTDAGAYIAWSGADQPELATEGLGCGLLVLRPLGFALPHYADSNKFGYVLSGSGVAGVLPVEAKERVVRLKAGDVIAVRTGDVSWWYNDNDNEGSADDLSILFIGDTARAVSPGDISYFFLAGGNSVLSGFDAGLLTMAWPGVTEEQAATAFRSQPAVLLPRLSAKLPGVCPREHDRKGLVVNAGHVAAGTLKMLTPSDLDALGRLXGFSAVLGRLEPGAARAPWVLREGAAXAVYLXXGXXSPDDVPPARVRGXXKKKTLIKSAGSGTLTEANAKCKSCTDDGFRCPCCVHGWPAVEHLIGEGSIFGGLTPQVVQASLKVAPELVKLL

SEQ ID NO: 37334 - protein, 643 aa, Glycine max
MPLGERAGDKSESRYCGVETDFNDDMPHVLHFNLYSGSFDFVVAPLMDHSYRPSLVQKDALGSGVLPFAGSDLVLSPSQWSSHVVGKISSWIDLDSEDETLRIDSETTLKQEIAWASHLSLQACLLPAPKGTSCANYARCVNQILQGSNNMQLWLRVPLVKPDDDSMDAKSVALVDSWETWNSFRLLCEHHSQLSVALDILSTLPSPNSLGRWFGEPVRAAILHTDCFLTNSHGCPCLSKRHQSLITGFFNHSIQIIVSGNSVHTKASVDANDNSGTNSQRHPLRPYLDYVGYLYQRMDPLPEQERFELGYRDFLQSPLQPLMDNLEAQTYETFERDAMKYIQYQRAVSKALLDRVPDEEASVKTIVLMVVGAGRGPLVRASLQAAEETGRKLKVYAVEKNPNAVVTLHALVKLEGWEYTVTIVSSDMRHWNAPEKADILVSELLGSFGDNELSPECLDGAQRFLKQDGISIPSSYTSFLQPVTASKLYNDVKAHKDLVHFETAYVVKMHNVARLAPTQPVFTFTHPKHPDKESNQRHKKLNFVIPNDTGSAMVHGFAGYFDATLYKDVHLGIEPSTATPNMFSWFAIFFPLRTPICVDPGSTLEVHFWRCCGSTKVWYERCVASPSSSPIHNSNGRSYWVGL

SEQ ID NO: 37335 - protein, 162 aa, Brassica napus
  misc_feature (16)..(16): Xaa can be any naturally occurring amino acid
KRQQMRHNEEAAKKQXLQHPQQQQHSRLPPQQHGVGQSHAAPHWPNHPVNNPPPPQLPAGGHYYQKARGGGAPGPNRYPPGGNQTGGYNNNQSRGGYGSGSYPPQGRGGAPYGGAGPRGPSGGYGAGPPNYSQGGGGGQYGGSGRGQNPMGGARNQQYGWQP

SEQ ID NO: 37336 - protein, 340 aa, Staphylococcus epidermidis RP62A
MKAAVVTKDHRVSIEEKRLRELKPGEALVKTEYCGVCHTDLHVKNADFGDVTGVTLGHEGIGRVIEVADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKVQLRQLSEINDIFDEMEKGTITGRMVIDMKSSH

SEQ ID NO: 37337 - protein, 340 aa, Bartonella quintana str. Toulouse
MNAVSMTVIGAGSYGTALAIAFARNGHHVLLWGYNPQHVRELQIHRCNQAFLPDVQFPDNLSPEASLETAITASRNILIAVPSHVFHQVLYNIQPYLNQHSRIIWATKGLEHGTGRLLQEVAREILGDKIPLAIFSGPTFAKELAIGLPTAITVAASNAEFSEELQQLFHCDKSFRVYKNPDMIGVQLGGVIKNVIAIGAGISDGMGFGANARIALITRGLAEISRLGIAMGAELSTFMGMTGLGDLVLTCTDNQSRNRRFGILLGQGMDIEEAEKQIGQIVEGYLNTKEVRMLARRIGVEMPITEQIYHVLYSGKSVVEAANTLLSRTLKDEIHDKVCF

SEQ ID NO: 37338 - protein, 244 aa, Brassica napus
MEWRKWYLDAVLVPCALLVMFSYHIYLWYKVRTEPFSTIVGTNSRARRSWVAAIMKDNEKKNILAVQTLRNTIMGATLMATTCILLCAGLAAVLSSTYSIKKPLNDAVFGSHGDFTVALKYVTILTIFLFAFFSHSLSIRFINQVNILINSPQDPSSDDFGSFVTTPEYVSELLEKAFLLNTVGNRLFYMGLPLMLWIFGPVLVFLSSALMVPVLYNLDFVFSSGNKEKCKVDCHGDSDDHCSP

SEQ ID NO: 37339 - protein, 178 aa, Dehalococcoides ethenogenes 195
MSPTKHTIVALVEDRPGVLNRMASLFRRRGFNIDSIAVGRSETPGFSRMTIVVDGANTMVEQVRKQLDKVVDVVKVSDITGQDIICRELALIKVKSTPANRSEIMQIVDIFRAKIVDVASDSLTVEVTGDEEKVNSLYNLLRAFGIKEITRTGRIAMTRGGLATATELQSAKESKTKE

SEQ ID NO: 37340 - protein, 246 aa, Brassica napus
MSVFDDSFVILGDDASESVPVSAYDGSVHVDDSTDDVFAAPSSDYGGYSNGADVFGSNGGHDGPILPPPSDMESDEGAALREWRRQNAIQLEEKEKREKELRNQIIEEANQFKEEFHKKRELACENNKAANREKEKLYVETQEKFYAEASKNYWEAIAELVPKEVPTIQKRRGKKKEDDPKKPTISVIQGPKPGKPTDLSRMRQILLKLKQNPPTHLKLAPQPSSEAAAPPKNVPETKPTEPVAAA

SEQ ID NO: 37341 - protein, 500 aa, Pseudomonas syringae pv. syringae B728a
MNESPVIGHYINGHLSNGEGERYSEVFNPAIGTVQARVALASVKTVDEAVAAAKAAFPAWAEQSSLRRARVMFKFKELLDQHHDELAQIICREHGKVLSDARGEVVRGIEIVEFACGAPSLLKSDFSDNIGGGIDNWNLRQPLGVCAGVTPFNFPVMVPLWMIPMALVTGNCFILKPSERDPSASLLMARLLKEAGLPDGVFNVVQGDKVAVDALLQHPDIEAISFVGSTPIAEYIHQQGTAHGKRVQALGGAKNHMIVMPDADLDQAADALIGAAYGSAGERCMAISIAVVVGDVGQRLVDKLLPRIDQLKVGNGMQADSDMGPLVTAVHKAKVEGFIDQGVKEGARLLVDGRNFKVPGAEQGFFVGATLFDHVTPQMQIYKEEIFGPVLGIVHVADFASAVALINAHEFGNGVSCFTSDGGVARAFARSIKVGMVGINVPIPVPMAWHSFGGWKRSLFGDHHAYGEEGLRFYSRYKSVMQRWPDSIAKGPEFSMPTAK

SEQ ID NO: 37342 - protein, 711 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSRLPSFLGGRKKSKDKKVPEPTTTTPPPPLPAVAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQQAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37343 - protein, 712 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKRKLPSFLGGRKKSKDKKVPEPTTTTPPPPPPPAAAATTTEAAPVGLSAETNSLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNPAAAASGGLPEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPSASDTQADAVQHYTMDLTINVLAAQSLPLPPRDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37344 - protein, 645 aa, Pseudomonas syringae pv. syringae B728a
MGQTRFATGRQLDLICLGRLGVDLYAQQVGALLEDVSSFAKYLGGSSANIAFGTARLGLRSAMLSRVGDDHMGRFLVESLAREGCDVSAIKRDPERLTAMVLLGLKDRETFPLVFYRENCADMALRAEDIDEQQIASSKALLITGTHFSTDQVFKASSQALDYAKKHDVKRVLDIDYRPVLWGLAGKADGETRFVADQKVSQHVQRILPRFDLIVGTEEEFQIAGGATDLLAALRRVRELTAATLVVKLGPQGCTVIHGAIPARLEEGAIYPGVQVEVLNVLGAGDAFMSGFLSGWLKEASDERCCQLANACGGLVVSRHACAPAMPTPAELDYLFNSPQPITRPDQDVALQRLHQVSVPRKQWRQLFIFAFDHRGQLVELAQQAGRDLGSISQLKQLFVQAVERVEADLRKRGIEADVGLLADQRFGQDSLNAATGRGWWVARPVEVQGSRPLAFEHGRSIGSNLLAWPQEQIIKCLVQYHPDDEPMLRLEQEAQIKALYDASKVSGHELLLEIIPPKDHPSPHPDVMLRSLKRLYNLGIYPAWWKIEAQSAQVWQQLDELIQQRDPYCRGVVLLGLNAPVEDLAAGFAEARHSRVCQGFAVGRTIFREPSRAWMAGEIDDATLISRVQSTFNWLIESWRESRA

SEQ ID NO: 37345 - protein, 489 aa, Saccharomyces cerevisiae
MELLKLLCLILFLTLSYVAFAIIVPPLNFPKNIPTIPFYVVFLPVIFPIDQTELYDLYIRESMEKYGAVKFFFGSRWNILVSRSEYLAQIFKDEDTFAKSGNQKKIPYSALAAYTGDNVISAYGAVWRNYRNAVTNGLQHFDDAPIFKNAKILCTLIKNRLLEGQTSIPMGPLSQRMALDNISQVALGFDFGALTHEKNAFHEHLIRIKKQIFHPFFLTFPFLDVLPIPSRKKAFKDVVSFRELLVKRVQDELVNNYKFEQTTFAASDLIRAHNNEIIDYKQLTDNIVIILVAGHENPQLLFNSSLYLLAKYSNEWQEKLRKEVNGITDPKGLADLPLLNAFLFEVVRMYPPLSTIINRCTTKTCKLGAEIVIPKGVYVGYNNFGTSHDPKTWGTTADDFKPERWGSDIETIRKNWRMAKNRCAVTGFHGGRRACLGEKLALTEIRISLAEMLKQFRWSLDPEWEEKLTPAGPLCPLNLKLKFNENIME

SEQ ID NO: 37346 - protein, 706 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQLSSESSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPAAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLTEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSLSASDTQADAVQHYTMDLTINVLAAQSLPLPPRDNNVDSFRPYLKVELHVEEPGERHGTDELPQDGKEKGGEYKAKTKSVKGGCDPNWEGKFGAQTELKFENIPGVVPELSFVRFLVLDDEIGRDSLAAWACVRLDRLREGYRFVHLLDAKGMESDGAVLVKISKKLRL

SEQ ID NO: 37347 - protein, 556 aa, Synechocystis sp. PCC 6803; identical to SEQ ID NO: 1574

SEQ ID NO: 37348 - protein, 711 aa, Neurospora crassa
MPAAVRGTPYLPDGAHQGGGGLSGAEQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQFSSDSSVDAYRNVLLRGCRCIEVDVWDGSDSESEDDDGDAESVTSSSSSSSDDAYGSGEEGTASKLKRKAKSKLPSFLGGRKKSKDKKVPEPTTTTPPPPLPGVAATTTEAAPVGLSAETNPLERCKSGGSASLFQTLSRKSTKEPRVLHGYTLTKDITFRDVCEAIKDYGFATTDLPLIVSLEVHCSAEQQERMVDIMRQIWGDLLLPEPEEDAKYLPTPEELRGKILVKVKYAPPNNEGGSTGSTTPEELDNTAAAASGGLSEEAGQPKQQAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPVGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 37349 - protein, 434 aa, Candidatus Protochlamydia amoebophila UWE25
MKNYYLNDLLSYLNNAPTPWHAVEEACQRLSKHGYTELKENEKWELKLGHSYYIKHHQTTLCVFTLPKNSPTRVRLLASHTDSPGFKLKPQAEIRRHSMILLGVEIYGSPLLNSWLNRDLGIAGHIIYKNKNNQPENCLVQLDSFPVVIPQLAIHLDREVNEKGLLLNKQEHLNALAALEKDIPTGQTYLETILKKQIDFQELLTFDLFLYPLDKARFVGFENQFISSYRIDSLASVHAALSALIETATPLENDIKMAIFWNHEEVGSHTSQGAESPFFHQTLERILLNLNCSKEDFFRLLNQSHCTSIDLAHALHPNYLDKHDGMHQPKLGQGVIIKNNAQQRYASTATSSIPIHLAAGIEQIPLQHFVSRNDMPCGSTIGPLQACTAGISTVDIGCGELSMHSCRELMASEDYIHLLNLLKVILKMPDWPII

SEQ ID NO: 37350 - protein, 518 aa, Ashbya gossypii ATCC 10895
MSSAVPRVTPLKNPVLPLQTTPEQRYWRQYSSTQLVKEHNAVTHIEFNPQHPHDFAVTSSTRVQLFSSRTRQVIKTFSRFKDVVYSSSFRPDGKLLAAGDATGLVSVYDSYNPRNLLVSIKASTHPAHVTKFHPLDKQTLVTATDDRVVRVWDISHAYEPTLELLGASDYVRSVCFVPGAPHMVVSGCYDGVVRLHDTRTRSAQPVTQLNHGMSVEDIVAISPTQLVSCGGSKFKVWDLTGNKLLHERGNFAKTVTCLDYVNMPDGGAMNSCLLASSLDGHVKVFDPLDGYRVKFGWKFSSAVLSCAISPGDAQGNKHLVAGLSSGLLAIRTNKKTREPKGDSDAQDTETAIMGKERKSNNFQRMMRGSEYKGDQEHIIHNDKPRQQPRLRLFEKKLNQFKWAEALDSAFVPGMAKELTLTVLQELRKRGKIRVALYDRDETSLEPLLNWCLKGLEDTRSAPVVADWIAVVLEMYATIIERSPVLEEMVVALRNKVRQEIHKCKEAQKIQGMLQILTN

SEQ ID NO: 37351 - protein, 266 aa, Zea mays; identical to SEQ ID NO: 1040

SEQ ID NO: 37352 - protein, 313 aa, Leuconostoc mesenteroides subsp. mesenteroides ATCC 8293
MKATAHTNIALIKYWGKKNTELNLPTTSSLSLTLDKFYTTTSVEPANHDRFILNDQVVDATRVHRFLDILRQQLGDFTPLQVISENHVPTSAGLASSASAFAALTGAVTHELGMDLPKEELSRLARRGSGSASRSFFGNFAMWHKGIDDASSFAESLNAPELPIALVVAEVCDAPKKITSTEGMKRAITSPNYDRWLSKSANQFIDMQHAILDQDIDKIGALAEDNALGMHALNLTATRSPFTYFTDKTQLILSLIQDMRHQGILAYATIDAGPNVKIITTTQEAPKIVTILNHAIPSLKLEIAQSGPGISYD

SEQ ID NO: 37353 - protein, 280 aa, Wolinella succinogenes DSM 1740
MLEAIFEKIKECAPYIQGVIGESAGEYFETKNATGDQQLKADLKADMIIEQEFAKIPSIKGLCSEEKEGCLILNPEGRYMIAYDPLDGSSLVEVNMSVGTIFGIYEGEFGAKNLIASAYIVYGPGIELVIAHEKVELYTFQFGRFEHRKTLALQEKGKINAPGATQACWHPKHKEFIDSLFAEGYRLRYSGGMVPDLHNILIKGGGLFSYPGASDNPKGKLRMLFEALPFAFIFEKAGGAAIDGKKRLLELEHSHLHDTTPCFFGSIHEIERVRSVYQEL

SEQ ID NO: 37354 - protein, 158 aa, Zea mays
CDCGNQLELAMKLIEKAGRGVLVYLRGHEGRGIGLGQKLRAYNLQDQGHDTVEANVELGLAVDAREYGIGAQILRDIGVRTMRLMTNNPAKFIGLKGYGLAVVGRVPVISPITEENQKYLETKRTKMGHVYGSDLPGSLPEFANPQDTPTEQEDDNQN

SEQ ID NO: 37355 - protein, 378 aa, Arabidopsis thaliana
MSDLPLDLVEKILSRVPATSLKRLRSTCRRWNALLKDRRFTEKHFHKAPKESRVLMLKEYRVFPISVNLKVTPPSVDFKGALGYSHSNSEQVVITEVFHCDGLLLCTTNDDRLVVWNPCLGETKWIQLKVDYRRYVSIFALGYIQNNESCRSYKILWTWYSYDYNSSPPQRGLGFEIYEFSSDSSWRVLDDVNHDSVVNHNSIIRSGVSLKGNTYMLAYDIEENSKFLLMFDFTTERLKRLCLPHFQDVGEMDLSVREEQLSVLNWSRITSKMEIWITNNFDTEATLLWKRVHLDSQCNCVRIFSSLYFDEEKKVVLYCNVKDGETSKKVVYIIGEDDGHYIEIPFVKSIKIERLQLIHTTRWYSLIFNYVPSLFQIQ

SEQ ID NO: 37356 - protein, 213 aa, Wolinella succinogenes DSM 1740
MLVAPSILSADFGKLSLEVGSICEAGCDYVHVDVMDGHFVPNLTMGPLVVQAVKKAATKPLDIHLMVQNNPFFVDLFAPLEPEFLSFHIEEEKHLHRLIQQTRKHGIRPAVALNPHTDESLLEYILSDIDMVLVMSVNPGFGGQKFIPSALEKIRRLKERIERRNPSCLIEVDGGVSDQNIHALKEAGVDMVVAGSYLFGSPDYRAAIASLRV

SEQ ID NO: 37357 - protein, 388 aa, Vibrio vulnificus
MRITVVGAGYVGLANAALLAQYHSIVLLDTDSKRVEQINAKSSPIVDVDIERFLSSGALQLTATTSPQIAYHDAQLIIVATPTNYDPITNGFDTVSVEQVIQDAIQISPNATILIRSTVPVGFTERMRTQVERRNILFAPEFLREGKALYDNLFPSRIVIGEQSERGQQIAELFANAAEKRDVPILLTNPTEAEAIKLFSNTYLAMRIAYFNELDSYAEAHSLGARQIIEGVGLDPRIGNHYNNPSFGYGGYCLPKDTKQLLANYQDIPNNIIGAIVDANRTRKDFVAESILKRNPKVVGIYRLIMKAGSDNFRASSIQGIMKRIKAKGIEVVVYEPVLKEAEFFHSRVIKDLNEFKQTADVIVSNRMVEELTDVADKVYTRDLFGSD

SEQ ID NO: 37358 - protein, 317 aa, Schizosaccharomyces pombe 972h-
MQIQETVPLDAPEHCPGPSSENAGTASACEGCPNQQICASAPRGEDPDLPLVVERLKEIKHKILVLSGKGGVGKSTFSSQLAWGLSLEEDKQIGLMDVDICGPSIPRIMGVEKEEAHQSSKGWSPIYVCPNLAVMSIGFLLPSEDSSVIWRGPKKNGLIKQFIKDVNWENLDYLIVDTPPGTSDEHLSLVQFFKNSGIDGAVVVTTPQEVALQDVRKEIDFCRKASIPILGLVENMSGFVCPSCKGKSNIFTITTGGGEALAKEMGLPFLGKIPLDPLIARSCDFGKSFIDECPESPASEIIIDIINKIDESLQKRQ

SEQ ID NO: 37359 - protein, 482 aa, Mycobacterium smegmatis str. MC2 155
MRIEDLISSVPTGLWIGGEEREAASTFNVLDPSDDQVITAVADATAEDAIAALDAACAVQDEWAATPARTRGEILRSVFEKITERADDIAALMTLEMGKVLPESKGEVAYGAEFFRWFSEEAVRIDGRYTHAPAGTGRILVTKQAVGPCYAITPWNFPLAMGTRKMGPAFAAGCTMIVKPAQETPLTMLLLAKLMDEAGLPKGVLSVLPTSNPRGVTGALIDDGRLRKLTFTGSTGVGKALVKQSADKLLRTSMELGGNAPFIVFDDADVDAAVDGAILAKMRNGGEACTAANRFHVANSVREEFTEKLVKRMSEFTLGKGLDPSSTLGPLINSKQVATVTELVSDAVSRGATVAVGGVAPGGPGNFYPATVLADVPADARILKEEVFGPVAPITGFDTEEEGIAAANDTEYGLAAYIYTQSLDRALRVAETIQSGMVGINRGVISDPAAPFGGIKESGFGREGGIEGIEEYLDTKYIALTK

SEQ ID NO: 37360 - protein, 255 aa, Triticum aestivum
PAVKKTGRLIGVLSTDQSLKDKELLEMAKNWKIVGVDLISDVTCDAPYEWVDKTGSGWEFNDNQSSETFHVVVYDFGVKHNILRRLASYGCKITVVPASWPASDVLNLKPDGVLFSNGPGDPAAVPYAVKTVQEIVGKVPVFGICMGHQLIGQALGGKTFKMKFGHHGGNHPVRDNRTGRVDISAQNHNYAVDPESLPEGVQVTHINLNDQSCAGLVFPKMKLMSLQYHPESSPGPHDSDLAFGEFVELMKNNRL

SEQ ID NO: 37361 - protein, 275 aa, Glycine max
MAERGGGDRGSDRGGFGRGFGGRGRGGDRGRGRRRGPRREEEEKWVPVTKLGRLVKEGRIRSLEQIYLHSLPIKEHQIIDTLVGPTLKDEVMKITPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSGIVAARVPKKVLQFAGIDDVFTSSRGSTKTLGNFVKATFDCLMKTYGFLTPEFWKETRFSKSPFQEYTDLLAKPTGKTLILEEERVDA

SEQ ID NO: 37362 - protein, 487 aa, Pseudomonas fluorescens Pf-5
MKALDELTFDNRFARLGDAFSTHVLPEPLDNPRLVAASPGAMALLDLDPAVAETPVFAELFGGHKLWAEAEPRAMVYSGHQFGSYNPQLGDGRGLLLGEVYNQAGEHWDLHLKGAGQTPYSRMGDGRAVLRSSIREFLASEALHALGIPSSRALCVIGSDTPVWREKQERGAMVLRLAPSHVRFGHFEYFYYTKKPEQQKQLGEHVLALHFPECQELPEPYLAMFREIVERNAELIAKWQAYGFCHGVMNTDNMSILGITFDFGPFAFLDDFDAHFICNHSDDQGRYSFSNQVPIGQWNLSALAQALTPFISVEALRESLGLFLPLYQAHYLDLMRRRLGFTQAEDDDQKLVERLLQLMQNSGVDYSLFFRRLGEHAPEQALARLRDDFVDRNGFDAWAELYRERVARDPIQGQDLRRARMHAVNPLYILRNYLAQKAIDAAEAGDYSEVRRLHQVLSRPFEEQPGMDSYAERPPEWGKHLEISCSS

SEQ ID NO: 37363 - protein, 580 aa, Pseudomonas fluorescens Pf-5
MNATTINSLFLIGALLVGASILVSSLSSRLGIPILVIILAVGMTAGVDGGGIIFDNYPTAYLVGNLALAVILLDGGLRTRVASFRVALWPALSLATVGVLITTGLTGMAAAWLFDLNLIQGLLIGAIVGSTDAAAVFSLLGGKGLNERVTASLEIESGSNDPMAVFLTVTLIDMLASGHTGLHWSLLTDLIREFGIGAVIGLGGGWLMLQLVNRIHLATGLYPILVVAGGLVVFALTNALHGSGFLAVYLCGLVIGNRPVRSRHGILHMLDGMAWLAQIGMFLVLGLLVTPHDLLPIALPALGLALWMILFARPLSVLVGLAPFKAFHGREKAFISWVGLRGAVPIILAVFPLMAGLPNAQLYFNLAFFIVLISLLVQGTSLPWVAKWLKVTVPPEPAPISRAALEVHVTSEWELFVYRLGAEKWCIGAALRELKMPEGTRIAALFRGQQLLHPSGSTVLEADDLLCVIGHEHNLPALGKLFSQAPERGLDLRFFGDFVLEGDAQLGAVSALYGLKLDGQDADMPLGAFIAQKVGGAPVVGDQVEWNNTIWTVAVMDGNKIGKVGVRFPEGSRPGPGLFL

SEQ ID NO: 37364 - protein, 218 aa, Arabidopsis thaliana
MAEIKDEGSAKAYAFPLRNPNVTLNERNFAAFTHRSSAAHPWHDLEIGPEAPTVFNCVVEISKGGKVKYELDKNSGLIKVDRVLYSSIVYPHNYGFIPRTICEDSDPMDVLVLMQEPVLTGSFLRARAIGLMPMIDQGEKDDKIIAVCADDPEFRHYRDIKELPPHRLAEIRRFFEDYKKNENKKVDVEAFLPAQAAIDAIKDSMDLYAAYIKAGLQR

SEQ ID NO: 37365 - protein, 373 aa, Physcomitrella patens
MRKTLKKCCCFASLMELCVRASVEGRRAHHLVTLSSLFNKGTQPTIKANKPSVSYGQALQAKKEEDFVIVKTNCQRIPGDGSSTYDAFAVLDGHNGSAAGAFTKENLLNNVVNAVPSGLSRDEWLAALPRAMVAGFVKTDKDWRSKGIFSGTTVTLVIVDGYIVTCACVGDSRCVLDAQGIVTALTIDHRFDTNEEECERVVASGGQVARLHPYGCDIGPLRSWPGGICLSRTIGDVDAGEHIVPVPHVKQIKLSPGGGRLIIASDGVWDALTSEKAAKVCRGEKHPEVAAKNIVKEVIKVQGLRDDTTCLVVDIVPPGRASRSFAPAVRKQMMVMRFLRRTRSKKGSGSGAPMEELFEESSATLSERLRPVT

SEQ ID NO: 37366 - protein, 86 aa, Glycine max
  misc_feature (61)..(61): Xaa can be any naturally occurring amino acid
GKYERVGTTQKRARAGKVAPFTGLKYMAVVPTRKTNQELTFIDRNGGGVLCLQVWPRAGKXMRVTLFYVPDIDDAHVGDEVQYLLM

SEQ ID NO: 37367 - protein, 81 aa, Chlorobium tepidum TLS
MSAAEIKDKVYDIIVSKMGVNKDQIKPESKFADDLGADSLDTVELIMELENEFGVQIPDEDAEKIGTVQQAIDYIVNKKVS

SEQ ID NO: 37368 - protein, 249 aa, Yarrowia lipolytica CLIB122
MVQPIIAPSILSSDFAKLGAQSRMMVDYGADWLHVDIMDGHFVPNISFGPTVVKCLRAELLKGEAFFDCHMMVTDPLRWVEPMADAGADQYTFHYEACYDHEEVIKAIKAKGMKAGIAIKPATSVEVVYPLVDQLDLVLVMTVEPGFGGQKFQQDMMPKVAALRERYPNLNIEVDGGLGPQTVDDAGAAGANVIVAGTSVYHSDSPPRTIKEMRDKLITYQKDIEMAAEHPEIVTIQQEILPVPAAASA

SEQ ID NO: 37369 - protein, 144 aa, Synechococcus sp. CC9311
MNPSRCRIIAIGKVRKSWVQDGIELYRKRLPGLTIVELRDSNPEKEAESIRQTLRRDEWPVMLMEQGETLTSINFSERLRSLGSQRLAFVIGGADGLTAELKALAHWKLSLSPMTFPHELARLLLIEQLFRAQAILQGSPYHRA

SEQ ID NO: 37370 - protein, 361 aa, Synechococcus sp. CC9605
MTPTPTPNDAITTGVPSDRLWLRSELMGTQVITRDTGRRLGVVGEVIVDIDRREVVAVGLRDNPLTRFLPGLPRWMPLDRIRQVGDVILVDSADSLSENFNPERYSRVINCQVITESGEQLGRVLGFAFDIETGELATLVMGALGVPLLGEGVLSTWEMPVEEIVSSGPDRIIVYEGAEDKLKQLNSGVLEKLGVGGPSWEEQERERYRVNLVPVENQLTSGQPQEQEQRRLQASEAERFEADAELEYVELEDRRQESMQQRRYLDEPQRYDEQPYTEPPRYDERPPERARTYNEPAPFEQQPAYEEQAAYEEQPAYEEQPPRRAMPASRRAVQQSGEPLDVEPMEDSAPQRRSQDLDDPW

SEQ ID NO: 37371 - protein, 394 aa, Microcystis aeruginosa PCC 7806
MPDLAKIILKNHKIDAVKRFHPWIFSGAIKEMEGEVKEGAIVEVYSDRGEYLATGLYNPSNIAVKILSFPKVSDIAQLFLEKFQNAYQLRQQIGLVDNPKTNCYRLINAEGDGLPSLIVDWYNGTAVIQAYSLALYQRLDLIVDCLKTIYADNLRAVYDKSAAVLAKSAHISENKYLFGQKTSDEVLESGHRFIIDWEKGQKTGFFLDQRENRALLSQYSHNKRVLNTFSYSGGFSIYAMQAGAALVHSVDSSHGAIDLTEKNIALNNLSEVPHQSYSTDVFNFLRDCQEDYDLIVLDPPAFAKSIQSRHQAVMAYKRLNYQAFQKIRPQGIIFTFSCSQVVNEEHFQGAVMAAAIESARPVRILARLSQPADHPTSIYHSEGSYLKGLVLAVD

SEQ ID NO: 37372 - protein, 365 aa, Dehalococcoides ethenogenes 195
MDFKLTVLPGDGIGPEVMAEGLKVLNAVAKKYKHSFEYQYGLIGGCCIDKEGVALSPETLAMCKKSDAVLLAAVGDPRFDDPKLPVHPEDGLLALRRGLGLFANIRPVKVAPSLVNSAPIKAEIVKGTDFIFIRELTGGVYFAKPKKRWTTPSGIRKATDSMTYSEKEIERIVRVGFELARSRKKKLVSVDKANVLLSSRLWRQIVIEIAKDYPDITVEHILVDACAMKLILAPTYFDVIVTENMFGDILTDEASMLAGSMGMLPSASLAGIPAKGTKTFGLYEPIHGSAPTIAKQNIANPIATILSIAMMLRYSCGLETEAAEIEAAVDKVLAAGYATIDIFKEGNTKLGTAEMGSQIAKIIGG

SEQ ID NO: 37373 - protein, 218 aa, Chlamydomonas reinhardtii
RVTKMCESFWKLTAYGSMLLLEVAIVHNEPWFWRPADYWVGWPNQPELPLMRLLFWVQLAYYISTTFTLALWEVPRSDYWVMQTHHCCTVVLIYYNYISGYHRWGCLIMMLHDINDVIMELAKCLNYAEQHMAANGAFAAFVLSWAALRLYAFPAILIRSTLFDSVRVLGYTPPHHGLLNTLLCVLCCFHMYWFGLILRVAYMTVVKGQGEDIREKED

SEQ ID NO: 37374 - protein, 443 aa, Ashbya gossypii ATCC 10895
MTQTNQVRASTKGVLGMTRNVVGAFTANWRCRRQHQALGRVPEAMPDQILGLTERFNQDRNPHKVNLTVGIYKDDNGEVTSFPSVARAQLMVEGQRGGRLAYLPIAGCPSYGARVSDFLYSECAPQGREFLASGCVSFMQTLSGTGALSLASLFLSNFISKTIWVPQPSWANHMNIFKLNGFEEVRRYRYYEDGAVDVDSWLAQLERAAADRPYPQCILLHACCHNPTGVDPTREQWSRILSVINGLGMVPIVDMAYQGLESGDLRADAYLLRMCLEHRWDNGLYVCHSFAKNMGLYGERVGSLSVVHPLGQFQAKAATDSQLKCIIRASYSSPPSYGSRVATTVLSVPEIKQQWHEDVHGMCNRLWSVRCMLHEKLRWPKLIDSTSQHGMFYYTGIGPDAVDTLREKYSVYLTKDGRLSLAGINTGNVDYVARALRNVSTYP

SEQ ID NO: 37375 - protein, 327 aa, Physcomitrella patens subsp. patens
MVGSGAFCKVYQGSDLTNHEVVGIKLEDTRTEHAQLMHESRLYNILRGGKGVPNMRWFGKEQDYNVMVLDLLGPNLLHLFKVCGQRFSLKTVIMLGYQMIDRVEYVHSRGLVHRDLKPDNFLMGCGRQGNQVFIIDFGLAKEYIDPATRRHIPYRDRKSFTGTARYASRNQHKGIEHSRRDDIESLGYILMYFLRGNLPWQGQGGQRFTDQKQHEYMHNKIKMETTIEDLCDGYPRQFADFLHHARELGFYEQPDYSYLRSLFRDLFIQKKFQLDHVYDWTVKRCGKASHLLRSGAKMEKEVNGKKEGGGGAREVHDGCAQCFCCCC

SEQ ID NO: 37376 - protein, 405 aa, Methanosarcina acetivorans C2A
MYHLKCIECGAEYSRDEVIYTCSKCDGLLDVIYDYSSIKIDMEKLKTECPSVWKYAKLLPVEREPVTIQEGGTPLYKCDRLAEKIGIKKLYVKHEGMNPTGSFKDRGMTVGVTKALELGMNTVACASTGNTSAALAIYGAKAGIPVVVLLPAGKVALGKVAQALMHGAKVLSIRGNFDDALALVRTLCSQEKIYLLNSINPYRLEGQKTIGFEIADQLDFKVPDRIVLPVGNAGNITAIYKGFREFKILGITDSLPKMTGIQAEGSCPIVKAIKSGAPAITPEENPETVATAIRIGNPVNATKALSAIRESGGTAESVTDEEILAAQKDLARLEGIGVEPASAASVAGLRKLVDMGVIGRDETVVCITTGHLLKDPQTVIDVCEEPTVVDANIDAIREAIFGKAK

SEQ ID NO: 37377 - protein, 156 aa, Azoarcus sp. BH72
MARYDNIAEFESDLNGKGLRVGIVMSRFNQDVCEGLLSACTEELQKLGVSPELIRIATVPGALEIPLVLQKMGQSGKFDALIALGAVIRGETYHFELVSNEMGAGITRIGLDTGIPIANGVLTTEDDDQALARMQEKGSDCARAAVEMANLLKVLQ

SEQ ID NO: 37378 - protein, 758 aa, Pasteurella multocida subsp. multocida str. Pm70
MDAQLRQAALDFHEFPTPGKIEVTPTKSLATQRDLALAYSPGVAVPCLEIQADPAASYRYTSRGNLVAVISNGTAVLGLGNIGALAGKPVMEGKGVLFKKFAGVNVFDIEIDERDPDKLVDIIASLEPTFGGINLEDIKAPECFYIEQKLRERMKIPVFHDDQHGTAIISAAAILNGLRIVKKDIAKVKLIASGAGAASIACLNLLVSLGLPRENIIVCDSKGVIFHGRDERMDETKKLYAIEDNGKRTLAEVINDADIFLGCSAAGTLTQDMVKTMAANPLILALANPDPEILPPLAKAVRPDAIVCTGRSDYPNQVNNVLCFPFIFRGALDVSATAINEEMKLAAVHAIADLALAEQSEVVTSAYGETELSFGPEYLIPKPFDPRLIVKIAPAVAKAAMDSGVATRPIKDFDAYIEKLTQFVYKTNLFMKPVFAQAKQNKKRVLLTDGEESRVLHAVQEIATLGIATPILLGRPSVIAQKIKQLGLHIQEGRDFELVDIENNPYFEECYKTYHNLLKRKGITPAGAQRKMLHNPTVIGATLLQLGKADAMLCGLVGPYASHLSNIKEVIGVQPCVPTPATVNGLVLPTGNLFITDTFVNHNPTAQELAEITIMAANEVSRFGIEPKVALVSHSNFGTFDDPSAVKMREVLHLVKEKAPDLIIDGEMHCDVALNEKLRQDIMPDSPLKGAANLLVMPNMEAARISLNLLQGTATPITVGPILMGMNKPVHILTSASSVRRIINMVAIAAANVEPTCK

SEQ ID NO: 37379 - protein, 498 aa, Ashbya gossypii ATCC 10895
  misc_feature (339)..(339): Xaa can be any naturally occurring amino acid
MSELKEQVMATQEALRAIQESLKQLQIAPGADDASGADEEDGLEKWARRFVDFTYKNPTTHHVVAHYAGRLEAAGFRRLDERDEWERPAEGRFFTVRNGTSLAAFVVGRDWKATDGVRVIATHCDALAVKVRTVSARLRSGTDTSCLGVAPYAGALSPVWLDRDLGIGGRVLVREADSDRVRSRLVDSTPHPVARISTLAPHFGAVATGPLDPETQMVPVIGYGGADAEASAAERAAPLFGKHPLPLLRYVARLAGVEVAQLVQLDLDLFDVQRGSLGGLRNDFLFAPRLDDRLCSFAAMEALLAAPAPAPAAFDAVVFFDNEEIGSRTRQDSAMGLLXFICTRVLLPTAPTLPPFPPSSANSIWLSRDVTHLVNPSFFNQYLDGHKPVANSGLDLALDENGHIDTNSVGTAFATTFAAAAAAPLKYFHIRNGARSGGTVGPILSAATGARTIDLGIPQLSMHSIRAAAGSRDLGLAIRFFAGFLTDWRAVYDRFRGL

SEQ ID NO: 37380 - protein, 721 aa, Pseudomonas syringae pv. syringae B728a
MIYEGKAITVKALESGIVELNFDLKGESVNKFNRLTLNEFRQAVDAVKADASVKGVIVTSGKDSFIVGADITEFVDNFKLPEAELVAGNLEANRIFSDFEDLNVPTVVAINGIALGGGLEMCLAADYRVMASSARIGLPEVKLGLYPGFGGTVRLPRIIGADNAIEWIASGKENAAEDALKVGAVDAVVAPEKLQAAALDLIQRAISGEFDYKAKRQPKLDKLKLNAIEQMMAFETAKGFVAGQAGPNYPAPVEAIKTIQKAANFGRDKALEIEAAGFVKMAKTPAAQSLIGLFLNDQELKKKARGYDKIAKDVKQAAVLGAGIMGGGIAYQSAVKGTPILMKDIREEAIQLGLNEASKLLGGRLEKGRLTAAKMAEALNAIRPTLSYGDFGNVDLVVEAVVENPKVKQAVLAEVEANVGENTILASNTSTISISLLAQALKRPENFVGMHFFNPVHMMPLVEVIRGEKSSEEAVATTVAYAKKMGKNPIVVNDCPGFLVNRVLFPYFGGFARLVSAGVDFVRIDKVMEKFGWPMGPAYLMDVVGIDTGHHGRDVMAEGFPDRMKDDRRSAIDALYDAKRLGQKNGKGFYAYETDKKGKPKKVNDPAVLDVLKPIVYEQREVSDEDIVNWMMIPLCLETVRCLEDGIVETAAEADMGLIYGIGFPPFRGGALRYIDSIGVAEFVALADQYAELGALYQPTAKLREMAANGQSFFGQASSEE

SEQ ID NO: 37381 - protein, 1425 aa, Ashbya gossypii ATCC 10895
MTAGHRDERPDREGGSERDEHLNRVVQSVSDATKRLSQISNSSTAHTKTGKRKNRDTVGPWKLGKTLGKGSSGRVRLAKNMQSGKLAAIKIVPKRNVRHNQKQVTALPYGIEREIIIMKLITHPNIMALYEVWENKSELYLVLEYVEGGELFDYLIARGKLPEQEAIHYFKQIVQGVSYCHNFNICHRDLKPENLLLDKKNKTVKIADFGMAALETTNRLLETSCGSPHYASPEIVMGQKYHGSPSDVWSCGIILFALLTGHLPFNDDNVRKLLLKVQHGRYQMPSNVSKEAKDLISKILVVDPEKRITVDKILEHPLLVKYDNPGKGGLACPLEKPEERPKVLDIHSIDDIDETILSNLQILWHGAPKEYLVDKLLQSGFTEEKLFYALLLRYQQRQSVEPTSVPSNMASTNGSGAFARASNNDQSVINAPKVTQKSQFSINSLLVSPKKTREGYVASSSRVFKHSVSRRSLHVSPSPMKSSTSCRSLKSSSSKRLQSPNPKAITQPVKVTSPQPRRRTLHNSASKRSLYSLTSISKRSLNLNEFLQEANEVKTPKLPSMPLQDQPRSEAPKTPTKTTYGADSHGGEKPTFISVLHDCPTVDSEGMVFKSSSGTPMIAANAPIIQPAFIFGVGAFPGTKQPSSNSLSKPSLNSQSSPKQAQEATANSMRETIRDRQTLVVEKRVPSKTESVPPAFPRVRPIMERKHGSDLTLVRDTRSVAKEKRSSLSLDPRRTAPEPPRGIETLLRRYSLKNSIKSRSSLKKKRDSGAWSITDKTIFQDLGQVPEDEEQEKDSEEKGNDTFISTTETSDTPSSKFKVTTSTPIKKDDATAISAENAAVGTEQSGSEDEATNFDSNAHSYPISTDLKTEDDLTPIKPQGQTDLLRMPSSFMNSSNTFANLNNFISNIDKEYSPENSDSGRIEKDEPAGKAQPEQITVKKRQRTLAPGGYLSPSIPRMESENSLNQELGSRISDLSDLSFANDMPTYTNTAHAVSISPGTRNVCSFSPLEPRSPQDVSNNGKMRSNLHIPLRQLSEDMCDKTITTQEGESVNIFEDAPEEEGSLTTSTSGSVPNIHQKAISIDTMNTSCALVPVSHVRTSIHMNGDSSVLDWSTSDGILSKARPLPTSNHVRKKSGNRLSNNLTLSKSMMSMFKNLDQINVTDIQDPMPVSDLLSKGVDPIEPIEPLKNDQVTLKAESIGAESDSINMDLADRKHVTIFHDNVSDKNFKSTRMENSDKGSLGSGAPQATHLFHTGNKDMKSHETLLSPITETPAAALSATSLTRKESISSDGKSVKDETKKSGKGNWFMRLIMSFTKPKKTVIQEHMTVLPFDDVNIITLQQFSYQGVEYEIRQMERRKDKQKVEYDCRLLDGDFKFKINIYGENSAATKVSVKQKGRSDELAFTKLNTDIEALIKAKENAANVK

SEQ ID NO: 37382 - protein, 373 aa, Ashbya gossypii ATCC 10895
MLRLLNPRSTQTVSRATRLVIRLSSTAIPTTQKAVVFYEHGGELKYTDIPVPKPKPNEILVNIKYSGVCHTDLHAWKGDWAIKPKLPLVGGHEGAGVVVAKGANVTNFEIGDYAGVKWLGKTCMECEFCQKGFEPNCETPTLSGYTHDGTFQQYATADAIHAAHIPPGTDLAKVAPILCAGITVYKALKTAALIPGQWVAISGAGGGLGSLAVQYAVAMGYRVVGIDGGNEKEALFRSLGGETFVDFHKNKDIVSAVREATGGGPHGVVNVSVSTNAILQSVEYVRPTGTVVLVGLPPDATVKSDVLTHVLKSINIKGSYVGNRADTKEAIEFFTRGLVQSPIKIIGLSQLEEAYKAMEEGTSIGRYVVDTSR

SEQ ID NO: 37383 - protein, 128 aa, Arabidopsis thaliana
MSRSLGIPVKLLHESSGHIVSVEMKSGELYRGSMIECEDNWNCQLENITYTAKDGKVSQLEHVFIRGSLVRFLVIPDMLKNAPMFKDVRGKGKSASLGVGRGRGAAMRAKGTGRGTGGGRGAVPPVRR

SEQ ID NO: 37384 - protein, 582 aa, Kluyveromyces lactis NRRL Y-1140
MGKMSFIEGLQKRFFLGYSYKYNTFELDPIILATSIKVAVLDYFRNTPWYWIIRDAVFYHLLFNVLSRIILYIRGYGLLTSISKLFHYASRRLFEVLLSLPMVRGSVDKEVSKVLATIEKDMIKNDANLKDFPELPRTGLSEADVLKELDKLNSVLKHSDWENGKVSGAVYHGGDDLIDLQSKAFKKFCVANQLHPDVFPGVRKMEAEVVSMVLNLFNAPPTGCGTTTSGGTESLLLACVSAKMLGLRYKGITEPEIIIPKTAHAGFDKAGYYFGIKIHHVDLDPVTFQADVKQMRKLINRNTVMLAGSAPNFPHGIIDDIVSIGKLGETYKIPVHVDCCLGSFIVAFMSKAGFNDVPLFDFRVPGVTSISCDTHKYGFAPKGSSVIMYRNPELRKQQYYVSTEWTGGLYGSPTLAGSRPGALVVGCWATMVHVGADGYINSCKDIVGKARELKEFIQKEIPELQILGDPLCSVISFTSNKIDIYELSDTLSKSGWHLSALQNPSSIHLALTKLSLKSVDELKHLLKSTVDKMKQSPDAKPSSDGTSALYGVAGSVKTVGVADRLIEGFLDSLYKLEPEHAT

SEQ ID NO: 37385 - protein, 361 aa, Solanum lycopersicum
MKALILVGGFGTRLRPLTLSVPKPLVEFANKPMILHQIEALKAVGVTEVVLAINYQPEVMLNFLKEFEASLGIKITCSQETEPLGTAGPLALARDKLIDDSGEPFFVLNSDVISEYPFKEMIQFHKSHGGEASLMVTNLDEPSKYGVVVMEESTGQVERFVEKPKLFVGNKINAGFYLLNPSVLDRIQLPPTSIEKEVFPKIAAEKKLYAMVLPGFWMDVGQPRDYITGLRLYLDSLKKHSSPKLASGPHIVGNVIVDESAKIGEGCLIGPDVAIGSGCVIESGVRLSRCTVMRGVRIKKHACISGSIIGWHSTVGQWARVENMTILGEDVHVCDEIYSNGGVVLPHKEIKSSILKPEIVM

SEQ ID NO: 37386 - protein, 251 aa, Desulfococcus oleovorans Hxd3
MTARTPLIAGNWKMHKTGDEAGDTAADLARRIAGVTGREVMIAPPFTALAAVKIAIAGSIIGLGGQNLHWESSGAFTGEISGPMLTAAGCTHVIIGHSERRQFFGETDETVNKKIQAARAANLVPVMCIGETEAQREAEQTFSVLDKQIRNGLQGFALQDISDLVLAYEPVWAIGTGKTASREQAQEAHAFIRSVVEKLFGGPAAAAMRILYGGSVKPSNIADLMAMDDIDGALVGGASLEAATFADIVTY

SEQ ID NO: 37387 - protein, 334 aa, Desulfococcus oleovorans Hxd3
MTIRLGINGFGRIGRMVFRAAMNHPQVKVVAINDLSDAETIAHLLAFDSVHGRFGHTVKAGENSIIVDGETIPVFAVKDPAKLGWRDVNAGIVAECTGIFRDRDGASKHLEAGARKVIISAPAKEPDITIVMGVNSTSYDPRKHHIISNASCTTNCLAPVAKVIHEKFGIQAGLMTTIHSYTGDQRLLDFPHKDLRRARAAALSMIPTTTGAAKAVALVLPELAGKMTGLAIRVPTPNVSIVDFVATVNASGVTASDVNAALKAASENELAGILGYSDLPLVSSDFNGSALSSIVDALTTDVMGNMVKVLSWYDNETGYSTRMVDLAAMIGESL

SEQ ID NO: 37388 - protein, 797 aa, Gibberella zeae PH-1
MSDDWTADPLVLDFEHLARSDVGLVGGKNSSLGEMIRALGPEGIPVPPGFATSSYAYWHYVDANNIRGKIDELVDQWQSGHQTLAETGHAIRTLFLRGTWPADTTEAILSGYRDLCDKVGVDDVSVAVRSSATAEDLPDASFAGQQETYLNIQGSEALLDACRRCYASLFTDRAISYRHIKKFNHENVALSIGIQQMVRSDIGGAGVMFSIDTESGFDKIVLINAAWGLGENVVQGTVNPDEYQIFKPLLSNEKLSPILSKKLGDKAIKMVYGDKCVPTRNVPTSRAERASYVLEDDEILQLARWACRIEEHYSCPMDMEWARDGSSGKLYIVQARPETVQSRRDTAAFKTYKVGEHGHTLTTGLSIGDKAVAGRICLLTSVSDMDKFIDGSILVTESTDPDWVPVMKRAAAIVTDYGGRTSHAAIVSRELGVPAVVGTGNATYVLHTGQDVTVSCAESDSGLVYDGISDITTKTVQISDFPSVRTKIMLNLANPSAAYRWWRLPVDGIGLARMEFVVSNSIRVHPMALIHFDHLEDEAAKKEIADLTAGYAYKPDYFVDKLASGLATLCSAVYPKPAIIRMSDFKTNEYARLIGGAEFELKEENPMIGFRGASRYYSPRYKEGFALECRAVKKVREKMGLTNAIVMIPFCRTVKEARKVLDVMEQNGLKRGEKGLMVYVMCEIPSNVILASSFTQHFDGFSIGSNDLAQLTLGVDRDSGELASLFDEQDEAVKWMIARAITVARREGCKIGLCGEAPSNHPEFAEFLVNAGIDSISVSPDSFVQVMKHIVACEKGL

SEQ ID NO: 37389 - protein, 457 aa, Propionibacterium acnes KPA171202
MSTEVTLPALGESVTEGTVSRWLKAVGDTVEADEPLLEVSTDKVDTEVPSPASGTLLEIKVPEDEDAEVGAVLAIIGDPSESGSAPAKPTAEPAEKAKPEPVKSEAEEAPAPAAPKPAEAPKPAGTNEVAPRATNPSSDVYVTPLVRKLARENNVDLSTITGTGVGGRIRKQDVLAAAGKSGEAPSAPQAPAAAPAPAAPKPAGSARKASQEVSPEAAALRGTTEKMSRLRKVIASRMVESLQISAQLTATVEVDMTAISRIRNAEKAAFKAREGVGLSYLPFITKAVVEALKANPTFNANIDTEAGTITYGSSENIGIAVDTPRGLLVPVIKNAGDLNIAGLAHQIGDLAARTRDNKVTPDELSGGTFTITNYGSAGALFDTPIVNQPEVAILGTGALVKRPVVVTNEFGEDTIAVRDMMYLSLSYDHRLIDGAVAARFLSGIKARLEEGDFAGEF

SEQ ID NO: 37390 - protein, 432 aa, Wolinella succinogenes DSM 1740
MDNKTLAQEDLRYLWHPCTQMKDHEQFPLIPIARGKGVYLYDFEGNAYIDGVSSWWVNLFGHSHDYINSQIVEQMGRLEHVILAGFTHEPIIKLSKRLVEMTPHGLEKCFYADNGSSAIEVALKMSFHRHKIEGKKRALFLSLSNSYHGETIGALSVGDVALYKETYGEILLATLQTPVPRDLTQEATQEALEALEVILENRGEEISAFVLEPLVQCAGGMHMYSADYVKGASQLCRARGIHLIFDEIAVGFGRTGTLLALEQCGVVPDFLCLSKGITGGYLPLSVVMMSQETYDCFYAPYHENRAFLHSHSYTGNALACAAANATLDLLEDGSVLKNNRLLGERIDTHLKRLALHPRIGNARRTGMIAALDLLGFDPKERVGLRVYSEALKRGILLRPLGNVIYFMPPYVITLTEIDQVFEALEEVLGRIL

SEQ ID NO: 37391 - protein, 455 aa, Gibberella zeae PH-1
MSVHPEVPRGIALFHHAIGESWASIPTDLILAELKRRQKDGEKPECGSRSKGSYDTSAHVFALILILVLSTLACGFPLLSRRTMRGRKQKSIIFYCQHIGTGVLLATAFVHLLPTAFESMTDPCLPDFFSKGYTPLPGLVAMVSAIIVVAIESYLTARGAGHSHSHNHGYFDSDDEHESELPMMDTSGLSDRRTGIRPPDIHLEPMENQGLVAGISPLPGSSPMGQESKKLSDDFNDADSDLDLDMDELDPSGPSNMRSRSGPYASLKAGGADEEPLTPMSPMSPGPQSPEEQQRKMLQCILLEAGILFHSIFIGMAISVATGPAFVVFLVAISFHQTFEGLALGSRIAAIQFPRKSIRPWLMVLAYGTTTPIGQAIGLVVHRMYDPKSAGGLLVVGFMNAVSSGLLLYAGLVQLLAEDFLTEKSYKILKGTKRLRAFLAVCGGALLMAAVGAFA

SEQ ID NO: 37392 - protein, 279 aa, marine gamma proteobacterium HTCC2143
MESARDKLMSDKSLDIQTLFSVAGKVALVTGGSRGIGRMIAQGLLQAGAKVYISARHEDVCQQTASELSQYGECIAIAADVADEDSRDKLCEALAAKEQGLNILVNNAGAAWGDSYENYPERAFDKLMKINVTSVFTLTQALTPMLEAAASSQDPARVINIGSMDGLHIPTVHGAGTYAYTASKAAVHQLTRHLAVELGRRNITVNAVAPGFFPSKMTDYVFDQFGEGIRSNSLLGRTGEDEEMAGIAIYLCSRAGAYTHGAVIPVDGGTSINHQHVQN

SEQ ID NO: 37393 - protein, 271 aa, Arabidopsis thaliana
MADNDSLDQFLAAAIDAAKKAGQIIRKGFYETKHVEHKGQVDLVTETDKGCEELVFNHLKQLFPNHKFIGEETTAAFGVTELTDEPTWIVDPLDGTTNFVHGFPFVCVSIGLTIGKVPVVGVVYNPIMEELFTGVQGKGAFLNGKRIKVSAQSELLTALLVTEAGTKRDKATLDDTTNRINSLLTKVRSLRMSGSCALDLCGVACGRVDIFYELGFGGPWDIAAGIVIVKEAGGLIFDPSGKDLDITSQRIAASNASLKELFAEALRLTGA

SEQ ID NO: 37394 - protein, 363 aa, Azoarcus sp. BH72
MSALSPISEIIADIRAGKMVILVDEEDRENEGDVVLAAEFVTPEAINFMVTHCRGLVCLTLTDERCRQLGLEQMVRNNRTPHGTAFTASIEAATGVTTGISAHDRSRTVQVAVARHAKPDDIVMPGHIFPLTAQKGGVLIRAGHTEAGCDLAQLAGLEPAAVICEILKDDGTMARLPDLIEFAAQHGLKIGAIRDLIEYRAATEHLVEKVTEKDVDTPHGRFRLSAFEDRTSGDIHFALTRGEISPDRETLVRVHEPISVVDFLDPASGKHSFPVNDALAAIAKAEAGAIVLLYRPQSGTDLLASLTGTTVERPVKWDPRLFGVGAQILRALGVGRMRLLANPRKIPSMAGFGLEITGFVEKP

SEQ ID NO: 37395 - protein, 413 aa, Fagus sylvatica
MAGICCGVVGEGETTAPIELSSRPSRRRRIDLVPLKLMADVAAPQPLETDKKRQKLCLNTTSSLPSQVVENCKCVEEENEEKKKTNKNEALHTNQAANSCESSKPVEGRNNEEAVQECPKFGVTSVCGRRREMEDAVSVHPSVSNNFHFFGVFDGHGCSHVAMRCRDRLHDIVKEEVESVTEGMEWKDTMEKSFDRMDKEVQEWRVPIKTTNCRCDVQTPQCDAVGSTAVVAIVTPEKIIVSNCGDSRAVLCRNGVAFPLSSDHKPDRPDELVRIQDAGGRVIYWDGARVLGVLAMSRAIGDNYLKPYVISEPEVTITDRTAEDECLILASDGLWDVVSNETACGVARMCLRAQKPSSPPRSPGNDMAVGAASESSDKACSDASILLTKLALARHSTDNVSVVVVDLRRNHQQ

SEQ ID NO: 37396 - protein, 234 aa, Mycoplasma gallisepticum R
MVVTTSAMRFRSRVFMANLIFRNIPNILTTIRIIILIPILVLFYFSLSDQKTIYQIHFFNLATLKINLYFLIIGILFVVASFSDFLDGYLARKYQLISNYGKVFDPIADKLLINAVLIYFAYLGVVNFYLVILLILRDIYVDGLRVFVSTKKIVVPANIFGKLKTVAQMVAIIITFFVAGQFVLTNTIANQIFNLAYYLATFFSLSSGGIYSYQIYQKYQMMVKQTNTEQTPTS

SEQ ID NO: 37397 - protein, 491 aa, Polaromonas sp. JS666
MDTLLYPPPNSGHWTGKIYSDGWVAAQGGTAAVMEPATGGTLGQIGIASTADVDRAARSAQSARAAWAATPFDQRAAVMREAARLLKERAGEINGWNVRECGSIMPKAEWELSATYEQMLMAAALPMQANGQMFPSTMPGRTNLWRRVPIGTVGVIAPWNFPLLLAMRSVAPALALGNAVLLKPDAQSAVTGGMLIAQVFADADLPAGVLHVLPGGPATGDAVVRHPAVNMISFTGSTAVGRQIGEVCGGLLKKVALELGGNNAIVVLDDADLDAASSCGAWGAFLHQGQICMQAGRHLVHRSVAEAYSQRLKQRAEALHVGNPHAGPAHLGPVINAKQRDRIDQIVQASVAQGARVVTGGTYEGLLYRPTVLTEVQPEMPAFTDEIFGPVAPITVFDTDEEAAALVNASAYGLAAAIHSSNISRAMALANRLHTGMIHINDQTVNNEFHVPFGGMGASGNGGRFGGPANLEEFTQSQWVSVMDKPIVYPF

SEQ ID NO: 37398 - protein, 583 aa, Yarrowia lipolytica CLIB122
MIPFTKINLELLLLPLLIIPITLFLLVLNVQVNTVHRRYKEYRLKLARCPQQSTGLFGWWLIYAVVRCNRDRFYSAKVVDYFTKLRTFIVSLGGELVIYTSESENIKALLATQFSDYDLGKTRHALLFTLMGDGIFTLDGQGWAHSRALLRPQFSKETVSPLSSLETSLQQLMAIVKRRVALKGEVDIQELFFMLTMDTATNLLYGESVDSLGDCLKETKKETHVMTDGKRNLLQSRDHHSNVPNEWEPIYGTYEKKGLGIGSENSLQSGVSPRDSPVFEVSVSEDIRKAYPAALTTALEFSAMRSKLQRFYWIWGDVLYRQKFHSAVNTVHAFSNHFVNQALKLTPQELQMKSAEKYTFLYELAQRTRDPVAIRDQLINILIAGRDTTAALLSFVFLCLVANPEKLAKLREGIMTDFGTSTDSITFESLKRCVYLRYVINEALRLCPPVPINMRQANKDTTLPTGGGKNHDEPIFVAKNQIVTYSVLFMHHNQNIWGPDASEFRPERWGEPACPKGWEYLPFNGGPRICLGQQYALTEAAYVIVRLVQEFTEIEWRDRKGLPVLFKTHITMSLGEGLRVHMK

SEQ ID NO: 37399 - protein, 708 aa, Dehalococcoides ethenogenes 195
MDLSWLVWTAGLIAVLFALYLIRDVMRRDSGTPAMQDIAGRILEGAVAFLRRQYRTIAILAIVAAVAVGAVVGLLGGERGLEAYGITGFGIAWRTALAFMAGALCSGISGIIGMYISVKSNLRCAAAAAKGGLSEAVTVAIRGGAVSGFLIVALSLLGVAGIYYMYGGNPEVTPHLIIGFGFGASFVALFAQLGGGIYTKAADMGADLVGKVEAGIPEDDPRNAAVIADLVGDNVGDCAGRGADLFESTAAENIGAMILGITLYLATGNAAWVLFPLVVRAFGIIASIVGIMFVRGKDNESPMNALNRGYFTAVGLSIIGLFVANQTIGGDLWLFGAGVIGILTSVAMVFITQYYTEFRYNPVKEIANASRTGPATNIVSGTAVGLETAMPTAITIGAALLLSYWMGGQTGIAGGAVFGTAAATMGMLMTCPFILAMDTFGPITDNANGVIEMAGVGGKVRKITDHLDAVGNTTKALTKGYALASAGLAAFLLFEAYLERVAFLRGETEMMAVDLSRIEVFVGGLLAVALVFFFSAVAIKAVGKTASKIIEEVRRQFKADPGILAGTSRPDYARAVDITAAAGLREMIFPGLLPVLSPIVLGIFLKVTGYDSAMAIAGFLMVGTISGIMMAAYLNNSGGAWDNAKKYIETGEMLESDGSPVMKHTVTHAATVVGDTVGDPFKDTAGPSIHVLIKLLSTITLVLAPLFI

SEQ ID NO: 37400 - protein, 269 aa, Pseudomonas syringae pv. syringae B728a
MLRLSSLYRFPLKSCKAESMQRASFDALGLAGDRRWMLVDAGNGRFFTQRALPHMSQLSVLWNASGGVTLSAPGFEPLDVAVPPDIDLNLRGVTVWRDSLQVPDAGDEAAEWVSRFIGKPTRMVYLPAERARWIPGGYQTVNDRVSFADGFPLLLIGQGSLDDLSARMGRPMEMLRFRPNLVIEGAEAFAEDSWKRIRIGDIEFQLLTPCARCILTTVDPATGERSADREPFATLKTYREVEGNVLFGQNVVNEGLGELEVGMSVEVLE

SEQ ID NO: 37401 - protein, 184 aa, Bradyrhizobium japonicum USDA 110
MLGIGSQLPPFDITGVKPGFQAQEEEGQSAFETLTEMSFPEKWKIIFFYPKDFTFVCPTEIAEFARLSKEFADRDAVVLGGSTDNEFCKLAWRRSHVDLHNLPIWQFADTKGTLVDGLGVRSPEGVAYRYTFIVDPQNTIQHVYATNLSVGRSPKDTLRVLDALQTDELCPCNREIGGETLKVA

SEQ ID NO: 37402 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKP

SEQ ID NO: 37403 - protein, 456 aa, Escherichia coli CFT073
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGAWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 37404 - protein, 625 aa, Gibberella zeae PH-1
MLSHPENTDLIVPYLYQLDMVAGLLAVGNQIMALLAWQHQWDHQNGVSNTLRRLSHTPFAMSPFTVGDYLAERIAQIDIRHHFIVPGDYNLILLDKLGGHPSLTEIGCTNELNCSLAAEGYARGHGVSVCIVTYSVGAFSAFNGIGSAYAENLPVILISGSPNTNDVSQHILHHTLGIYDTTYQLEMAKKITCCAVRIRQAAHAPELIDRAIRAALTQRKPVYIEVPTNLAGETCPRPGPISSVISAVPSDRHSLDVAVTKTAEYIGSKQKCVVLVGPKVRRAMAQDALRQFVEAIGSAVVLQPAAKGTFPEDHAQFCGIFWGQVSTLAADTIVNWADLIICIGAIFTDYSTVGWTALPSVPQLFVDLESVTVASKIYCSRVQMSEFLSRLAETVCWNDNTMVEYNRLRPDPTLGEPSCGPERLTRKEITRQTQALISLNPQTVIFADTGDSWFNGLKLNLPFGADFEIEMQWGHIGWSIPASFGYALAKPHKRIVVMVGDGAFQMTAQEVSQMVRFRVPIIILLMNNKGYTIEVEIHDGSYNCVQNWDYARLVQAFSTENGNGHALGLEARTAEELSNSLERAIVHTNGPTLIDCSLHRDDCSRELITWGHFVAAANARMPKKE

SEQ ID NO: 37405 - protein, 123 aa, Triticum aestivum
  misc_feature (32)..(32): Xaa can be any naturally occurring amino acid
  misc_feature (53)..(53): Xaa can be any naturally occurring amino acid
  misc_feature (62)..(62): Xaa can be any naturally occurring amino acid
  misc_feature (83)..(83): Xaa can be any naturally occurring amino acid
MPRQFFVGGNFKMNGVTDSIKSIVSNINKARXDPSTEVVIAPPTIYLSLTREXPDPSIGVAXQNVYDKANGCFQWGEIERLSXSKGTKEWVGLLGWNNGASCFCCGKNERFLARKNKWLIDGV

SEQ ID NO: 37406 - protein, 365 aa, Pseudomonas stutzeri
MSEADQLKALRVRIDSLDERILDLISERARCAQEVARVKTASWPKAEEAVFYRPEREAWVLKHIMELNKGPLDNEEMARLFREIMSSCLALEQPLRVAYLGPEGTFSQAAALKHFGHSVISKPMAAIDEVFREVVAGAVNFGVVPVENSTEGAVNHTLDSFLEHDIVICGEVELRIHHHLLVGETTKTDRITRIYSHAQSLAQCRKWLDAHYPNVERVAVSSNADAAKRVKSEWNSAAIAGDMAAQLYGLSKLAEKIEDRPVNSTRFLIIGSQEVPPTGDDKTSIIVSMRNKPGALHELLMPFHSNGIDLTRIETRPSRSGKWTYVFFIDCMGHHQDPLIKNVLEKIGHEAVALKVLGSYPKAVL

SEQ ID NO: 37407 - protein, 640 aa, Kluyveromyces lactis NRRL Y-1140
MNSTSTQVYLNSSVLQQLNATIQAYLTDLVSTGQTFNSSQIVSENVRFTSGTLVVGLISIYFIYQWVFSKSKLPSAVQFKLYIPDAAHKHWKGKRMFPCSVYNPEQPHMIQSYCPATGQFLGSFKSMSDTDIDEIVLLAERAQLQWAKTSLKERLQVLLSLKNFILENQEAIARVACRDSGKTMLDASMGEILVTLEKIQWIIEHGEDVLKPSARPGPTNFFMKWYKGAEVRYEPLGVVGAIVSWNYPFHNLLGPIVASIFTGNAVVVKCSEQVVWSSKFFTLLVQEALKACGHDPNLVQLCYCLPPTGNDDAANYFTSHPVFKHLTFIGSKPVAHHVLKAAADSLTPVVVELGGKDAFIVLDSVKDLQALSSIIMRGTFQSAGQNCIGIERVIVSAKNYDALVSILNDRVGQLRLGSDIDNLEDVDMGAMISDNRFGQLENLISDALSKGAKLLHGGSRYNHPNYPQGHFFQPTLLVDVTEDMQISHNEVFGPILTVMRAKDTDDCIRLANAAPFGLGGSIFGADFGECNRVANSLTTGNVAINDFATFYVCQLPFGGLNGSGYGKFGGEEGLLGLCNAKSVCFDTLPFISTQIPKPLDYPIKSNSKAWEFVKAFITGAYAVSTWQRIKSLVSLAKNAN

SEQ ID NO: 37408 - protein, 388 aa, Oryza sativa Japonica Group
MAMLTAKLTSPPAATTWLPGGGRRSAPPRRATVIRAAAVSYADELVSTAKSVASPGRGILAIDESNATCGKRLASIGLDNTEVNRQAYRQLLLTTAGLGEYISGAILFEETLYQSTTDGKKFVDCLKDQNIMPGIKVDKGLVPLPGSNNESWCQGLDGLASRCAEYYKQGARFAKWRTVVSIPCGPSALAVKEAAWGLARYAAIAQDNGLVPIVEPEILLDGDHAIERTLEVAEKVWSEVFFYLAQNNVLFEGILLKPSMVTPGAEHKQKATPEAIAKHTLTMLRRRVPPAVPGIMFLSGGQSEVEATLNLNAMNQEPNPWHVSFSYARALQNSVLKTWQGRPENVEAAQKALLVRAKANSLAQLGRYTGEGESDEAKKGMFQKGYTY

SEQ ID NO: 37409 - protein, 1913 aa, Arabidopsis thaliana
MGDGEIGCHAQKFFTDIFTTNGIQVSPIDFADFPSSVTNIINSELTQDFRDSEIFEAICQIGDDKAPGPDGLTARFYKQCWDIVGNDVIKEVKLFFESSHMKTSVNHTNICMIPKIQNPQTLSDYRPIALCNVLYKVISKCMVNRLKAHLNSIVSDSQAAFIPGRIINDNVMIAHEIMHSLKVRKRVSKTYMAVKTDVSKAYDRVEWDFLETTMRLFGFCDKWIGWIMAAVKSVHYSVLINGSPHGYISPTRGIRQGDPLSPYLFILCGDILSHLIKVKASSGDIRGVRIGNGAPAITHLQFADDSLFFCQANVRNCQALKDVFDVYEYYSGQKINVQKSLITFGSRVYGSTQTRLKTLLNIPNQGGGGKYLGLPEQFGRKKKEMFNYIIDRVKERTASWSAKFLSPAGKEILLKSVALAMPVYAMSCFKLPQGIVSEIESLLMNFWWEKASNKRGIPWVAWKRLQYSKKEGGLGFRDLAKFNDALLAKQAWRIIQYPNSLFARVMKARYFKDNSIIDAKTRSQQSYGWSSLLSGIALLRKGTRYVIGDGKTIRLGIDNVVDSHPPRPLLTDEQHNGLSLDNLFQHRGHSRCWDNAKLQTFVDQSDHDYIKRIYLSTRSKTDRLIWSYNSTGDYTVRSGYWLSTHDPSNTIPTMAKPHGSVDLKTKIWNLPIMPKLKHFLWRILSKALPTTDRLTTRGMRIDPGCPRCRRENESINHALFTCPFATMAWRLSDTPLYRSSILSNNIEDNISNILLLLQNTTITDSQKLIPFWLLWRIWKARNNVVFNNLRESPSITVVRAKAETNEWLNATQTQGPRRLPKRTTAAGNTTWVKPQMPYIKCNFDASFNGLPRKDDTAKPSPVNSSGDISTSSQLCSLYFKGLVSDDSSAGFGVAIFGKKDDLLFQMKGPIHHDSNITPLEAELTALKRGLTEAVMGRCVPEENKTALLMIDVQRIREGFKSSFPIFVEGKRISYAYKLARETIVSEISISVNPPRQPKATRKTTCKICLDDDINENQMFCVGKCRHRFCSDCMRRHIEVRLLEGSVMRCPHYRCKTTLKFGGCINLLTPKIREMWQQRIKEDLIPVTGRIYCPNSRCSALMSETELSISTKEDEVRRCCFKCGQIFCIKCKVSWHSNLSCNDYKKLNPYPTENDGKIKALANQKRWRQCGKCQHMIELSKGCVQVKCRCGHKFCYRCGVQAGGCKHGHGLPPRPPPPPPSPPPTPIKGHPHRVSLVKNHDGLECDACDQSYGDAYSCGECKFTVHKKCTFLFEVVPEIFEHPSHVGHCLKLLTTGAPDHTVPKCHLCGKNTKRLLYHCRDCKLNVDIDCIIDPMCAQADLNMPWHHHPLFMGNFATNMTCDVCYDNHVDGYICLCCRLFVGWVCAALVIDSPEITHPCHTKHPLKLLTEGAPTYTDPKCHLCGEDTGKFIYHCDICKFNLDLVCAKTKTPPVALSNLKVHEHTLNLMPRLISFVCDACGTKGDRAPYVCHQCDFMVHKKCAHLPRVINVNHHDHRVSFKYPLGLGEWRCGVCFEEIDWSCGAYSCSLCPQYAIHSLCATRKDVWNGKELDGVPEEVEDIEPFKRNDDNTITHFAHEHNLMSLSKDGEESSLCGACVLPIGSYTFYKCSKSNCSFILHEKCANISKKKRHFLSSEPLILCFESIIDDDFLCRACYQMFCEGFFYSSKGVNFDLICSSITMPFIHGSHDHHLLYVKQEEGNKKTCHNCDNERAKVLLGCIKCNYFLDFRCATMPLTIMLPRYDDHPLTLCYGEEKASGKYWCDICERETNPETWFYTCNDCGVTLHTFCVLGDIRNAKAGGSFRHHGELELLPNNRSTRPLCNSCHSRCPGSFIMKSYDGGEVYCSCYCVSSQLGYTYKGADTCPPWAIYELELIVVIHVNYLSTYILHYLTAIK

SEQ ID NO: 37410 - protein, 114 aa, Kluyveromyces lactis NRRL Y-1140
MQSQNGIATLLKAEKEAHEIVAKARQHRQELLKQAKSDAAAEITEYKSKKEQELKKFEASNEGGVEGLEKEAENSVQTELKEIKELASKKEDDVVKLLIKAVTTPTGEMHVNAA

SEQ ID NO: 37411 - protein, 428 aa, Oryza sativa Indica Group
MASKRFLSLSLLILLLGFSSSLAAGQVLFQGFNWESWKENGGWYNMLMGKVDDIAAAGITHVWLPPPSQSVAEQGYMPGRLYDLDASKYGNEAQLKSLIEAFHGKGVQVIADIVINHRTAEHKDGRGIYCLFEGGTPDSRLDWGPHMICRDDPYGDGTGNPDTGADFAAAPDIDHLNKRVQRELIGWLDWLKMDIGFDAWRLDFAKGYSADMAKIYIDATEPSFAVAEIWTSMANGGDGKPNYDQNAHRQELVNWVDRVGGANSNATAFDFTTKGILNVAVEGELWRLRGEDGKAPGMIGWWPAKATTFVDNHDTGSTQHLWPFPSDKVMQGYAYILTHPGNPCIFYDHFFDWGLKEEIERLVSIRNRQGIHPASELRIMEADSDLYLAEIDGKVITKIGPRYDVEHLIPEGFQVVAHGDGYAIWEKI

SEQ ID NO: 37412 - protein, 439 aa, Mycobacterium smegmatis str. MC2 155
MTRLDSVERAIADIAAGKAVVVIDDEDRENEGDLIFAAEKATPELVAFMVRYTSGYLCVPLDGEICDRLGLLPMYAVNQDKHGTAYTVTVDAKKDVGTGISASDRATTMRALANPGSVADDFTKPGHVVPLRAKDGGVLRRPGHTEAAVDLARLAGLQPAGAICEIVSQKDEGDMARTDELRVFADDHDLALISIADLIEWRRKHEKHIERIAEARIPTRHGEFRAVGYKSIYEDVEHVALVRGEISGPGSDGDDVLVRVHSECLTGDVFGSRRCDCGPQLDAAMAMVAREGRGVVLYMRGHEGRGIGLMHKLQAYQLQDAGEDTVDANLKLGLPADARDYGIGAQILVDLGIRSMRLLTNNPAKRVGLDGYGLHIIERVPLPVRANKENIRYLMTKRDRMGHDLVGLDDYDEAVSMDDYDEAVYLLGDRRPTESGGAQ

SEQ ID NO: 37413 - protein, 359 aa, Triticum aestivum
MNSGDAAGSSSGGSGDAGAPRRASRKPKYSKFTQQELPACKPILTPKWVISVFLLVGVIFVPIGVASLLASNKVVEIVDRYDDACVPSNVTDKLAYIQNSTISKTCRRTLKVPKDMKQPIFVYYQLNNFYQNHRRYVKSRNDQQLRDASKANETTLCDPEKTRDGMAIVPCGLIAWSTFNDTYTFQHNTNNLTIDKTDISWKSDRDHKFGSDVFPKNFQKGPLIGGKTLNESIPLSEQEDLIVWMRTAALPTFRKLYGRIYVDLKENDTITVTLGHHYNTYTLDGKKSWVLSTSTWLGGKNDSLGPAYLTVGGTRPLPGHWHSPHCKPRNWRYTTMTEARASFDQSKLGYLTLQNNFVQ

SEQ ID NO: 37414 - protein, 322 aa, Zea mays
TRVITGIYWGVNKFVIDNSSVPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDLQFSSLAKQELGREKLLKTQAVETVAEVVGTGNGSLQETLASEPSANGAATKQSQDPESTASEKSGQQSQ

SEQ ID NO: 37415 - protein, 282 aa, Nostoc punctiforme PCC 73102
MKNQQFGNWQTTVLGIVLATLVILGLNSFIIINPGEAGVISILGKARDGALLEGIHVKPPFISVIDVYDLTVQKFEVPAESSTKDLQNLSARFAINFRLDPIKVVEVRRKQGTLANIVSKIIAPQTQEAFKIAAARRTVEEAITKRSELKEDFDQALGDRLDKYGIIVLDTSVVDLAFSPEFARAVEEKQIAEQRAQRAVYVAREAEQEAQADVNRAKGRAEAQRLLAETLKAQGGQLVLQKEAIEAWKSGGAQMPKVLVMGGDSKSGVPFIFNLGNVPNQP

SEQ ID NO: 37416 - protein, 482 aa, Burkholderia sp. 383
MTDRRMLIAGEWCAARDGRTFDRFNPATGALASRAPAAGLADADAAIDAAHRAFPAWSALAPTERRRLLLKAADLMDARIDTFIATGVAETGATPGWIGFNVTLAANMLREAASMTTQIAGDVIPSDVPGNLALAMRVPCGVVLGIAPWNAPVILGTRALAMPLACGNTVVLKASEACPGVHALIGAVLDEAGLGAGVVNVITHAAVDAPELVERLIAHPHVKRINFTGSTHVGRIIARHAAAHLKPVLLELGGKAPVLVLDDADLDAAVDAIAFGAFFNQGQICMSTERVIVARPIADTLVERLAAKARTLVAGDPLAGHPLGTMVDAAAAARAASLVEDARAHGAQLPLGCRVEGATMQPAIVDGVTRDMRLYREESFAPVVAILRADSDDEAVALANDSEFGLSSSVFSRDVARAMAVARRIESGICHINGPTVHDEAQMPFGGTKASGYGRFGSRASIAEFTELRWITVQTVPRHYPI

SEQ ID NO: 37417 - protein, 191 aa, Zea mays
METSTKKLSSLRITSLDDDDDETEIPHQPPQAGLSTAEADYEDDDDEEEEAEVTLGVLSKPKHPGLLLRHLFPSKAGGIPAWLDPVNLPSGKSSYCGFCGEPLQFVLQIYAPIEDNVAAFHRTLFMFMCPSMACLLRDQHEQWKHKYGNPCRSVKIFRCQLPRNNAFYSAQPPKHDGSDKPLCPGGSVVFC

SEQ ID NO: 37418 - protein, 351 aa, Vitis vinifera
  misc_feature (111)..(111): Xaa can be any naturally occurring amino acid
  misc_feature (115)..(115): Xaa can be any naturally occurring amino acid
  misc_feature (281)..(281): Xaa can be any naturally occurring amino acid
MVSQFMHALNEEHTNAVVRILRYLKGIPGKRLLFSKTSNLDVEAYTNADWAGCMSHMRMDEMMRGERGWRELAKFEDRVDRFSRINYDSMCSPMSDEFNDQNDDWTEEGPXYDFXGPNSGSTACVAIIRGDQLLVANAGDSRCVLSRAGECFEFCIYFGLRWTGQIIGLSLKMLHRLTLKAYDLSTDHKPELQEEKERILKAGGCIQHGRVNGVLNLARAIGDSEFKMNKSLPAEKQMVTANPEINTASLCNDDDFMVLACDGIWDCMTSQELVEFVHEQXNSGCKLSAVCEKVLDKCLAPSSGGEGCDNMTMILVQFKKPIHSSASAGKQEPLPSDIPSGSNQTPTGTNS

SEQ ID NO: 37419 - protein, 603 aa, Nostoc punctiforme PCC 73102
MLTVVKPKRVALAIFSFTLVVYSQVASAALTLPLRSKKGMVASAHPLASEAGILMLRKGGNAVDAAVATTFAISVVEPFSAGIGGGGFLLMHSEKTGDMKALDFRERAPLKATKKMYLDAEGKVRPNASINGYLAVATPGTVAGLYEVHRRYGKLPWQEVMKPAITLAKDGFIVSDVVNWRSLQANDSRKEAVLNNPAAREIFTHNGEFYKPGEKLVQRDLARTLTAVAENPQSFYTGSIARAIASDMVKNGGLITLEDLKAYKPIWRTPICGNFRKAKVCSMPPPSSGGVHLLQILNIIGDTDLKSLGWHHPDAIHLMVEAMKIAYADRSEYLGDPDFVKVPVQELLSPAYAKQRRQEINMQVARPSTKVKPVDRKTLQRFSQANNRSLGENTIPLSHQSLKLHATRYESTETSHLTVVDEERNAVSLTFTINLSFGAGVVTPGTGIILNNEMDDFAAAPGVPNAFGLVGNDANSIAPRKTPLSSMTPTIVTENGHFRMAAGAPGGSTIITQVLQVILNVLEYNMNVGAAVSVPRIHHQWLPDELRVEPWGLDALTLEELRRRGHKIKESTPWGNGNAIAVTSDGTLEGAADPRGEGSPRGL

SEQ ID NO: 37420 - protein, 208 aa, Arabidopsis thaliana
MSLKATIVLLGLLWSFQATLGIRFVIDREECFSHKAEYEGDTLHVSFVVIKSDSQWHFNEDGVDLVIHGPTGEQIHDFREQISAKHDFVVQKKGVYRFCFTNKSPYHETIDFDVQLGHFAYYDQHAKDEHFTPLMEQISKLEEALYNIQFEQHWLEAQTDRQAIVNENMSKRAVHKALFESFALIGASFLQVYLLRRLFERKLGMSRV

SEQ ID NO: 37421 - protein, 123 aa, Triticum aestivum
MTVEAVNPKAYPLADSQLAITILDLVQQATNYKQLKKGANEATKTLNRGISEFVVMAADAEPLEILLHLPLLAEDKNVPYVFVPSKQALGRACGVTRPVIACSVTSNEASQLKSQIQQLKGGY

SEQ ID NO: 37422 - protein, 37 aa, Cucumis sativus
PMVFIGGKMFGGLEKVMAAHISGELVPALKDAGALWL

SEQ ID NO: 37423 - protein, 363 aa, Oryza sativa Japonica Group
MRHPGAGGGSGDAGFVRADQIDLKSLDEQLERHLGRPAERAASQHGGSGSRRGEFRQARARGGAAAGAAPSAAPGGLGDRPRQALKMLDWGEDGHRSEREISSLRAAFAQEVAVWHKLDHPNVTKFIGAIMGARDLNIQTEHGHFGMPSNICCVVVEYLAGGALKNFLIKNRRRKLAYKVVVQLALDLARGLSYLHSKKIVHRDVKTENMLLDKSRTVKIADFGVARIEASNPSDMTGETGTLGYMAPEVLNGHPYNRKCDVYSFGICLWEIYCCDMPYPDLSFSEVTSAVVRQNLRPEIPRCCPSSLANVMKRCWDANPDKRPAMAEVVSMLEAIDTSKGGGMIPTDQPQGCFSCFGRHRGP

SEQ ID NO: 37424 - protein, 408 aa, Glycine max
MVAMAAATASTQLIFSKPCSPSRLCPFQLCVFDTKQVLSSGRRRHVGGSGVRCMAVGEAATTGTKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 37425 - protein, 778 aa, Mycoplasma penetrans
MKENNKTIEAKNKELRDATKEFNEKLQKFLKDKVKKGFQIKNPNYKIDDNKISSNEVFKNNKNDFELNLPKNTWEEKTNKPESFENYKNVIPPYEDKFLPENFKEKFAPKNIKSEPLINKKDNLKEKNNNPVFDEVKIQEDDKFFDFSKFSETVSNQPENILKIEENDFKEIHDDFVSQYETFSKLETKENTNDLKTNLSSDTIKTIESKNEPEVQIESEIKDDSLEKEISEDDSFMDIFKAEQPDNQEDDSFVIDEEKAKEEYQEIKTNKSIVSDSHKIDIYEENEDLMKLNTLKSDKGIIYQIFGPVVDVKFARNQMPNINDCLEVKLPNNKKLVLEVALLEGDDVARCISMGSTEGLYRGLEVINTKNPIMAPVGSAVLGRMFNVVGEPIDNKPMPEKVEYSPIHKKPPSFDEQSTKTEIFETGIKVIDLLVPYVKGGKIGLFGGAGVGKTVLVQELIHNIATGHGGLSIFAGVGERTREGNDLYHEMIDGGVINQTALVFGQMNEPPGARMRVALTALTMAEHFRENNKQDVLLFIDNIFRFSQAGSEVSALLGRIPSAVGYQPTLAFEMGQLQERITSTKSGSITSVQAVYVPADDLTDPAPSTTFAHLDAKTVLDRKIASLGIYPAINPLESSSRMLDPSIVGIEHYKVARSVQTILQKFEELQDIIAILGIDELSEEDKLTVSRARKIRNFLSQPFFVAEKFSHKSGKYVSTQDTISGFSEIIEGKCDDIPEQYFLYVGGIDDVHKNYVAANSNNKVNSSNKPLNSENKSN

SEQ ID NO: 37426 - protein, 514 aa, Zea mays
  misc_feature (232)..(232): Xaa can be any naturally occurring amino acid
MDGLVAPSPSHSGATSGGGASHRKRKLPPSSLSDATGDEDDDTTAPSSPSTAPSSPSRPSSPSSSHSDDDDDDSLHTFNAARLDGAPSGGSASGRPPKPDSSSVSAAAAAAAAAVGGGPKPEPGSANAGDGKEDTKGLFTDNLQTSGAYSAREEGLKREEDSGRLKFLCYSNDGVDEHMIWLVGLKNIFARQLPNMPKEYIVRLVMDRTHKSMMVIRNNIVVGGITYRPYAXRFGEIAFCAITADEQVKGYGTRLMNHLKQHARDADGLTHFLTYADNNAVGYFVKQGFTKEITLDKERWQGYIKDYDGGILMECKIDPKLPYVDVATMIRRQRQAIDEKIRELSNCHIVYSGIDFQKKEAGIPRRLIKPEDIPGLREAGWTPDQLGHSKSRSSFSPDYNTYRQQLTTLMQTALKNLNEHPDAWPFKEPVDSRDVPDYYDIIKDPIDLRTMLRRVDSEQYYVTLEMFVADMKRMFSNARTYNSPDTIYYKCATRLENFFSGRITVLLAQLSTKS

SEQ ID NO: 37427 - protein, 447 aa, Magnetococcus sp. MC-1
MAKTLQDEPLRAPLAERMRPRDLAELVGQEELADEGRILHEALCSGHIPSMILWGPPGCGKTTIARMIATQVTLRFESLSAVLAGVKEVRLVVDRAREARVLGQGTILFVDEIHRFNKAQQDAFLPYVESGDIILIGATTENPSFELNGALLSRCRVVELKPLHEAALVTLLQRALVDQERGLERYKLAVEPEALQHMAQLAAGDGRYALNLLETFVELAAKSGVARGSQLTLERLKNSLQRRAALYDKAGDGHYNLISALHKSLRGSDVDAALYWLARMLEGGEEGLYIARRLVRFATEDVGNADPRALSLAMDARDAYHFLGAPEGELALAQCVVYLATAPKSNSVYTAFKAARKRAIESGAMAPPKHILNAPTATMQALGYGVGYQYAHDYEEGFVAQQYLPDALQGERFYYPVERGFERDIAKRMAYWDKLREQAKEEGKACK

SEQ ID NO: 37428 - protein, 338 aa, Aspergillus oryzae
MATPKVGINGFGRIGRIVFRNAIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTNINVLSNASCTTNCLAPLAKVINDKFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 37429 - protein, 426 aa, Synechococcus sp. CC9605
MTIAAEARSSADFVDLSSRYRADFPILKQRAPDGRPLIYLDHAATSQKPRQVLEALQHYYSCDNANVHRGAHQLSARATDAFEAARSTTAAFIDAASPREIVFTRNASEAINLVARTWGDANLKQGDEILLTVMEHHSNLVPWQLLAQRTGCVLRHVGITDSGELDLEDFRAQLNERTRLVSLVHISNSLGCCNPLDQVIPAAHAVGACVLVDACQSLAHKPIDVVALDADFLVGSSHKLCGPTGMGFLWARESLLEAMPPFLGGGEMIQDVFLDHSTWAVLPHKFEAGTPAIGEAVGMGAAIRYLQMVGLEAIQAWEAQLTRHLFARLQAIDGVRVLGPTPDQQPERGALATFLVDGVHANDIAALIDASGICIRSGHHCCQPLHRIYDVTASARASLSFTSTFEEIDRFSEELASTVAFLREHS

SEQ ID NO: 37430 - protein, 485 aa, Pseudomonas syringae pv. syringae B728a
MSTLIPCIIAGGSGTRLWPVSREAMPKPFMRLPDGQSLLQKTFLRAVGLPGVERLLTVTNREVYFRTVDDYRQLNKGNARLDFILEPFGRNTAAAVAAAALHVSQLYGDEAQLLVLPADHLITDVAEFSRAVTAAQKLAAEGWLVTFGILPTAPETGFGYIEKGPVLNADACQVARFVEKPDAITAQGYLDSGQHFWNAGMFCMRADAVLRELRKHAPDVLSAVSACLESSPRKEGNRELQVELDSESFALTPDISIDYALMERSEKVAVVPCQLGWSDIGSWQAVRELSPVDAQGNYCNGETVLHDVSNCYIDSPKRLVGAIGLDNLIIIDTPDALLIADGGRSQDVRIIAQELKRQGHDAYRLHRTVTRPWGTYTVLEEGKRFKIKRIVVRPQASLSLQMHHHRSEHWIVVSGMARVTNGEREFMLDTNESTFIKPGHTHRLVNPGVIDLVMIEVQSGEYLGEDDIVRFTDIYGRVPDKAMKS

SEQ ID NO: 37431 - protein, 444 aa, Saccharomyces cerevisiae
MGKLLQLALHPVEMKAALKLKFCRTPLFSIYDQSTSPYLLHCFELLNFTSRSFAAVIRELHPELRNCVTLFYLILRALDTIEDDMSIEHDLKIDLLRHFHEKLLLTKWSFDGNAPDVKDRAVLTDFESILIEFHKLKPEYQEVIKEITEKMGNGMADYILDENYNLNGLQTVHDYDVYCHYVAGLVGDGLTRLIVIAKFANESLYSNEQLYESMGLFLQKTNIIRDYNEDLVDGRSFWPKEIWSQYAPQLKDFMKPENEQLGLDCINHLVLNALSHVIDVLTYLAGIHEQSTFQFCAIPQVMAIATLALVFNNREVLHGDVKIRKGTTCCLILKSRTLRGCVEIFDYYLRDIKSKLAVQDPNFLKLNIQISKIEQFMEEMYQDKLPPNVKPNETPIFLKVKERSRYDDELVPTQQEEEYKFNMVLSIISSVLLGFYYIYTLHRA

SEQ ID NO: 37432 - protein, 469 aa, Bacillus anthracis str. A2012
  misc_feature (364)..(364): Xaa can be any naturally occurring amino acid
MENLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYNWNLDFGSISMLWRXGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 37433 - protein, 198 aa, Magnetococcus sp. MC-1
MSVLVTKQAPDFNATAVMADNSFQEISMSDYKGQYVVLFFYPLDFTFVCPSELIAFDHRLGEFEKRNVQVLGCSIDSHFSHLAWKNTEINNGGIGQVKYPLIADLNKQIARDYDVLFNDAIALRGSFLIDKEGKVRHQVVNDLPLGRNIDEMLRMIDALQFTEAHGEVCPAGWKSGDAGMQGSTEGVAKYLAANADKL

SEQ ID NO: 37434 - protein, 284 aa, Magnetococcus sp. MC-1
MKIGVIGLGAMGWGMAMNLHRANLLEAVWNRTISRAHAFEAQSGVVVASDPATLAARCEVILTCVSEDKDLFEVVDKLLAGLAPGKVVMDCSTVDPQTAVCCAERLANKQVAFLDAPVTGGVEGAQKGTLSMMIGGDARVLERIMPLLKPITAHVTHMGPVGSGQKAKAVNQVMVAGINQAVTQALALGQSLDLPLTKLIGAIAGGAAGNWFLDHRGLSMVENQFTAGFKVAHHLKDLRICRALTTEAGLEDTFLEATTAGYETLIEEGFGGEDISALYRTKLK

SEQ ID NO: 37435 - protein, 360 aa, Pseudomonas aeruginosa PAO1
MSKQILVLPGDGIGPEIMAEAVKVLELANDRFQLGFELAEDVIGGAAIDKHGVPLADQTLQRARQADAVLLGAVGGPKWDRIERDIRPERGLLKIRSQLGLFANLRPAILYPQLAAASSLKPEVVAGLDILIVRELTGGIYFGQPREQRVLENGERQAYDTLPYSESEIRRIARVGFDMARVRNNRLCSVDKANVLASSQLWREVVEEVAKDYPDVELSHMYVDNAAMQLVRAPKQFDVMVTDNMFGDILSDEASMLTGSIGMLPSASLDANNKGMYEPCHGSAPDIAGQGIANPLATILSVSMMLRYSFSQATAADAIEQAVSKVLDQGLRTGDIWSEGCRKVGTREMGDAVVAALKNL

SEQ ID NO: 37436 - protein, 94 aa, Glycine max
GGLLGSMLIFVFSAWACPAVGRTAQEVVNEPTRQFTDTPGIMDYKEKPDYGRCVAIVASASLREMIKPGALAIISPIVVGGLTFNFTCLHIYYH

SEQ ID NO: 37437 - protein, 637 aa, Neisseria meningitidis MC58
MNPSPLLDLIDSPQDLRRLDKKQLPRLAGELRTFLLESVGQTGGHFASNLGAVELTIALHYVYDTPEDKLVWDVGHQSYPHKILTGRKNQMHTMRQYGGLAGFPKRCESEYDAFGVGHSSTSIGAALGMAAADKLLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVAPALAVAEKLNATVADMRFVKPIDEELIVRLARSHDRIVTLEENAEQGGAGGAVLEVLAKHGICKPVLLLGVADTVTGHGDPKKLLDDLGLSAEAVERRVRAWLSDRDAAN

SEQ ID NO: 37438 - protein, 448 aa, Pseudomonas putida KT2440
MNMPETGPAGIASQLKLDAHWMPYTANRNFQRDPRLIVAAEGNYLVDDHGRKIFDALSGLWTCGAGHTRKEIADAVTRQLSTLDYSPAFQFGHPLSFQLAEKIAELVPGNLNHVFYTNSGSECADTALKMVRAYWRLKGQATKTKIIGRARGYHGVNIAGTSLGGVNGNRKMFGQLLDVDHLPHTVLPVNAFSKGLPEEGGIALADEMLKLIELHDASNIAAVIVEPLAGSAGVLPPPKGYLKRLREICTQHNILLIFDEVITGFGRMGAMTGSEAFGVTPDLMCIAKQVTNGAIPMGAVIASSEIYQTFMNQPTPEYAVEFPHGYTYSAHPVACAAGLAALDLLQKENLVQSAAELAPHFEKLLHGVKGTKNIVDIRNYGLAGAIQIAARDGDAIVRPYEAAMKLWKAGFYVRFGGDTLQFGPTFNTKPQELDRLFDAVGETLNLID

SEQ ID NO: 37439 - protein, 497 aa, Pseudomonas putida KT2440
MSIVQHLIHGELVTKGERTADVFNPSTGQAVRKVELASRATVQEAIDSAKAAFPAWRNTPPAKRAQVMFRFKQLLEQNEAKISQMISEEHGKTLEDAAGELKRGIENVEFACAAPEVLKGEYSRNVGPNIDAWSDFQPLGVVAGITPFNFPAMVPLWMYPLAIACGNAFILKPSERDPSSTLYIAQLLLEAGLPKGILNVVHGDKEAVDALIEAPEVKALSFVGSTPIAEYIYAEGTKRGKRVQALGGAKNHAVLMPDADLDNAVSALMGAAYGSCGERCMAISVAVCVGDQVADALIAKLEPQIKALKIGAGTSCGLDMGPLVTAAARDKVVGYIDDGVAAGAKLVVDGRGFRVAGNEDGYFVGGTLFDKVTPEMRIYKEEIFGPVLCVVRVNSLEQAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 37440 - protein, 296 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVWLGCRCAGGCATQGCRVQDSPNELPEREDPEGNLLWQLQATHWPAQCGGAVYEEVEKFITHSVPFSEINKAFDLMAKGGGH

SEQ ID NO: 37441 - protein, 326 aa, Arabidopsis thaliana
MQSSQRDVANERRMGKIDRNDAIDSMLRYADAGLSTFDMADHYGPAEDLYGIFINRVRRERPPEYLEKIKGLTKWVPPPIKMTSSYVRQNIDISRKRMDVAALDMLQFHWWDYANDGYLDALKHLTDLKEEGKIKTVALTNFDTERLQKILENGIPVVSNQVQHSIVDMRPQQRMAQLCELTGVKLITYGTVMGGLLSEKFLDTNLTIPFAGPRLNTPSLQKYKRMVDAWGGWNLFQGLLRTMKTISTKHGVSIPTVAVRYVLDQQGVGGSMIGVRLGLAEHIQDANAIFSLVLDEEDVNSIQEVTKKGKDLLQVIGDCGDEYRRI

SEQ ID NO: 37442 - protein, 398 aa, Streptococcus equinus
MAKLTVKDVDLKGKKVLVRVDFNVPLKDGVITNDNRISAALPTIKYIIEQGGRAILFSHLGRVKEEADKEGKSLAPVAADLAAKLGQEVVFPGVTRGAELEEAINNLKDGEVLLVENTRFEDVDGKKESKNDPELGKYWASLGDGIFVNDAFGTAHRSHASNVGISANVEKAVAGFLLENEIAYIQEAVENPVRPFIAILGGSKVSDKIGVIENLLKKADKVLIGGGMTYTFLKAQGIEIGNSLVEEDKLDVAKELLAKANGKLILPVDSKEANAFADYTEVKDTEGAAVDAGFLGLDIGPKSIAKFDEELTGAKTVVWNGPMGVFENPDFQAGTIGVMDAIVKQPGVKSIIGGGDSAAAAINLGRADKFSWISTGGGASMELLEGKVLPGLAALTDK

SEQ ID NO: 37443 - protein, 306 aa, Nostoc punctiforme PCC 73102
MTNGSSKIVRLSVVEVQNPKSDRGLFVGLVTLDLIYLAESAPKNNQKIVATDYTVAAGGPATNAAVTFSHLGNQATVLGVVGSHPMTQLIRGDLANYKVAIADLEPTTDLAPPVSSIIVTQATGERAVVSINAVKTQASSASIPPDILQNVNIVLIDGHQMAVSYFIAQAAKAKNIPVVIDGGSWKPGFEQILPFVDYAICSANFYPPNCQTGEDVFAYLAGFNISYIAITHGQKPIEYLSRTASGIVDVPQIHAVDTLGAGDIFHGAFCDYILRESFTDALALAAKIAADSCKFFGTRRWMDLKC

SEQ ID NO: 37444 - protein, 387 aa, Cryptococcus neoformans var. neoformans B-3501A
MGKGVLKAVENVNKVIAPALIDSKLPVTSQKEIDDLLIKLDGTENKGKLGANAILGVSMAVSEAAAADKGVPLYGYLAQLAGVSEPYVLPVPAFNVINGGSHAGNALAFQEFMLLPTGASSFTEAMKMGSETYHTLKKVITKKYGIDAANVGDEGGFAPNVSGAEESLDLLTEAIKQAGYTGKVQIGLDVASSEFFKEGKYDLDFKNPNSDSSKWLSGKELADLYHGYCEKYDICSIEDPFHEDDFDAWAAYNQTAKIQIVGDDLLVTNPRRIKMAIEKKACNALLLKINQIGTISESIQAVQLAQSNGWGVMTSHRSGETESTYIADLAVALRTGEIKTGAPCRSERMAKYNQLLRIEEQLEGKSIFAGGKGLSKGTTAPELHSSK

SEQ ID NO: 37445 - protein, 463 aa, Burkholderia sp. 383
MQQHTMRRELGARQISFMALGMAIGVGLFLGSASAIKAAGPGALVAYLIGGAMIFLIMRALGEMAVHRPVSGSFGAYAFEYVGPFAGYVVGWSYWLLMVGVGVAETTAIGIYMGFWFPDVPQWLWVVSAIAAISAFNLLNVKVYGELEFWFAIVKVVTIVLMIAGGALIVFTGIGHGGVPVGLSNLWRHGGVFPHGVLGVVSALPIVAYSFAGVEMIGLTAGEAREPQKMIPRAINSVLWRILIFYVGALFIIMALYPWHELGEHGSPFVTTFESLGLRQAAGIVNFVVVTAALSSFNCIVFSGARMLSSMAGNGLAPASFAALSASGSPSRAVRATVLFMSVGVVLNYVIPARVFGWLMSFLSFDVAVIWAMIVLTHMRFRRALAARGETVAFRMPYASVTSWICLVFVAFVFVMLGVDPTTRGSLYAGAAVMALMAIIYRRSRHLQAAARSTRVGLGVERV

SEQ ID NO: 37446 - protein, 208 aa, Avena sativa
MDMTGSEQWSSSSSSSYSVEHGGPAVWTTPPKRPAGRTKFKETRHPVYRGVRRRGNAGRWVCEVRVPGQRGERLWLGTYLTAESAARAHDAAMLGLHGRSASACLNFADSAWLLDLPSPLSDLAAVRRVALAAVVRGQCRKLVGDIAALLCRWDIRGAGRAGQRHVRAGRVRGNGLRHVLRGPRGGIAAGAAAAARRRLLGHRRRWRS

SEQ ID NO: 37447 - protein, 220 aa, Dehalococcoides ethenogenes 195
MYEDITRNIRDILAELPPDVTLEAAVKKRQPAEILAAIEAGVKIIGHNYLSEAEQTYPLIGEKVEWHFIGKLQSNKCKKIVRLFSVVETVDSFEIASELNRRAAEIDKVLSVFIEINSGREEQKSGVLPEDTVELAKRLSGLSNLRLSGLMTMGPALEDPDELRSVFRLTKNKFDEIAAMGLPNTELKFLSMGMSGSYKVAVQEGTNLVRLGTRIFGPRP

SEQ ID NO: 37448 - protein, 310 aa, Bordetella parapertussis 12822
MIFTGTANTRLAVDVVNHLDMSLGKMTVGRFSDGEVMVEINENVRGKDVFVLQPTCAPTNDNLMEIMVMVDALRRASAGRITAAIPYFGYARQDRRPRSARVAISAKVVANMLQVAGVDRVLTMDLHADQIQGFFDIPVDNIYAGPILLGDIWRRNFSNLVVVSPDIGGVVRARALAKQLEADLAIIDKRRPRANVSEVMNIIGEVDGRTCIIMDDMVDTAGTLCKAAQALKDRGAGAVYAYCTHPVLSGGAIERIETSSLDELVVTDTIPLSEQGQACGKIRQLSCAALLGETILRISNAESVSSLFAD

SEQ ID NO: 37449 - protein, 491 aa, Salmonella typhimurium LT2
MAVTQTAQACDLVIFGAKGDLARRKLLPSLYQLEKAGQIHPDTRIIGVGRADWDKEAYTHVVREALETFMKEKIDEGLWDTLSGRLDFCNLDVNDTPAFSRLGDMLDQKNRTTINYFAMPPSTFGAICKGLGEAKLNAKPARVVMEKPLGTSLATSREINDRVGEYFEECQVYRIDHYLGKETVLNLLALRFANSLFVNNWDNRTIDHVEITVAEEVGIEGRWGYFDQAGQMRDMIQNHLLQILCMIAMSPPSDLSADSIRDEKVKVLKSLRRIDRSNVREKTVRGQYTAGFAQGQKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 37450 - protein, 799 aa, Ustilago maydis 521
MSPGASSRGAGTGAGAGTRTAYRLPTLSSEANKNVLSLLRLIIIFLIAGAAVSSRLFAVVRHESIIHEFDPWFNFRATKVLTTDGFYRFWNWFDATAWYPLGRAAGGTAYPGLMVTSGAIYNLFHSLNIPVDIRNICVLLAPAFSGLTAWATYMFTAAMKDDAAGLLAAAFIGIAPGYISRSVAGSYDNEAIAIFLLMMTFYLWIKALKDGSALWGVATALFYFYMVAAWGGYVFITNMIPLHALVLILMGRFSSRLYVSYSSFYALGTLASMQVPFVGFQPVRTSEHMAALGVFGLLQLVAFVELIRSHVPSKQFKLLLVAFVVLVATLAFGALVALTYAGYIAPWTGRFYSLWDTAYAKKHIPIIASVSEHQPPAWPAFFFDLEMLIFLFPVGVFLLFKELRDEHVFVIIYAVMASYFAGVMVRLMLTLTPVVCVSAAIAMSTLLQTYLDPKEPTPLVEGDDDPEDESVLKPTRSAAASRKGADTATASREGTVGSSDSELFRPVSPVFRASSFTSSKFGVFGLDSRFFVTIYSLLLLLVFVLHCTFVTSTAYSSPSVVLASRNADGSQHIIDDFREAYYWLRQNTASDAKVMSWWDYGYQISGMADRPTLVDNNTWNNTHIATVGKAMCSPEDKSYPILQKHDVDYVLIIFGGLLGFSGDDINKYLWMIRIAQGVWPDEVREADYFTPRGEYKIDDGASKTMRDSLLYKMSYYRFNDLFGGRPGMDRVRQTPGPSKSPELEYLDEAFTSENWIVRIYEVKKPDALGRDLPGVKGFESGKRRKRAFALPAAATTKNK

SEQ ID NO: 37451 - protein, 667 aa, Candida glabrata CBS 138
MNEYPIPRPYPLAKSNTGLSLQTNWKAGSNWKLWLKLDYNSDEINQAISIEFDENDTIEDVKDKLFNRLNGTRWNRYNDMMSVGIGIYTNVPDLQENMTNLNTSDKILSHSPSSLKEQILQTNNNRSPQNSPLDRQNYRTRWLANHRRSNSASPTFQSIPNNRITPILNSNWHSEYHNEQLSSLYSHPKYASPNPHVSRQSPRKNLKYSVEDIDDYHYKIIFDPDEQIYQIYVSLFGAIGSQTSSSALLVFSNVDMGHAPPLPMESPAAGIFDDDHDKFAGHIQVLSQEHSVGNMDTYDNDNSLHGFGSNNADEVNFYANGTDIDERSNSELQAVQPAMLLLPKDYRLEEQEQLYHESEHNSNEQNKGLAFISDRNSSASVPQLENDKSKQLHVDTNVLDKQNAIDSNNYKQANSLLLSPLDVLKTTETTPIPVSKEKQQNITALDTLPFKLTTTSEKVFPKINVLIVEDNVINQAILGSFLRKNKISYKIAKNGKEAVDKWKEGNLHLIFMDLQLPVLSGIEAAKKIRELEKERGIANQSERVSTPGSLSSINMNGSTNSPVIIVALTASNSQEDKREALISGCNDYLTKPVNLLWLSKKITEWGCMQALIDFDGWKKEASRMTDSVLVRSPHRNRIPSANKSSTSISRSSSSGGKKQERAVSINN

SEQ ID NO: 37452 - protein, 363 aa, Bordetella parapertussis 12822
MALQCGIVGLPNVGKSTLFNALTGAGIAAENYPFCTIEPNVGVVEVPDPRLDKLAEIVKPERILPATVEFVDIAGLVAGASQGEGLGNQFLSHIRETNAIVNVVRCFEDPNVVHVAGKVDPIADIEVIETELALADLQTAEKALHRHSKTARSGDKDAQRLVTVLEKCIAQLNQAKPVRGLDLSDEEQALIAQLCFITAKPAMYVGNVSDDGFTDNPLLERLAEFAKSRNAPMVAICAAIESEIVDLPEEDRQAFLSDMGMEEPGLNRLIRGAFTLLGLQTYFTAGVKEVRAWTIPIGATASQAAGVIHTDFERGFIRAQTIAYEDFIACKGEQGAKEAGKMRAEGKEYVVKDGDVMNFLFNV

SEQ ID NO: 37453 - protein, 510 aa, Polaromonas sp. JS666
MSLSPSASAPQAIGHYLNGRITAGASGRSQEVFNPATGAVSGHVALASPADVDTAVAAAQAAFPAWADTPPIRRARVMFRFLELLNANKDKLAHMITAEHGKVFTDAQGEVSRGIDIVEFACGIPQLLKGDFTDQVSTGIDNWTLRQPLGVVAGITPFNFPVMVPMWMFPVAIAAGNSFILKPSPIDPSPSLFMAELLKQAGLPDGVFNVVQGDKEAVDALLVHPDVKAVSFVGSTPIANYIYETGARHGKRVQALGGAKNHMVVMPDADLEQAVDALIGAGYGSAGERCMAISVAVLVGNVADKLIPMLQARAKTLVVKNGVNLDAEMGPIVTAAAHQRITGYIDQGVKEGAKLLVDGRTFTGASAGPGCDQGFWMGGTLFDHVTPDMRIYKEEIFGPVLGCVRVKDFGEAVNLINAHEFGNGVSCFTRDGHVAREFSRRIQVGMVGINVPIPVPMAWHGFGGWKKSLFGDMHAYGEEGVRFYTKQKSIMQRWPESIGKGAEFVMPTAK

SEQ ID NO: 37454 - protein, 618 aa, Zea mays
MSSFFAVAVALVLSSLIHGTTMATASSEESFFQKCPASSCSEGGPEIRFPFRLATSPLSCGAPGMELVCSKADTVLVHPNLGLCKVTAIWYGGSTITIVPLAVAAEHKCPFQKIISTNLSTDVYRPYGDRATLVSCSAEFIVPSHPASLAGPISCLTNASRRFAYLVPSFRPMDFLPLDCTVLSNSISVPYPASVNAGFNETARGAITFGETMLEWRVPNITDVCRDCEAEGRLCGFSSESRQAFCKSKDHSSRLKVIAVTTPVATVLVLSAMAGAALLHLALKSKYDDEIHRKVEMFLETYRTLKPRRYTFSEVRKMTRRFSSRLGQGGFGSVYKGELPNGGVPVPVAVKMLEDSTGEEEFISEVATIGTIHHANVVRLLGFCSERSRRALVYEFMPNASLEKYIRCSSQEQSSLITASKMLEIATGIARGIEYLHQGCDQRILHFDIKPSNILLDYNLNPKISDFGLAKLCARDQSVVALTAARGTMGYIAPELYSRNFGTVSCKSDVYSFGMVVLEMVVVSAKRRKYSPAETEDQNDDVCVPEWIYEEIVTGQEPREMARGERDMVRKLAIVALWCIQWNPPNRPSMTTVVNMLTDSLQSLKIPPKPFVSSFVGQ

SEQ ID NO: 37455 - protein, 358 aa, Glycine max
METRAAAKRKANAATIVFVEKQYPNKRQRVVLGELPNLQNLIVSETQNSRKEKLLCRKNPNEKKPSPTNNNTFPSPQINESYDSDIHGYLREMEMQNKRRPMVDYIEKVQKIVTPTMRAILVDWLVEVAVEYKLLSDTLHLSVSYIDRFLSVNPVSKSRLQLLGVSSMLIAAKYEEMDPPGVDEFCSITDHTYDKTEVVKMEADILKSLMFEMGNPTVSTFLRRYADVASNDQKTPNLQIEFLGSYIGELSLLDYDCLRFLPSIVAASVIFLAKFIICPEVHPWTSSLCECSGYKPAELKECVLILHDLYLSRKAASFKAVRAKYKQQKFECVANLPTPPYVPSCYFEDQWCSEFLDK

SEQ ID NO: 37456 - protein, 524 aa, Ephedra gerardiana
MARARSWMFVFLSLALLLTCSAYRGLHQQQSRDNDNNNPCLNLISQNIRARDPAESSSIQAKSEGGRFEVTTPNDAPELECARVAFNREVISENSLARPRYTNVPLVAYVVKGEGYFSIVFPGCPNTIEDPFEEIRGGRQPRREPHHQPGRQDERGQGQQQQEGEDEQYEHDTAQKIHRVKRGDAIAIPAGHVFWIYNNRNEDLEIVSVADLANHQNQLDEEYLTFLLNGNAPVLPQQQEGRRRGRDESGRRGGEGQDASGILSGFSSDRLARALGIRNCTASRLQGKEQQQQRGLHVKVNFQNPSRDALYVAENAGNGFPSETVCNQRIRHNINRRDQPDFYHPRAGFMSVANSFKLPILDNIRLSADHVNLQPNAIFGPSWVVNAHRVIYALQGSGNVEIVAPNGEGVFQGRLRRGQFLVIPQFFAAVKEASEEGFEWVAFLTHQRPYRSDLSGAGSVFVGLPRPVVEEAFGLEEEEARALDRNLRRRANTPFSPPRSGSQVDYECPRQGDQDRDQPGFQLH

SEQ ID NO: 37457 - protein, 192 aa, Brassica napus
MISDSITNASATSAPSARDFAKKKRNNKSAAKLKQNKLGLRREQWLSQVAVTNKVCKEEKSAKPDQRDKPVERREEDSNGGSVDVRHESFMESPSNSSMGGTDISTNFSGSSSTSSDFCSGNITEEDNADHNDGEECVDDWEALADALAAEEENHLLRESVKEKESVGQSASNADDSINRDAEQDCLRMPSR

SEQ ID NO: 37458 - protein, 559 aa, Populus trichocarpa
MGDPWEFAVHAINGRWFSVFASFLIMAGAGATYLFGTYSKDIKATLGYDQTTLNLLGFFKDLGANVGVFSGLLAEVTPTWFVLLVGSAMNFAGYFMIWLAVTQKIARPAVWQMCLYICIGANSQNFANTGALVTCVKNFPESRGVMLGLLKGFVGLSGAILTQFYLAIYGTDSKSLILLIGWLPAALSVIFVYTVRERKPERQPNELRVFYHFLYVSIVLALFLMAMNIVEKQVDFSKAAYAGSAAVVCAMLFVPLIIAIREDWVQWNLKNQDGMKPATETTVDRALDIAPEVKSEVSKDKEEKAKESCFVSICHKPERGEDYTILQALLSMDMLILFAATFCGLGGSLTAVDNLGQIGESLGYPTKTIKSFVSLVSIWNYFGRVFSGFVSESLLVKYKMPRPLMMTFVLLLACVGHLLIAFPFPGSVYVASVIMGFAFGAQLPLLFAIISELFGLKYYSTLFNCGQLASPLGSYILNVKITGHLYDHEALKELAKKGMNRSSVKELICMGVQCYRVPFIILSSVTLFGALISLVLVMRTRKFYSSDIYKKFREIHGVS

SEQ ID NO: 37459 - protein, 522 aa, Corynebacterium ammoniagenes
MTQPATTPRPVLVVDFGAQYAQLIARRVREASIYSEVVPHSATVKEIKAKNPAALILSGGPSSVYADGAPQLKPELLELGVPVFGICYGFQAMNHALGGNVAQTGDREYRRTEITHTGGVLHDGLEENHKVWMSHGDAVDKAPEGFTVTASSAGAPVAAMECVAKQMAGVQYHPEVMHSPHGQEVLVRFLTEVAGLEQTWTSANIAQQLIDDVRAQIGPEGRAICGLSGGVDSAVAAALVQRAIGDRLTCVFVDHGLLRAGEREQVEKDFVASTGANVITAHEADAFLSKLAGVTDPEAKRKAIGAEFIRSFERAVAQALEESPEDSTVDFLVQGTLYPDVVESGRGDGTANIKSHHNVGGLPDDVEFELVEPLRLLLRRSPCRSRELGLPEEIVARQPFPGPGLGIRIIGEVTEERLEILRQADLIARTELTNAGLDGDIWQCQSYCLPMSAPSSPRRRPHLRHPIVLRPVSSEDAMTADWTRVPYDVLEKISTRITNEVNDVNRVVVDITSKPPGTIEWE

SEQ ID NO: 37460 - protein, 400 aa, Fusobacterium nucleatum subsp. vincentii ATCC 49256
MEEKMKISDRVKNMKYSAVRKLAPLAAEAEKKGIKVYRLNIGQPNIETPKLFFEGLKNIPDQVIKYADSRGISVLLEQVIEVYARDGHILKKEDIIVTEGGSEALTFAMLAICNPDDEVLIPEPFYSNYKSFLDISGAKIIPIPTDIKNNFALPKKEEIQKLITSKTKAILYSNPCNPTGKVYTEVEVKLLADLAIENDLFIIADEPYREFIYDDKDKHHSLLDIEKAKENVIIIDSVSKHYSACGARVGFLISKNKDFMTYIMKLCQARLAAPTVEQYAVANLMKAPKEYFKEIKEIYRRRRDIIVDSLNKIEGVTCSTPKGAIYAFAKLPVESSEDFCKWLLTEFVYDNSTVMLAPGEGFYETEGLGKNEVRFSFCVGEDDIEKAMKVLEEALKVYKK

SEQ ID NO: 37461 - protein, 237 aa, Avena sativa
MDMSGSEQWSSPSSSLEHGGPAVWTTPPKRPAGRTKFKETRHPVYRGVRRRGNAGRWVCEVRVPGQRGERLWLGTYLTAESAARAHDAAMLGLLGRSASSACLNFADSAWRLTVTPGLSDLAGVRRAALAAVANFLRREAAGGAANVPADEDTSSASADNAGGSSATSQPYVDGTFDFEMPAGMGSDIFELDMSGEMDQGTYYAGLAEGLLLEPPPQHAGACWDTGDGGADPALWSY

SEQ ID NO: 37462 - protein, 484 aa, Oryza sativa
  misc_feature (134)..(134): Xaa can be any naturally occurring amino acid
MASYDKAIESYKKAITTAASVAASVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSIXADPNNGNGSGQREVRSYELSFHRKHKEKALESYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRSILVVEDIDCSIELKQREAGEERTKSNSTEEDKGEDKVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDIDVALLGLLELLKSKIKDASETKAESKDANKQTEENKDSKAMENKNDSSTDECT

SEQ ID NO: 37463 - protein, 219 aa, Burkholderia pseudomallei K96243
MAFLLHQARFFTTVNHLRDLPPTVQPEVAFAGRSNAGKSTAINVLCNQKRLAFASKTPGRTQHINYFSVGPAAEPVAHLVDLPGYGYAEVPGAAKAHWEQLLSSYLQTRPQLCGMILMMDARRPLTELDRRMIEWFAPTGKPIHSLLTKCDKLTRQESINALRATQKSLDAYRDAGYAGKLTVQLFSALKRTGLDDAHALIESWVRPAAADEDRAAVAE

SEQ ID NO: 37464 - protein, 293 aa, Populus trichocarpa
MAIASDTQPQEKASTEVSGEEKKRWTLNDFDIGKPLGRGKFGHVYLAREKRSNHIVALKVLFKSQLQQSQVEHQLRREVEIQSHLRHPNILRLYGYFYDQKRVYLILEYAAKGELYKELQKCKYFSERRAATYVASLARALIYCHGKHVIHRDIKPENLLIGAQGELKIADFGWSVHTFNRRQTMCGTLDYLPPEMVESVEHDASVDIWSLGVLCYEFLYGVPPFEAKEHSDTYRRIVQVDLKFPPKPIVSSAAKDLISQMLVKDSAERLPLHKLLDHPWIVQNADPSGIFRG

SEQ ID NO: 37465 - protein, 192 aa, Chlorobium tepidum TLS
MNITTADFFCSYSSLNGLPSDGRPEIVFVGRSNVGKSSLLNSLCARKGLAKTSSTPGKTRLINYFIINDNLYFVDLPGYGYAKVGQGERESWGKLLTGYIQKRGEIALVVLLVDSRHPGMASDLEMMEFLDYCGRPFGIVLTKWDKLKQAEKSKASRTIESCAPNARFIVNYSSLSGSGRDRLLASIDTFTQ

SEQ ID NO: 37466 - protein, 480 aa, Salmonella typhimurium LT2
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIQTAALIGVDYLAVSFPRCGEDLNYARRLARDAGCDAKIVAKVERAEAVCDQNAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSAADGVVAAHEAVNLLRDKGYLVSGDLVIVTQGDVMSTVGSTNTTRILTVE

SEQ ID NO: 37467 - protein, 258 aa, Avena sativa
MDTGPEYNLTPTSSSSSQELGMALSSPTSPTPKRPAGRTKFKETRHPVYRGVRRRGSNGRWVCEVRVPSKSGERLWLGTHVTAEAAARAHDAAMLAMHGHTSAACLNFPDSAWLLNVPSNLSDLADVRRAAIEAVVEFLRLEAIKDGAAAVAVPIDGVVASAALAPSSHADNASPAATSQPSAASEVPEALGGDMFELHTSGEMGLGTYYADLAEGLLLEPPPAAASSEHGGDCGDAPDMMRRYGNGATEIRLSLAAE

SEQ ID NO: 37468 - protein, 374 aa, Chlorobium tepidum TLS
MKQIADKHVYAVVMAGGIGSKLWPLSRKKSPKQFLHFFDGGTMIRKTVERIAGAVRRENILIITGKQHRRLVNDSLPDFDVDNIIIEPTIKDTATCIALATTFIRKRDPDAVTIVLPADHLVLDEEHFLKTVSKGVRLARKQRGLITVGIHPDRPETRYGYIQVEPSVMIGEENDDPDDDDIALFRVKTFAEKPDLATAEHFLQSQDFWWNSGVFIWHVDDISREYSRSLPDLYEDMQNVHAFIGTERQESVIEDVYSWVHPVSIAYGIMEKAEKVYMLAGNFGWTDLGCWDEVIKIGLGLEGRDMDGSESIMIDSKNVFVRKPHGKAVVSIGVDDIIVVDTPDALLICKAGESQKVVKAVEMMRREPGLEGFL

SEQ ID NO: 37469 - protein, 261 aa, Chlamydomonas reinhardtii
MAWTRGELLGEGAYGKVYAGLNQQTGELMAVKVLQLLSKHGNKEAVFAQLEALEHEMSLYKKLKHKHVVRGGGGVEVTSAFYIFLEYVPGGSITSMLNRFGRFSEDLVRNYTRQLLMGLEYLHGCKIVHRDLKGGNALVSRDGIVKLADFGASKAYRDHTITDCMKSVRGSVFWMAPEVIRGTGYGRRADIWSLGCTVIEMLTGAHPWPHLDNQWTAMFTIAKTEEGPPRPKGIGEEAKRFLDKCLQFDPAKRPTAAELLQ

SEQ ID NO: 37470 - protein, 368 aa, Prochlorococcus marinus str. NATL2A
MSFSKKLKQLFTSTPPKNNWDGLIETYKTWLPVSNKTPIITLKEGATPLIEVKSISNRIGNGVKVFVKYDGLNPTGSFKDRGMTMAISKAKEAGCEAVICASTGNTSASAAAYASKGGMKSFVIIPDGYVAQGKLAQALVYGAEVLAIKGNFDKALDIVRELSDKYPITLVNSVNPYRLQGQKTAAFEIIENLGNAPDWLCIPMGNAGNISAYWMGFQEFFHAGKSKRLPRMMGFQASGSAPLVEGKSINNPETIATAIRIGNPVNKEKAILAKESSNGRFSSVSDSEIINAYKILGREEGIFCEPASAASVAGLLKIKEDVPKNSTIVCVLTGNGLKDPDCAIKNNDSIFHTGVEAEINSITKIMGF

SEQ ID NO: 37471 - protein, 346 aa, Pyrococcus horikoshii OT3
MILMLICSKCGRKFEEKFILRCTCGGTLLVKRKYDSFAPRKFLDIRRYIDYLPVDEKFLPSLTPGITPISKISDEVYLKLDYLQPTGSFKDRGTYVTVAKIKEEGIDEVVIDSSGNAGLSLATYGMAEGIKVHVFLSYNAKPEKIARLNSVNARLHFVEGDRMRVHEEAVKFSERTGIPYASHWLNPYFLEGTKTIAFEIYEQIGIPRYIFVPVGSGTAFLGIWKGFKELLEMGEINKMPSLVAVQAEGYESLCKRSKSVNKLADGIAIPNPPRIEEMKVALRETSGFCISVGEEETLAGYHWLRRNGFFIEETSATALAGYWKAREKGLVKGSSLLLLTGSAKSF

SEQ ID NO: 37472 - protein, 161 aa, Glycine max
  misc_feature (63)..(63): Xaa can be any naturally occurring amino acid
  misc_feature (101)..(101): Xaa can be any naturally occurring amino acid
  misc_feature (115)..(115): Xaa can be any naturally occurring amino acid
MDLSKTTYHTNVPDHSTFAYRYDPTYLARFKIAEESILKEATIHIIHDELMLDGNSRLDLASXVTTCMEPVRDKVIAADIDKNDVHMDDYAVTTELHNPSXNMIPHLFNAPLYEXHTCRGGGSFGSSEGIMWDVLSLNTRWGNRKNLVWKPYDNPNIVTGA

SEQ ID NO: 37473 - protein, 341 aa, Pyrococcus horikoshii OT3
MSVIQNIIGRIAVLRGGKYSVEVDVATDEGFGRFTSPIDDNPMLHIAEARRAVSEVDEIIGPELIGFDASEQELIDSYLWEIDGTEDFSHIGANTALAVSTAIAKAAANSRDMPLYSYIGGTFATELPVPVLSFAQDDMFDYYLVVKDLLEVTDIIDATNKIREIVKEINLENLSKASEDVGVELGLEVALGIGMKKEMDIEKVLNLVEDYNVAYIKPIGPPELFLELIAGTHGVFIDGEYLFRTNSVLDRRYYNALSIKPINLGTLTDLYNFVNDVKAEKITPILAEAKYEPADETFPHIALGLRCPAMLISWSSIEKINELNRIAEELGERGRIITFEE

SEQ ID NO: 37474 - protein, 452 aa, Magnetococcus sp. MC-1
MLVGALMIWVMPLPEGLTEQGRIVLTMTVVATTLFVTEPVPLPTVALLIVVGQVLLLKHNSSDVARTLMSDSVLFIMGSLMLAVAVVKQKLDKRIALFIIRFTGTKTSRIAFGISVMSGLLASFVGEHTVAAMMLPVGIALITLTSDDPAKVRNLAAVLLFSIAYGCSVAGVGTPSGGARNAIMIGYWSDFYGIVIDYVKWMLYAYPMFLLQLPFVTMILLFTFRPEFDDLTPAVEKLKAQVEAEGPLKQRHFVSIALFFLILYGWVGLSEGVGMGTIAVLGASAFLVGGLVKWEDLNNGVNWGVVLLYAAAISLGVQMKDSGAAEWVATSFLEMLTPFGADKGMGLWLAVSALTTGVTNTMSNGAAVAVLGPIVLNMAAAAQESPVVIGFITAISSAFAYLTVVGTPACTIVYASGYLKTSDFLNVGWRMAVMSTLLMLLFASLYWPLIGV

SEQ ID NO: 37475 - protein, 119 aa, Pyrococcus horikoshii OT3
MIEQCWSEIQEEQSPTSQIGQLRVQGLRDKRVIVEYIPLILKTFLLSKTSGVGPLIIPVRCFTCGKVIGDKYYEFKRRVEAGEDPEKVLDDLGLERYCCRRMLLSHVELIDDIMHYKVY

SEQ ID NO: 37476 - protein, 305 aa, Zea mays
YVKSRNDAQLRDKSKASDTTNCDPEAKTVDGKPIVPCGLIAWSLFNDTYTLIHNNKTLRVDKKDISWKSDRDHKFGSDVFPTNFQKGPLQGGKILNPKIPLSEQEDLIVWMRTAALPTFRKLYGRIHVDLKENDTITVQLENNYNTYSFSGKKKLVLSTATWIGGKNDFLGLAYLTVGGICFVLAFAFTLLYLIKPRLYIKLKQIALCSPKLYNQKLMSVSMLCSSSLKELNLTYMTKQVIAEILALRVCGVDRVITCCPSLTSIRKATKSRSRGAFRFALRESRLLEKAASWIHPFGWLLAFRG

SEQ ID NO: 37477 - protein, 187 aa, Mycoplasma gallisepticum R
MIMSNLLELKVTIEIPKGSNIKYEYDRKTDQISVDRILYGSEVYPHNYGFIKEALDWDGDELDCLVVANQAFQPGVVVPVRILGMMGMVDSGETDNKLIGVIACDKRFENIRSLKDLGAHALKEIKGFFETYKLLQNKKVLVKGFKELDSAIHEYKNCVSLMNQYGSLPKDEFIAKMKKMYPEKYME

SEQ ID NO: 37478 - protein, 647 aa, Dehalococcoides ethenogenes 195
MHTGLEISIPHNLQMSKLLDTINSPSDLKKLTLDELRELAVQIREELVNRVTLNGGHLASSLGVVELTIALHRVFESPKDKIIWDVGHQSYAHKLLTGRREQFATLRQHGGLSGFTCRDESPHDPFGAGHASTSISAGLGMAVARDLAKEDYSVISVIGDGAISGGMSFEAINNAGHLHTKFIVILNDNGMAISPSTGALSKFLNNVRFDPRFEFAKRGAKQTITNMPFGKSVWAFTKSIKRKFEKSMLPGSLWEELGFIYLGPVDGHNIRELEAALKCAKDFESQPVLIHMITKKGKGYDDAEADAVKYHGIAPKSGGLKSGHGLSYSQVFGQTLHKIMSDNPKVVAITAAMTDGCGLSEVAADFPDRVFDVGICEQHAVTFAAGMATQGYIPVVVIYSTFLQRSFDQIIHDVCLQKLPVVFAIDRGGIVGDDGKTHQGIFDLSFMSLIPDMIVTAPSDENDLQHLLYTAVNSGKPFALRYPRGFGEGVETEGTLRNIPIGENEVLASGSEIAIFATGKSVAFAKEAMEILAESGIKPTLVNNRYISPLDTELILKIAGNHKYLITVEENVLSGGLGSRINTILAEAGLVNAVKIANIAVPDKFVEHGNQSLLRAKYGLDGKGIAQKVLSLMANTGEAKHQQILCP

SEQ ID NO: 37479 - protein, 505 aa, Triticum aestivum
MYRAASGLGALKQHGADTQLLNIAVRSASTSVAQRSSGGFLGWLTGARSNALPPPDFALPGVTIPPPLADHVEPGKTKITTLSNGVKIASETSPGSACSVGVYVHCGSVYETPETLGATQLLKKLAFTTTRNRSQLRVVREIGAIGGSAKASANRELMSYSYGALKTYMPEMVEVLVDCVRNPALLDWEVKEEIMNLKAELAEASSNPETFLLDALHSSGYSGALANPLIASEASISRLNTDVLEEFLALNYTSPRIVLAASGVDHDELVSIAEPLLSDIPTATGTGKPKSVYVGGEYRRAADSSNTDLALAFELPGGWLKEKEFATASVLQALLGGGGVFTWGRPGKGLHSRLNPLVNEFDQIKSISAFKNVHSNTGIFGIHTSTEAAFVPKVIDLAARELTSLATPGQVDQTQLERAKAFAKSAILKNLESKASTTEDMGRQALAFGERKPVEQLLKAVDGITLADVSTVAEKIISSPLTMASHGNVINVPAYETVRGKFSSK

SEQ ID NO: 37480 - protein, 482 aa, Phyllostachys edulis
MVSQVADEKPQLLSKKAGCNSHGQDSSYFLGWQEYEKNPFDPAANPGGIIQMGLAENQLSFNLLEDWLEANPDALGLRREGASVFREPALFQDYNGLPAFKNALARFMSEQRGYRAVFDPSNIVLTAGATSANEALMFCLADHGDAFLIPTPYYPGFDRDLKWRTGAEIVPVHCTSANGFRVTRAALDDAYRRAQKSRLRVKGVLITNPSNPLGTTVPRADLEMLVEFVAAKGIHLISDEIYSGTAFAEPGFVSVLEVVAARSPLAADVSGRVHIVYSLSKDLGLPGFRVGAIYSANAGVVSAATKMSSFGLVSSQTQYLLAMLLGDKDFTRRYVAENKKRIKERHDQLVEGPKEIGIGCLESNAGLFCWVDMSHLMRSRSFEGEMELWKKVVFEVGLNISAGLSCHCREPGWFRVCFANMSAKTLDVAMQRLSSFVHHASSFVDEAGRRRGSGPARSMSCPLAIKWAFRLPPASADRKAER

SEQ ID NO: 37481 - protein, 257 aa, Neisseria meningitidis MC58
MYRQIGMWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 37482 - protein, 274 aa, Schizosaccharomyces pombe 972h-
MDSAEKKLDLSPIELAKRLACHMAVDENYPENPKVIGIGSGSTVVYVVERLLTKPGVDSVVFIPTGFQSKQLIVNNGLRLGDPDCYPNVDVSFDGADEVDDNLQCIKGGGACLFQEKLIAFLAKRLVIVADSRKNSHVLGEYWKKGVPIEVMPMAYASILPQLVELGAIEPKLRMGAPGKAGPVVTDNGNFIIDAHFGLIKNPKELFAKIKLLVGVVEVGLFCDMISAVYFGSKDGSVTVKKASGEKHIIPAPVTAAANEVDAKVAETNAKPLN

SEQ ID NO: 37483 - protein, 607 aa, Gnetum gnemon
MAAPPSMLWLLLLALLVLGVRGEAEREALISERRDACNRLSNRGIHPRDPSQFPNRFRSHGGTLQYASPADANMTDLDCAGVALLREIIRPYSLSRPRYSNAPHLLYVERGSGLLGIVTPGCPTTFRNPFATPSCPHREEDRRRRRRRPYDYESESERESEYEYEEEEEDEHETRQRRQQQEQEQGQEKEGDTCQKVRRVKEGDLVVIFAGNTFWLDNDNPSQELRLVAIVDVSNNQNQLDRRYKTFLVSGEARLESEEGGEEGGVSRGVLQGFSNDVLQRALDIGNTTILRHIERRVSQQRQQGQGLHIRLHRGQLDIPHPRQRRGEESQQYYEPEYEEEEEEDEYKEEEEEYPCERRGRRRGSGNGVAEEGSCSMRLRQSLNRADNADIYVRGAGRVNLANALKMPALQVVGLAADYVKLERRGAMFAPSFVVNAHRIMYVTRGRGRIQIVDDKGRRVFSGEVRQGQFLLIPQNFAAVKEATAQIFEWVAFLTDGRPLREQLVGRNSLIQSMPRQVVAATCGIRGNEAEQLIGSRQQTVGPILTPPSSYYYSRSSSSSRTYPEDLDSTTESQTTETETKTEAETETEAEAQTETQPVTAVLTASA

SEQ ID NO: 37484 - protein, 324 aa, Crocosphaera watsonii WH 8501
MDIKEGFVGTVGNTPLIRLKSFSEETGCNILGKAEFLNPGGSVKDRAALYIIKNAEEKGLLKPGGTVVEGTAGNTGIGLAHICNAKGYKCLIIIPETQSQEKIDLLRTLGAEVRTVPAVPYKDPNNYVKVSGRLAEELDNAIWANQFDNLANRQAHYETTGPEIWQQTNGKVDGWVSATGTGGTYAGGALFFKEKNPNIKCIVADPMGSGLYSYVKTGEIKPEGSSITEGIGNSRITANMQDVPIDDAIQIDDHEALRIVYQLLSQDGLFMGGSVGINVGAAVALAKEMGPGHNIVTILCDGGARYQSRLYNQEWLASKGLSLG

SEQ ID NO: 37485 - protein, 179 aa, Schizosaccharomyces pombe 972h-
MSANLQNENPEVKELNQLPSRVEEEEDLLLSSTKQWLTEIESEQTNIKEERDPIDPQEIYDLLAKINDPEHPLTLAQLSVVKLEDIEVVDNVEGDSYITVHITPTIPHCSMCTLIGLCIRVRLERCLPPRFHVDVKVKKGTHASESQVNKQLNDKERVAAACENEQLLSVLNGMMATCV

SEQ ID NO: 37486 - protein, 570 aa, Desulfococcus oleovorans Hxd3
MSYLVLARKYRPQTFEEVVEQQQVTRTLTNAIASGRVAHAILFTGPRGTGKTTIARILAKAMNCEKGPTPTPCCACRSCLEIASGNATDVFEIDGASNNSVDQVRELRGNVKFMPAHSPYKIYIIDEVHMLSGPAFNALLKTLEEPPAHVMFFFATTEPHKIPVTILSRCQRHDLSFVGIDPLVAHLETLCEKENIPIEKKSLELIAHEAGGSVRDSLSLLDQVMSSAQGPVSHEMVLEALGIIDREVIFGLSGAVLAGDMTGALDILDTVYRGGHDIKRFYAEMLGHFRDLLMVKLGVRAERLASLPGWAVEKMQAQTRDVTELFLSQAMALMLAEEDRVRFSSQPKIAVEMVFVKLLHTKPVLPIDTLIQKVDALRKSFAQLAGNGNAPATASKDAAPERNADGAAGVSASRPAQARPAPTENQPRPSSPPPASPLPEETGPVATGTTDPVPLDNAGTWEAILARIDEQYPLLGANLRNSTLAAMEGGRLEIKVYGSQTNKAILAREQSMENLKQVCCDFFKTDINLAVTYTCDTQPAQPDKQKPRTAGPDPLVAEALNIFGGTIVNT

SEQ ID NO: 37487 - protein, 61 aa, Triticum aestivum
  misc_feature (23)..(23): Xaa can be any naturally occurring amino acid
  misc_feature (50)..(50): Xaa can be any naturally occurring amino acid
  misc_feature (55)..(55): Xaa can be any naturally occurring amino acid
SLISLSTHASVLSSFDAWSALCXVTCANVWGVSYAIGMDSRIGPKILNSXVGFGXSCFQKD

SEQ ID NO: 37488 - protein, 398 aa, Oryza sativa Japonica Group
MAAATTSLLLEATPRLLSLPPRRPVQPRGGIFLLKPPPPPPFPSRRGVAVAVAPPLRASHPDTARRVSVSPAAVEPPPKPRALLDAIKRSLLDSLAALKKPALALLLAGALLAAAGPHHGAALAASGGRVGGSAFSSRSSSPPSSYGYTAPAPRGGYSAAPFYSPSPFVSVGPAVGIGFGGSSFFFVLMGFAAFLYLAGFLSDSSGGSVLTETDKTTVLKLQVGLLGMARSFQKELDQIAEKADTSTPAGLSYVLTETTLALLRHPDCCISAYSSVDVKRSIDDGEKRFNQLSIEERGKFDEETLVNVNSIKRQKAGSQRSSGFSNEYIVITILVAAEGVHKLPSINGSGDLKTALQKLGAIPSRKILAVEVLWTPQNENDTLSERELLEDYPLLRPL

SEQ ID NO: 37489 - protein, 271 aa, Populus trichocarpa
MGTLGRAIYTVGFWIRETGQALDRLGGRLQGNYYFQEQLSRHRTLMNIFDKAPVVDKDAFVAPSASVIGDVQVGKGSSIWYGCVLRGDVNSISVGSGTNIQDNSLVHVAKSNLSGKVLPTIIGDNVTVGHSAVVHGCTVEDEAFVGMGATLLDGVVVEKHAMVAAGALVRQNTRIPTGEVWGGNPAKFLRKLTDEEIAFIAQSATNYSNLAQVHAAENAKPFDEIEFEKVLRKKFAKKDEEYDSMLGVVRELPPELILPNNVLPDKEHKAK

SEQ ID NO: 37490 - protein, 317 aa, Arabidopsis thaliana
MAPSSSSGLTFKLHPLVMLNISDHFTRVKTQLNPPAASCATGNGSNNADAMLLQNPRVYGCVIGLQRGRTVEIFNSFELIFDPALDTLDRSFLEKKQELYKKVFPDFYVLGWYSTGSDATESDMHIHKALMDINESPVYVLLNPAINHAQKDLPVTIYESEFHVIDGIPQSIFVHTSYTIETVEAERISVDHVAHLKPSDGGSAATQLAAHLTGIHSAIKMLNSRIRVLYQHIVAMQKGDKPCENSVLRQVSSLLRSLPAAESEKFNENFLMEYNDKLLMSYLAMITNCTSNMNEVVDKFNTAYDKHSRRGGRTAFM

SEQ ID NO: 37491 - protein, 572 aa, Rhizobium leguminosarum bv. viciae 3841
MLQSFHMPIFRGLEGFRADWLRSDIPAGLSIAAVGLPSAIAYPAIAGLPPETGIYASIVAPVAYALFGPSRLLVVGPDAGTMAVLAAVIGTVIAAQPAGTSADPVAIASALALGVGAFYFAARLLRLGVLASFLSRPILVGFFAGVSISILVGQIGRFTGVRIESDGLLPPIAEIIRKSALIHWPTLLFGLAMFALLWIVKATRLPVPGPVVVVVVSVILSAIFNFEAAGIRVVGDLPTGLPSFSLDAFSQMPMDRIVLGSAAVFLISFGSSIVAARSFGARSGEEVDANRELIGLGAANIAPGLFGSFPIAVSDSRTAINLAVGGRSQAAGLVSAVTLMAALLFLNDALRILPIPALAAILAAAAISLIDVSELRKIWHISRMEFVFALIAMFGAISFGVLNGVIVAIAATLIYLLRKTMFPKDTLLGRIAGRDGFYDMQRFPEARGIPGIAICLVQGNLLFYNADYISIRLRAIADGLPAETRWFILDASAIAHIDSTGAAALDAVQANLSGRGIAFGVAHLNAEVTELLARAGVVDGIGAGKFFDDTEDALRAARLGEESDRPLAGGHQ

SEQ ID NO: 37492 - protein, 300 aa, Chlamydomonas reinhardtii
MSARRSSRLFPALLSAVQQGAAAGTQVGVAPVSLQALCAGSQRLRLPGQGMGLLGRTFASQPLATADAKDRFDSTNSLLQQVQVLKLRQELDDESVMNLHIPYTQLLQMIKASGSAHDDKEAEEVALALHRAGVVMRHHDVVYLRPEEIAEVVMQVLPGGKDDASQKLAKIEEELTDLDKIHEQVDKQANNVTTRLLTVGYVVLFVQLISFIYLTWWELSWDVMEPIAYIISLFYSLLGYTYFMATKGGVFDLQPFKEFWQTHYKQKKASAVQFDAERYEYLLKMKERYKRHLAHAALRR

SEQ ID NO: 37493 - protein, 635 aa, Physcomitrella patens subsp. patens
MEERLKIRDLDSGREFLMKRFNSDGSLDLLREVDTGKELTLAEFEKTIGTYSPVAQVLKRREQLTDSHVSVKKPVFKTASKASVILKRTNWLRKLKGFVKSRSVDGLVGGGSERSFADSVDDSDTSLERPQKVKVKLRHKSSKDLGNLHLSQEILAHQGAIWTMKFSPDGRYLASAGQDRVVHVWEVIDHPLVAEDGSVKANNDGSVKAGRCKSFTKWDIKGNSRSGNGTPQKQRSSNYSETQTPNLLWLSEKPTCSFRGHTDDILDLSWSQSQFLLSSSMDKTVRLWHISYDVCLRVFSHNDYVTCAQFNPVDDRYFISGSLDDKVRIWCIPDHHVVDWSDLQEMVTAVCYAPDGKRAVVGSHKGTCRFYNTTGNKLQLDAHKDVRDENKKGAGKKITGIRCMPGDPHKVLVTSNDSCVRIYDGLDLVAKYKGLRNVKSQISSSFSSTGDFIISASEDSRVLVWNSNKKDISNRSSVYRRDKQLACEEFTSRYVSVAISWPGSSTHHNSSLSRNTSQVDVSSKVFGPSPPLDARQSSPSHMQQRCTSFFLESGPKGSATWPEEKLSTFNKQVSSTPTMTQSASIGSSMTAHSGREVHPLADLATVSAAWGLVIVTAGLGGNITTFQNYGFPVRL

SEQ ID NO: 37494 - protein, 257 aa, Chlorobium tepidum TLS
MITIKSEREIELMREAGRLVARVLDMLENEIRPGISTKRLDELAEQFIRDHNAVPSFLNYVPKGESGVTPYPATLCVSINEEVVHGVPSTKRIIHEGEIVSVDCGVYKSGYHGDSARTYIIGEVDPAVRQLVDVTRECLDLGIEQAVEGNRLHDISAAIEKHARSFGYSVIENMVGHGIGSELHEEPAVPNYGRPHTGVKLRSGMTLAIEPMIALGRSRRAVSKRGAWAAVTEDGSYSAHFEHTIAIGKAQAEILTK

SEQ ID NO: 37495 - protein, 619 aa, Oryza sativa Japonica Group
MESLALLHAKPGGLPPRAGLRLPLPRARSARVSLPSSPGGPRIAPVPAPPRFEKRPYLAGRRRGVGIGPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDPCKEMAYIPLDEDMKVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATESSPSNSSPSN

SEQ ID NO: 37496 - protein, 214 aa, Oryza sativa Japonica Group
MAGEADGKAPLGSRYPPAALNERILSSMSQKHVAAHPWHDLEIGPGAPAVFNCVVEIPRGSKVKYELDKATGLIKVDRVLYSSVVYPHNYGFIPRTLCEDGDPMDVLVLMQEQVVPGCFLRARAIGLMPMIDQGEKDDKIIAVCADDPEYRHFRDIKEIPPHRLQEIRRFFEDYKKNENKEVAVNEFLPAEDAINAIKYSMDLYGAYIIESLRK

SEQ ID NO: 37497 - protein, 762 aa, Bordetella parapertussis 12822
MKDTDRQAALDYHAYPHPGKISVTATKPLVTQRDLSLAYSPGVAAACEEIVEDPANVFRYTGRGNLVGVITNGTAVLGLGNIGALASKPVMEGKAVLFKKFAGLDVFDIEINETDPDKLVEIIAGLEATFGGINLEDIKAPECFTVERKLRERMKIPVFHDDQHGTAITVCAAVVNGLAVAGKRIEDVKLVTSGAGAAALACLDLLVDLGLPLEHIWVTDIEGAVYQGRTALMDPDKARYAQPTEARTLAEVIEGADVFLGLSAGNVLKPEMVATMAANPLILALANPNPEILPEAAHAVRDDIIMATGRSDYPNQVNNVLCFPYIFRGALDVGATTITREMEKAAVLAIASLAREEQNEVVAAAYGTYDISFGRDYLIPKPFDPRLIVRIAPAVAKAAMEGGVATRPIADLDAYAEQLQQFVYHSGAFMKPLFSQAKQIVRDGGRARIVFTEGEDERVLRAVQVIVDEKVAKPILVGRPQVLLSRIEKFGLRLRLGQDVEVCNPEYDERFHQYWTTYWELMCRNGITKEMARVEMRRRLTLIGAMMVHLGDADGMICGAVSGFHDHLRFIDQVIGRKPGATTYAAMNILLLDERTVALVDTHVNEDPSAEQIAEYTVAAAEEMQRLGLAPKVALLSRSNFGSGSSASGAKMRHALELVNRQAPGLEIDGEMHGDCALDESLRLRLLPDSPLKGSANLLVCPNVDSGNIAYNLLKTVAGKNVAVGPILLGANAPVHIVTSSATVRRIINMAALCVLDANRPQ

SEQ ID NO: 37498 - protein, 400 aa, Mycoplasma gallisepticum R
MIMKVQLVREEFSWFKNNKGWIYFDNAATSLKPDSVVNAISEYYQKWSLNPHNNNTSLSNKLNDIIYETRKKTAQYLAVSADEIIFNSSATEILNLFAFGLNEYLKKGDEIIVNELEHASNLINWLELSRRNNLKLVLVKSLNEIKDKVNQKTKLVAFSGLSNIFGYKINYLDYAKQIKTINKNCLVFIDATQLAAQEKIVISQNIDGLCFSAHKIFGPTGLGIGYIKKDLQKILNPLKYGGDMYYDFDINQKSISLKTNPLKYEAGTNNVAAIYSWSKTLDFINEIYNQKFQTYKQNLTTYFKEKIKQQKKLILINEQANFPIFLLQIPNIHSQDLAWYLSTKKIITRAGASCVHLLKKYQKDGYVRVSLSIYNTKEEIDYFFKVIEEFDLKDILNELL

SEQ ID NO: 37499 - protein, 175 aa, Gracilaria tenuistipitata var. liui
MKHTLSVLVEDEAGVLSRIAGLFARRGFNIESLAVGPAEKIGISRITMIVNGDNRTIEQLTKQLYKLVNILEVQDITDIPSVERELVLIKIHALSDNRSAILEIAHIFRAKIVDMANEYLILEVTGDPGKMVAIENLLGQYGIIEIARTGRIALIRESNVNTEILRTKLKRYSLS

SEQ ID NO: 37500 - protein, 129 aa, Glycine max
THSAKAPTRKSGTESCVRQTPTRPVSLATHHSKAMMLIYPQGVRVIVHTANLIYVDWNNKSQGLWMQDFPWKDQNSLSKGSGFENDLVEYLSVLKWPEFSVNLPFLGSVSICPSFFRKFDYSDARVFSH

SEQ ID NO: 37501 - protein, 353 aa, Aspergillus oryzae
MAEFNRSEVLGSVFDTTNRYVNVRPVGLGAFSLVCSAYDLVRGQAVAIKKLLNPFATTANAKQTYREIKLLKQLRHENLIGLCDVFISPRTDVYLVTELLSTDLARLLEAGPLEPQFVQYFAYQILRGLKYLHSAGVVHRDIKPSNLVIDENCDLKICDFGLSRPQDHRMTGYVSTRYYRAPEVMLTWQRYGVEVDIWSAGCVIAEMFNGKPLFPGQDPINQFYLILDVLGNPSDKFISRICTTNTVEIIRSLERREPRPLQSVIQNLDDSARSLLERMLTLDPQERISAEEALQHPYMKMYHDPTDEPIAEERFDWMFNGGEFDKEMLKEMIPAYNLASCYHDIFNQNDLLQ

SEQ ID NO: 37502 - protein, 335 aa, Prochlorococcus marinus str. NATL2A
MISNSLKTNEIANYRLSIAPMMDCTDRHFRVLMRQITKKSLLYTEMIVAQALHYSKNRNKLLDFDEIEHPISIQLGGDNPKLLAEAAQMAEDWGYDEINLNIGCPSPKVKSGNFGACLMGKPNIVASCIEKMKKTCNIPITVKHRLGIDNLDSDDYLLKFVDTCSLAGADRFIVHARKAWLNGLNPKENRSIPPLQYERVQNLKNNRPELIIELNGGINTINDSIEALKVFDGAMVGRAAYSHPFLWTKIDSLIFGQKEKYLSRSKIIKKLIPFAQKHLENGGRLWQISRHILNLIENIPNAKILRQELSEKCQTQKADISILKKIAQQLEDAGQ

SEQ ID NO: 37503 - protein, 385 aa, Yersinia pestis biovar Microtus str. 91001
MTDNPLLVLRERISALDLKLLALLAERRELAVDVAKAKQLHHRPIRDKERERDLLDALIDAAKPYNLDGFYVTRLFQLIIEDSVLTQQALLQHQLNQTALLSARIAFLGPKGSYSHLAARQYAARHFEQLIECGCLKFQDIFTQVETGQADYAVLPIENTSSGSINDVYDLLQHTSLSIVGEITNPIEHCVLIATETDLNKIETVYSHPQPFQQCSQFINRFPHWKIEYCESTAAAMEKVAGMKSPTAAALGSEAGGALYNLQVLEHNLANQQQNITRFIVLARKPIDVSEQIPAKTTLIMATGQQSGALVEALLVLREHGIIMTKLESRPINGNPWEEMFYIDVQANIRSEAMQKALADLTPITRSLKVLGCYPSENVVPVEPR

SEQ ID NO: 37504 - protein, 320 aa, Azoarcus sp. BH72
MSASTGAVEAAYEDVGGWGVSQVVAELRAARERWRAAQQRNREFAVREFPSRDALRQIAADLCGVLFPMRLGPPELHQEGEDYYVGHTLDSTLNALFHQVRLELGYLARHRGIEADIDADAARIVKRFAGGLPALRTLLDSDVEAAYTGDPAARSVDEVLLCYPGTLAIIHHRLAHSLHALGARLVARIIAEIAHSATGIDIHPGAQIGSGFFIDHGTGVVIGETTVIGNRVRLYQAVTLGARRFAVDENGALEKGAARHPVLEDDVVVYAGATILGRVTIGRGSSIGGNVWLTRSVPPGSHVSQASLQHESAAQRVAAS

SEQ ID NO: 37505 - protein, 489 aa, Oryza sativa Japonica Group
MKLERYASGAGAMLLLRRAASGKVVSASSHLLFRATVLATMALVFLFTFHYPSLLSRSFTLSSGAGAGEGGAAAHASHRSLLMSSSSASASAASVYGGAAWEKEVRRSAKPRKDGGIAVLVTGAAGFVGTHCSLALRARGDGVLGLDNFNAYYDPELKRARQRLLAGRGVLVLDADINDALLLEKLFDLVPFTHVLHLAAQAGVRYAMEAPQTYVASNVAGLVTVLEVAAKHADPQPAIVWASSSSVYGLNTDAPFSEEHRTDRPASLYAATKKAGEAIAHTYNHIYGLSITGLRFFTVYGPWGRPDMAYFFFAKSIVSGEPITLFRAADGADARRDFTYIDDVVKGCLGALDTSGKSTGSSKSGKKSGPAPLRVYNLGNTSPVPVTRMVAILEKLLGKKANKRIVAMPSNGDVPFTHANVTHAAHDFGYRPTTSLDAGLRHFVDWFADYYKLKLDVPKIAAKVAGAGKPSSSSASKKKKKAAAMSASS

SEQ ID NO: 37506 - protein, 155 aa, Prochlorococcus marinus str. NATL2A
MFGLLNTLFGFTIKPKSAFASSKSMENYKTLTDTDWENRLPKDAFYVLRKEGTERPFSSPLNDEKRKGVFRCAGCGLALFSSTTKFDSGTGWPSFFDHLPDAIETKTDFKLIVPRTEYHCRRCGGHQGHVFNDGPRPTGKRYCNNGVALAFEVDS

SEQ ID NO: 37507 - protein, 153 aa, Catharanthus roseus
MANSNLPKRIIKETQRLLSEPAPGISASPSEDNMRDFNVMILGPAQSPYEGGVFKLELFLPEEYPMAPPKVRFLTKIYHPNIDKLGRICLDILKDKWSPALQIRTVLLSIQALLSAPNPDDPLSENIAKHWKSNEAEAVETAKEWTRLYATGA

SEQ ID NO: 37508 - protein, 313 aa, Oryza sativa Japonica Group
MAANFWTSSHCEGSKQLLDQEDVDKVPQADSDRGITLEEFRLVKIHMSFLLQIKANHLMISDIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQCFDFRLLQDAGITDLTQFACCTCADLVAATLPQKANLKTQKTEQQTSTSKSKHLIQGYVNNYGEKVRLEDAAAAARSSFGTSNEPAFDEIRSSLECQKIWPQIVVEGSSNLFQHTGQLKTGSFALGGSLLVFTALFQNRKCNQC

SEQ ID NO: 37509 - protein, 345 aa, Schizosaccharomyces pombe 972h-
MDNHMLNRISKSPILPVVSYCMASILMTLTNKYVLSSPGYNMNFLLLTVQSTVCVAAIGILKRLKVINYRDFDFREAKFWFPISFLLVAMIYTASKALQFLSVPVYTIFKNLTIIIIAYGEVLWFGGHVTALTLFSFGLMVLSSIVAAWADIQSSSFASQTLNSGYLWMVLNCLTNAAFVLAMRKRIKLTNFRDFDTMFYNNLLSIPVLVICTLFTEDWSAENIAQNFPPDAKFGVLMAMAISGVSSVGISYTSAWCVRVTSSTTYSMVGALNKLPLAIAGLVFFDAPITFGSVTAILLGFISGVVYAVAKSQQQRQKDPATILPMTHNPVSASSQSMRDSLSKS

SEQ ID NO: 37510 - protein, 397 aa, Dehalococcoides ethenogenes 195
MENLTIRDLDFSGKKALVRVDFNVPINAETGSINDDSRIRAAIPTIDYLLDHQAKVILCSHLGRPDGKVVESMRLAPVAKRLSEILRQEVLTASDCIGDEVTAKVNALEDGQVLLLENLRFHPEEEANDPAFARKLADLADIYVDDAFGTAHRKHASIVGVAKYLPAVAGLLLEKELNALGKVLEHPPRPFMILLGGAKVSDKVGMLENVMDKVDTILIGGGMAATFLKAQGLEIGDSLIDDSLDTAKMLMDKAKSKNVKIVLPDDVLITFDKIGPDAKAENVSVENIPPTAKIVDIGLLTITLFTKQLEKCKTVFWNGPMGIYEIPQFSEGTRAMVNTMTRLHGTTIIGGGSTAEIVTELNIASKMSFVSTGGGASLKFLSGEKLPGVEVLAKKHE

SEQ ID NO: 37511 - protein, 190 aa, Prochlorococcus marinus str. AS9601
MSKGFKSQEIKTIQNIGQNDFGESKVQEAFEKQLTLKELKQINWHFIGRIQSNKIRKIVQNFKYIHSVDSFEKLQKISNISREEKKKPFIMLQVKLSDDPTKGGFNPESLILKWTEIQELKNISLTGLMTINPKGLSPKENLGLFKKCRALADYLQLPDCSMGMSGDWEEAIDAGSTWLRLGALIFGGRS

SEQ ID NO: 37512 - protein, 506 aa, Polaromonas sp. JS666
MLYSAPGTTGANIAYKARYDNFIGGEFVAPVEGEYFDVITPITGKPYTKAARSGAKDVERALDAAHAAADKWGRTSPTERSNILLKIADRLEANLELLAYAETVDNGKPIRETLNADIPLTIDHFRYFAGCVRAQEGGLSDIDGDTVAYHFHEPLGVVGQIIPWNFPILMAAWKLAPALGAGNCVVLKPAESTPISILIMAELIADLLPPGVLNIVNGFGREAGMPLANSKRIAKIAFTGSTATGRQIAQAAASNLIPATLELGGKSPNIFFADVMDKDDGFLDKAIEGMVLFAFNQGEVCTCPSRALIHESIYDRFMERVLKRVAAITQGNPLDTDTMMGAQASKEQMSKIMSYMDVGKQEGAQLLMGGKQARLGGDLESGYYVQPTLFKGHNKMRIFQEEIFGPVLAVTTFKDEADALAIANDTLYGLGAGVWSRDGNVAYRMGRAIKAGRVWTNCYHAYPAHASFGGYKESGIGRETHKVMLDHYQQTKNLLVSYSESKLGFF

SEQ ID NO: 37513 - protein, 460 aa, Arabidopsis thaliana
MQKRELGKSGGNSGGSSGPPAKRGRPFGSTSANSAAAAAAAAAADAMSPSALLGPSLLVHNSFVEQNNRRIVLALQSGLKSEVTWALNTLTLLSFKEKEDIRRDVMPLAKIAGLLDALLLIIDDWRDIALPKDLTRGTRVRTLGTNASVTGFGNEYDALASIQPPGSGIGSSAAEALGKKSTGKHQSSQWWMEEDGLFNLDDEGRSEKQMCAIAASNVIRNFSFMPDNEVVMAQHRHCLETVFQCIHDHMTEDEELVTNSLETIVNLAHLMDLRIFSSLKQSYININEKKAVQAVVGILDSSVKAWNCAAAELLGRLIINPDNEPFISPLIPQIHKRLVDLLSIQAVDAQAAAVGALYNLVEVNMDCRLKLASERWAVDRLLKVIKTPHPVPEVCRKAAMILENLVSEPQNRGLLLAYENAFAELLFQEGKYSDSFARILYELTARSNSRVASARGIWGM

SEQ ID NO: 37514 - protein, 270 aa, Prochlorococcus marinus str. AS9601
MTDKIAIIGFGNIASAIVTPLLDNKLIQPENVFCVVNSEKSLENIKKNYKYKINVYKSGSKESKIIWDCQYKLLSIKPQQLKDISEAHQIKNKGNLIVSILAGVSINKLTQKFPNHKCVRVVTNIPITIGKGLTGISWGEEITEDQKQFTKKLFENTSKIYEFTEDYLDIFLALTSSGPAIIALIIEALSDGGLSGGLPKIISEELVMEMILGTICLIKENKLTTSELKNLVTSPGGTTISALRVLEKKSVRSALIESIVSASNRSKEFR

SEQ ID NO: 37515 - protein, 315 aa, Ochromonas danica
NGFGRIGRLVLRAARNKPDVQVVAINDPFIPVDYMKYMFYYDSVHGRYPQAPVVVENGKLIVDGKVISVSHELDPVNIKWGDSGADYIVGITGKKFLTEEGAAKHFVGGAKKIVMSGPSKNKTPMFVVGVNHKEYKKELLVVSNASCTTNCLAPLAKAINDNFGIKEGLMTTIHATTASQPTVDGHSLKDWRGGRGAVGINIIPSSTGAAKAVGKVIPALHGKLTGMAFRVPTANVSVVDLTVTLEKGAKYADIKEAVKAASNGELKGILGYTEDSVVSFHFVSDTRSSTFDANAGIALTDNFVKLVSWYDNEWG

SEQ ID NO: 37516 - protein, 344 aa, Nostoc punctiforme PCC 73102
MKVGINGFGRIGRLVLRAGLDNPNIEFVGINDLVPPDNLAYLLKYDSTHGQLKHKVEAKEDGILIDGHFIPCVSMRNPAELPWGKLGADYVVEATGLFTDYEGAANHLKAGAKRVVISAPTKDPDRVTTLLMGVNHHLFDPGKDIIVSNASCTTNCLAPIAKVINDNFGLTEGLMTTVHAMTATQPTVDGPSKKDWRGGRGASQNIIPSSTGAAKAVALVLPELKGRLTGMALRVPTPDVSVVDLTFKTAKATSYKEICAAMKEAAAGSLAGILGYTDEEVVSTDFQGDTHSSIFDAGAGIELNSNFFKVIAWYDNEWGYSNRVIDLMLSISQKEKLASTVAVV

SEQ ID NO: 37517 - protein, 512 aa, Populus trichocarpa
MANIDIEGLLKEHQDDEEGRVPRTKIVCTLGPSSRSVPMLEKLLRAGMNVARFNFSHGTHEYHQETLNNLRIAMQNTNILAAVMLDTKGPEIRTGFLKDGNPIQLKEGQEITITTDYSIKGDTDMISMSYKKLPVDIKPRNTILCADGTITLTVLSCDPKAGTVRCRCENTAMLGERKNVNLPGVVVDLPTLTDKDKEDILGWGVPNNIDMIALSFVRKGSDLVNVRKVLGPHAKHIQLMSKVENQEGVVNFDEILRETDSFMVARGDLGMEIPVEKIFLAQKMMIYKCNIVGKPVVTATQMLESMIKSPRPTRAEATDVANAVLDGTDCVMLSGESAAGAYPELAVKTMRRICIEAESSLDYAAIFKEMIRSTPLPMSPLESLASSAVRTANKARAKLIVVLTRGGTTAKLVAKYRPAVPILSVVVPVLTTDSFDWTCSDETPARHSLIYRGLIPLLAEGSAKATDAESTEVILEAALKSATKRGLCKPGDAVVALHRIGAASVIKICLVK

SEQ ID NO: 37518 - protein, 206 aa, Fusobacterium nucleatum subsp. vincentii ATCC 49256
MEIYFVRHGQTIWNVEKRFQGLSDSPLTELGITQAKLLGEKLKDIKFDKFYSTSLKRANDTANYIKGNRKQEVEIFDDFVEISMGDMEGIQQEEFKKLYPEQVKNFFFNQLEYNPSSFKGESFLEVRERVAKGLDKFIKLNKNYERVLVVSHGATLKTLLHYISGKDISTLSDEAIPKNTSYTIVKYQNGKFEIIDFSNTSHLEEK

SEQ ID NO: 37519 - protein, 385 aa, Vitis vinifera
  misc_feature (140)..(140): Xaa can be any naturally occurring amino acid
MSVTLESISLSSPNPNPSPTTGSPLRITPYHPSSQSSSSLRFASLLGPRPRSRPHGVSAVARTLSPIGLGHGLVPLTRRTSCNRLVLASAASREDSSKIEVEKENTNVGAGAEASEEEWQKTLASLKEQALKMQSVSQEXYEIYSERAKVILIETSKQLKAQADKASQDLNELAKVIGEDGKEYLSLAAENSPVPLKDVVETFTSPSDDLDKISKVRDFYLGIPYGVALSVGGLLSFMLTGSIPAVRFGVILGGALLALSISSLRAWKKGESLALALKGQTGRPCCGGTGCPRLLLISYYGTSGSLSVSTFVCCQHLDVKVVVNNVIMQSFGIHQDSINFGCRCEAKIPFAMEENEEERNECDSLVFTIQFFHEKLKAMDNLVEV

SEQ ID NO: 37520 - protein, 610 aa, Azoarcus sp. BH72
MTIPTPTSKGAEGLSGAPLPDLPDEATLGALASAFFRALPGAALPPADPVRAQVASAPELSLAQGGSRLAPAPVASDPVDPVGGAGAFVVPQAYAAALPQVAPPQVPAGVAEGLPLAVPGSPYYFIGEASPYLQSGAAPALPENRVVARSFGLPGEGELKALLAEIAAGRPLADAPAADPGGRFYFIDAAKVPAAEPGARAPFDVNAVRRDFPILQERVNGKPLVWFDNAATTHKPQAVIDRLAHFYAHENSNIHRGAHELAARATDAYEAARQKVQRFLGAGSADEIIFVRGATEAINLVAKTWGVQNIGEGDEIVVSLLEHHANIVPWQQLAAQVGAKIRVIPVDDNGQLKLDELQKLLNPRTRLVSVTQVSNALGTVTPIKQVIDMAHAAGARVLVDGAQSVSHMRVNVQALDADFFVFSGHKIFGPTGIGVVYGKAALLEQMPPWQGGGNMIADVTFERTLFQPAPNKFEAGTGNIADAVGLGAALDYVERIGLENIARYEHDLLVYATRGLSSIAGVRLIGTAADKASVASFVLAGYSTEEVGRALNEEGIAVRSGHHCAQPILRRFGVETTVRPSLAFYNTCEEIDRMLAVVRRLARGKGRVGA

SEQ ID NO: 37521 - protein, 251 aa, Dehalococcoides ethenogenes 195
MRQIIIAGNWKMNTTLSEACTLVQGMKYELDQISGIQKIVCPPFISLAPVKTILDGSSIHLGAQNLFYEEKGAYTGEISPLMLQDICPYVIIGHSERRAYFGETGQVVNRKIKAALQAGIMPIVCVGEKLEENENGQTRQILETQMKEALAGINPSSIIIAYEPIWAIGTGKAATAAEANNTISYIRKVLGDIWGNTASRITPILYGGSVNEKNTAELLCQSDIDGALVGGASLKAESFVSICRQAADVRK

SEQ ID NO: 37522 - protein, 289 aa, Oryza sativa Japonica Group
MASSISVMASAGRNRGVGFAKLQGEDFEYFMQTYSIILGRDSKREKHGPSASAAFQPANNGTAADEHNLTASAAAQPAHIGTAAPPPHIGTAQPGQIGIVTLPPAHIQNNAENENIAGIETQEEFMNQNKMPFGELDTCSSHHITIEPTLAPGGQPVNNLAIRPADNNKDQQEVLLKEEEYVLASIGIVISDLCGLKKMIPIEKLHSELVACYSATWPQRQVQMHLAPEAGSSAAGTECKPWLKLMYLLRKYPERFTVMNSSCDEEGRQHRCVCTLYGDGTVCVFLKRT

SEQ ID NO: 37523 - protein, 388 aa, Dehalococcoides ethenogenes 195
MKLSKRIENLPPYLFVQISKKIAEKRAKGEEVISFAIGDPDLPTPKHILAELCKAAEDPANHRYPETEGLPVLRKAMAEWYEKRFGVKLNPDTEVLPLIGSKEGIGHAAWCFLDPGDVALVPDPAYPVYAISSQLAGAEVFYMPLNKENNFLPDFNAIPQDVLSKAKILWINYPNNPTGAVAGLDFFKEAAEFAAKHNLAVCHDGPYSEIAFDGYRPVSFLEADGAKEVGIEFHSLSKSYNMTGWRIGMAVGNAKMIDALRRFKSNLDSGIPQAIQLMAIAALNGSQDVISQNCAVYQRRRDRLVEALRNIGMEVTAPKASLYIWAPVPEGYTSASFATELLDKTGVVVTPGTGYGTSGEGYIRLSLTVPDEQLEKGIAKLANFKSQA

SEQ ID NO: 37524 - protein, 306 aa, Pseudomonas syringae pv. phaseolicola 1448A
MQAKIVIVGSLNMDLVIRAQRLPRPGETLSGETFDTVPGGKGANQAVAAARLGGSVAMIGCVGADAYGEQLRAALLAEHIDCQAVTVVEGVSTGIASIVVDASSQNAIVIVAGGNGRLTPALIERFDALLAGSGIVICQLEVPTETVFHTLTRARALGKTVILNPAPASEPLPANWYGLIDYLIPNESEAQTLTGVTVDSSAAAEEAAAAMLAAGARNVIITLGERGTLFASAAGVEHIPARRVQAVDTTAAGDTFVGGFAAALAAGQSESQAIRFGQAAAAISVTRAGAQPSIPTFEEVKEFDSL

SEQ ID NO: 37525 - protein, 170 aa, Vibrio aerogenes
SRDASERDVKKAYKRLAMKYHPDRNPDDDSAAEKFKEVKEAYEVLTDPQKKAAYDQYGHAAFEQGGGGGGFGGGSADFGDIFGDVFGDIFGGGRRGGGQARAQRGADLRYNMELTLEEAVRGCSREIEVPTLVHCDSCNGTGARKGTSAETCSTCHGHGQVQMRQGFFAV

SEQ ID NO: 37526 - protein, 340 aa, Prochlorococcus marinus str. NATL2A
MTLRVAINGFGRIGRNFMRCWLSRGANTNIEVVGINVTSDPKTCAHLLKYDSILGAIKDAEISHTDDTFQINGKTIKCYSDRNPLNLPWKEWGIDLVIESTGVFNTDVGASKHLQVGAKKVILTAPGKGDGVGTYVVGVNADSYSHEDFDILSNASCTTNCLAPIVKVLDQKLGINKGLMTTIHSYTGDQRILDNAHRDLRRARAAAMNLVPTSTGAAKAVALVYPQMKGKLTGIAMRVPTPNVSAVDLVFESGRKTSAEEVNSLLKTASQGEMKGIIKYGDLPLVSTDYAGTNESTIVDEALTMCIDDNMVKVLAWYDNEWGYSQRVVDLAEIVAQKWK

SEQ ID NO: 37527 - protein, 706 aa, Azoarcus sp. BH72
MNVPTPLPSGPHDRVHIVGAAFALGAPHGGSADGPEALRHAMLPERLRTTGITGTWLEPLRPLRTPPPDAPMEERLAAVGEYCARLAEQIAGLPEDGFPLVLGGDHAVAIGTWRGVARRQGGAPGLIWIDAHLDSHTDQSTWSGNIHGMPLAALLGEGAPALTAIPGPRLDPARVCIIGARDWEPAERERLDRLGVRVFDIAEVRERGLPTVFCEALTIARSGHGRDGGFGVTLDLDALDPLAVPAVTCPTPDGIDPQQLVDVFHTLRSCGDFVGLEIVEYRPDLDPDGHSAALTARLVAAALGPATYWLREKERRFGATNYAPMPVVFHRGEGVWLWDVEGTRYLDMMSAYSAVSFGHANPRLLRALQDQAQLLTLTSRSFSNDRLPLLLERLCSLLGFERALPVNTGLEAVETALKAARKWAYIVKGVPPDRAEIIACEGNFHGRSITIVGLSSKEQYRDGFGPFPPGLRRVPFGDPTALEAAITPHTAAFLVEPIQGEGGIIVPPPGYLAHCAEICRRHNVLLIADEVQTGLGRTGRLLACDHDGVRPDGLILGKALGGGLLPVSAFLADREVMDVFRPGDHGSTFGGNPLGAAVALEVLDLLAETRPWEAAERLGRRLRAELEAAELPCVREVRGRGLLIGVALDPVKAPAQLVAELLLARGIATRDTNGNVIRLAPPLTIDEGTLDRAAAIIIDTLNPLGR

SEQ ID NO: 37528 - protein, 65 aa, Brassica napus
MISWHDLYTVLTAVIPLYVAMILAYGSVRWWKIFSPDQCSGINRFVAIFAVPLLSFHFISTNNPY

SEQ ID NO: 37529 - protein, 305 aa, Kluyveromyces lactis NRRL Y-1140
MAKDIEISNAESKFILEALKLKQRLDGRSYDQFRDVKIEIGEAYGDVTVTMGNTKVHCRISCEIAQPYEDRPFEGLFHISTETTPMAGAQFENGNNTGEEEVLISRMIEKAVRRSGALDVEGLCIIAGSKCWSLRADVHFLDCDGGLIDASCIAVMAGLLHFKKPDVTVLGERVTVHPIDEREPVSLGVLHVPICVTFSFFNPDDTEENIKGEDNAEISIIDASLKEELLRDGVLTVTLNKNREVVQISKAGGLPMEALSLIDCCHKAYGIVEKITDQIHRVVKQDTIARNQYAHILSSENARET

SEQ ID NO: 37530 - protein, 354 aa, Oryza sativa Japonica Group
MAAAAAAKIAPSMLSSDFANLAAEADRMVRLGADWLHMDIMVTHFVPNLTIGAPVIQSLRKHTKAYLDCHLMVTNPSDYVEPLAKAGASGFTFHIEVSRDNWQELIQSIKAKGMRPGVSLRPGTPVEEVFPLVIAQYNFSRSHALFPHAVHNYDINAFLNISNKCSNWEHFVPNLTIGAPVIQSLRKHTKAYLDCHLMVTNPSDYVEPLAKAGASGFTFHIEVSRDNWQELIQSIKAKGMRPGVSLRPGTPVEEVFPLVEAENPVELVLVMTVEPGFGGQKFMPEMMEKVRALRKKYPSLDIEVDGGLGPSTIDVAASAGANCIVAGSSIFGAAEPGEVISALRKSVEGSQNKS

SEQ ID NO: 37531 - protein, 515 aa, Candidatus Protochlamydia amoebophila UWE25
MTQDSIIEQDLAFEQFGLKAPILQALQEAGFKIASPIQKQAIPVVLAGHDVVAQAHTGTGKTAAFGLPALHLIHDNPGSQLLVLTPTRELASQVSDELFRLGRHLGIRTATICGGKSFRPQIEALQRGVQVIVATPGRLQDLLESDSLPDFRPAIVVLDEADEMLDMGFLEAIQRIFTFLPAKRQTLLFSATMPSAIQKLAHQILKKPIFISVTQKETTNKDIKQVYYVIREDERDDAILRLLDSEEPAKSIIFCRTKKDVDRLSTTLVANGYHARGLHGDMEQPQREEVIRHFRSEQIRVLVATDVAARGLSVSDVSHVFNYHLPFDPASYVHRIGRTGRAGNKGVASTFVTLREWREFQRYEKVTGAPINREIIPTLEDVKKLKRQKLVSRIQNQPLHQETELVLELMKEVDHSTLVSKFISFVLEQETIQGPDRIGVEPRGQERDTRGQRTDKFNDERRRANRPQQKFGKANGFKKEHDKGFKKTFGQKNRASHPSKVPSSAAGFKERTRSI

SEQ ID NO: 37532 - protein, 455 aa, Prochlorococcus marinus str. AS9601
MSHEIFMPALSSTMTEGKIVEWLKNPGDKVARGESVLVVESDKADMDVESFQDGYLAAVLMPAGSTAPVGETIGLIVENEDEIASVQEQNKGNQPEVSSSDQLELVSNKTEEKPLVQTEIVEKQEKEVVLMSEKAAPSSNSDQINAATSNVSSRVIASPRAKKLASQMGVDLAKVHGSGPHGRIQADDILKANGQPVSIPWIGEGGSPASIPGVNLGVESKPEASGNSFGNPGETVQFNTLQKAVNKNMESSLDVPCFRVGYSINTDKLDNFYKKVKQNGVTMTALLVKAVAKTLKKHPQVNSSFSENGISYPENINIAVAVAMEDGGLITPVLKEPCNTDLFELSREWKDLVKRSRSKQLEPDEYSTGTFTLSNLGMFGVDRFDAILPPGTGAILAIASSKPTVVANSDGSISVKKIMQVNLTADHRVIYGADGASFLKDLASLIQDEPETLVS

SEQ ID NO: 37533 - protein, 328 aa, Prochlorococcus marinus str. AS9601
MAKIYEDNSFAIGNTPLVKLKSVTKNAKATVLAKIEGRNPAYSVKCRIGANMIWDAEKSGKLTKDKTIVEPTSGNTGIALAFTASARGYKLILTMPESMSIERRRVMAVLGAEIVLTEASKGMPGAIAKAKEIAESNPSQYFMPGQFDNPANPEIHFKTTGPEIWDDCDGEIDVLVAGVGTGGTITGVSRYIKQEKGKNITSVAVEPSHSPVITQTMNGEEVKSGPHKIQGIGAGFIPKNLDLSIVDKVEQVTNEESIEMALRLAKEEGLLVGISCGAAAAAAVRLAEQDEYAGKTIVVVLPDLAERYLSSIMFTEVPSGIIQEPVKA

SEQ ID NO: 37534 - protein, 73 aa, Zea mays
  misc_feature (54)..(54): Xaa can be any naturally occurring amino acid
LGDKFAPATIGALFVCYELLSFSGGAIWNLSSFDQWGVELGKSLAPKIQPELFXFSEPLTHDASPSGLINAFF

SEQ ID NO: 37535 - protein, 1143 aa, Candidatus Protochlamydia amoebophila UWE25
MTPSTTQLPNHLTSSQEFELEFQDGTSITIPHSQLALLREKSPYLKSLWSENFLKNLWSKESEEFFQGPLTQKNFTNLLNCLLDANFKVPVEEILSSIHLAYYFQMTEVVKNLEEQLINGYKSQELELLSCIEDNLDELISILNFAHQRQLNILKNYLECAAVSVLLNQISELTEFEEFLNLFSNEIEGGIESLDFSNNAYLTDAHLLALKDCKNLKVLRLHECRNFTDAGLAHLSRLVALQHLDLGGCYKITDSGLTYLSRLVALQHLNLNCCVCLTDDGLAYLSHLVALQHLDLGECYKITDSGLAHLSSLLALQHLNLGCCNNLTDSGLAHLSHLTSLKHLDLRDCAKLTDSGLAHLSLLVNLQYLNLNRCYNLTDRGLSHLSHLVALQYLDLGLCKKLTSSGLAHLSPLVALQYLDLDRCGEITDRGLAHLSRLVALQHLNLNCCACLTDDGLAYLSPLVALRHLNLRCCGNLTSAGLAHLTPLIALQYLNLSYCDSLNDNGLTHLTRLASLKHLDLSECPYFTDSGLAHFTALATSLTHFYCWSQVGSEHLEDESNIPVNPLAGLEEVAPSTTQLPNHLTSSQEFELIFQDETSLTIPHSQLILLMEKSPYFKSLWSGGFPESLQNPLALTQKNFTNLLNCLLDANFKVPLEEILSSIHLAYYFQMTEVVKNLEEQLINGYKSQELELLSCIEDNLDELIFVLNFARKRQLNILKNYLECAAVSVLLNQISELTEFEEFLNLFSNEIEGGIESLDFSNNAYLTDAHLLALKDCKNLKVLRLHECRNFTDAGLAHLSPLVALQHLDLGGCYKITDSGLAHLSRLVALQHLDLGGCYEITDSGLTYLSRLVALQHLNLNRCVCLTDDGLAYLSHLVALQYLDLDRCWKITDRGLAHLSSLLALQHLNLGCCNNLTDSGLAHLSHLTSLKHLDLRDCAKLTDSGLAHLSLLVNLQYLNLNRCNNLTDRGLAHLSHLVALQHLDLGECYKITDSGLAHLSLLVNLQYLNLNRCDNLTDRGLAHLSRLVTLQHLNLNCCVCLTDDGLAYLSPLVALRHLNLRSCDNLTSAGLAHLTPLIALQYLNLSYCDSLNDNGLTHLTRLASLKHLDLSECPYFTISGLAHFKALAASLNLKIIRQKDFQ

SEQ ID NO: 37536 - protein, 166 aa, Vitis vinifera
MVNYMLMITGELENLTNLQPQGGCDDPDFTYYFKVKCGNCGEVSQKETCVTLNETVPLPKSKGTTHLVQKCKFCDREGTILMIPGRGRPLTQEMSESGKFTPLMLLDSRGFEPVEFSFGTGWKAESMEGTKFDDIDLSGGEFAEYDEKGECPVMISNLRATFDVTK

SEQ ID NO: 37537 - protein, 169 aa, Vitis vinifera
MVRTVFVTVGTTCFDALVKAVDTHEFKRELFARGYTHLLIQMGRGSYIPTKSTGEDGSLVVDFFTFSSSIADNLRSASLVISHAGSGSIFETLRLRKPLIVVVNEDLMDNHQSELAEELAERKHLFCARPQTLYQTIATMNLESLLPYHPGDAAPVAKLINRFLGFPDD

SEQ ID NO: 37538 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPRYYDGRYWTMWKLPLFGCTDSAQVLKEVEECKKEYPNAFIRIIGFDNTRQVQCISFIAYKPPSFTG

SEQ ID NO: 37539 - protein, 176 aa, Erwinia carotovora subsp. atroseptica SCRI1043
MSLNDVPAGKDLPEDIYVVIEIPANADPIKYEIDKDTGALFVDRFMSTAMFYPCNYGYINHTLSLDGDPVDVLVPTPYPLQPGSVIRCRPVGVLKMSDEAGEDAKLVAVPHSKLTKEYDHIKDVNDLSELLRAQISHFFEHYKDLEKGKWVKVEGWDNAEAAKAEIIASFERAKNK

SEQ ID NO: 37540 - protein, 349 aa, Oceanobacillus iheyensis HTE831
MEALNLYGIEDLRYEDTPKPMIEKDDDVIIKVKSVGICGSDTSRYKKLGPYVEGMTFGHEFAGEVIEVGKSVTNFKSGDRVVACPTFSCGNCHYCREGHPTRCVELTVIGARNPGAYAEYTKLPEGHVKILPDSIDDDTAALVEPSAVVAHGFYRASITPGSSVAIMGVGSIGLLAVQWAKIFGASKVIAIDIDDHKLKIAQELGADIVVNPMKENAEGIVKQHTDELGVDLAVESAGSPITSEQVLALPKKGGEVVFLGIPYGDITLKRYYFEKIVRNELRILGSWNALSAPFPGKEWNATLHYMSTGQLNIKPMISHRLGLQAGPEIFHQITNKLSDAVKVIFHPGK

SEQ ID NO: 37541 - protein, 521 aa, Hebeloma cylindrosporum
MSPPKSSRGAPKFKWSHLWEPAIVNPVNLKSYTIPIFNLGDPYARAFHLSWLGFFVAFLSWFAFPPLIPDAIKSDLHLSAAQVANSNIIALCATFVVRVGVGPLVDQYGPRKVMAYLLILGAIPSGLAGTARSAEGLYVLRFFIGILGATFVPCQAWTSAFFDKNCVGTANALVGGWGNMGGGATFAIMTSLFQSLTQTYGLSTHVAWRAAFAIVPAPILLFVAVLTFIFGQDHPAGKWSERHTLPVAALAVQQGHQIPNIQPEKSLKSSSESSKDEKDPEGNAAVTVRPAIADEDLALVKSTVDVAINEPLTLKTTVKILTNPLTWLPALAYLTTFGVELAIDSKFADVLFVLFSKRRPGFDQTTAGYYTSILGLLNLVTRPAGGYFGDLVYRHYGTNGKKAWTLLCGLIMGAALVAGGFYMQNNRTSGDEQLSVLMGVFSVAAIFSEFGNGANFALVPHCNAYNNGVMSGLVGSFGNLGGIIFALVFRFQTEVGKAFWIMGVISIGINALLIPVSVPAL

SEQ ID NO: 37542 - protein, 429 aa, Crocosphaera watsonii WH 8501
MKKVLAIILGGGAGTRLYPLTKLRAKPAVPLAGKYRLIDIPISNCINAEILKIYVLTQFNSASLNRHLTRTYNFTGFSDGFVEVLAAQQTAENPSWFQGTADAVRQYLWLFDEWDVDQYLILSGDHLYRMDYSDFVRRHQETGADITLSVVPIDERRASSFGLMKIDDSGRVVDFSEKPKGDALKQMQVDTSILGLNPEQAKESPYIASMGIYVFNKKALTDLLRNNPEQTDFGKEIIPGSAKDYNLQAYLFKGYWEDIGTIEAFYEANLALNRQPLPRFSFYNEKAPIYTRARNLPPTKVLNCNITESMISEGCMIKDCRINNSVLGIRSRIESDCVVEDSLLMGADFYESLDTRQSLLDQGKIPVGIGKGSTIRRAIVDKNARIGTNVNIVNKENIEESNREDDGFYIRNGIVVVIKNAVIPDGTVI

SEQ ID NO: 37543 - protein, 344 aa, Oceanobacillus iheyensis HTE831
MKALVKTELGHGNLHIQNVEEPSVSSHQVKIKVAYAGICGSDIHTYEGHYKVAAPVTLGHEFSGRIVEVGEGVTDFKVGDRVTSETTFSICGECRYCQTGDYNLCNHRKGLGTQQNGGFTNYLIAREESLHHLPDEVDDRSASMTEPLACTYHAIQKINIKPGDLVVVLGPGPIGLLAAQVAKSYGATVMMSGLDNDKIRLDKAKEVGIDYVINIQEEDIKEKIAALTDGYGVDVVLECSGSIHAANQGLDLLRKKGSYAQVGIFPDSHVKFDMEKVIQKEIHVVGSRSQKSADWEPSLQLMKEKKVDAKALVTHEFTIDQWDEAYQAIKDGEAIKVLLKPLQD

SEQ ID NO: 37544 - protein, 187 aa, Fusobacterium nucleatum subsp. vincentii ATCC 49256
MEKLKRFDKAEEYHQDYLKKNPNGYCHINLNKANEAIIDEKKYQKPSDEVLKEKLSDLEYQVTQEAATERAFTHEYYKNQEDGIYVDITTGEPLFSSKDKYDAGCGWPSFTKPIATEVVNYKKDSSHGMNRVEVRSRAGEAHLGHVFEDGPRDKGGLRYCINGASLRFIPYDKMDEEGYGEFKKYVK

SEQ ID NO: 37545 - protein, 349 aa, Vitis vinifera
MTSEEGENFSMPSEGSTPITGSTSTTDGTLVSKRRKLTSVVWNDFDKIIEDGQDYAICKHCKGKLKVDTKNGTKHLHVHIDRCMKRRNVDWQQLLAVERKGHGKVQIGGFTFDKEISREKLARAIILHEYPLSIIDHVGFREFATSLQPLFKMVSRNTIKGDIMKIYEFSIASFRTRNVLFSMVYYLFVGIVVSRKDEVGASNSFCINPVDLNSFFEEDGKIYGYQGHTLPKASSSSPQDYLCNKCKRPGHFARDCPNVTVCNNCGLPGHIAAECNSTTICWNCKESGHLASQCPNDLVCHMCGKMGHLARDCSCPSLPTHDARLCNNCYKPGHIATDCTNEKACNIFR

SEQ ID NO: 37546 - protein, 629 aa, Zea mays
MATWRLRRAGAALAASSTLAAVLAASSASATDPSAAALEAARQRVARSGATPPLRDAQRAALAGSTPAEPLDVLVVGGGATGCGVALDAATRGLRVGLVEREDFSSGTSSRSTKLIHGGVRYLEKAVFNLDYGQLKLVFHALKERKQVIENAPHLCHALPCMTPCFNWFEVVYYWFGLKLYDLVAGRRLLHLSRYYSVDESVELFPTLAKNGHNCSLKGTVVYYDGQMNDSRLNVGLACTAAVVGAAVLNYAEVVSLIKDESGERIIGARVRDTLSGKEFETFAKVVVNAAGPFCDSVRKMADSTVAPMICPSSGVHIVLPDYYSPEGMGLIVPKTKDGRVVFMLPWLGRTVAGTTDSNTAITMLPEPHEDEIQFILDAISDYLNVQVRRSDVLSAWSGIRPLAMDPSAKNTESISRDHVVFEDYPGLITITGGKWTTYRSMAEDAVNAAVMSGNLKPANGCLTDNLHIVGGYGWDPASFTVLAQNYKRMKKTYGGKVIPGAMDSAVSKHLSHAYGSLAEQVATIAQNEGLGKRLAHGYPFLEAEVAYCARYEYCESAVDFVARRCRLAFLDTDAAGRALPRIIEILASEHKWDKARKKAELQKGREFLETFKSSKNAQFHDGKHNGRS

SEQ ID NO: 37547 - protein, 298 aa, Prochlorococcus marinus str. NATL2A
MIQEIVKRSRPLPPKSKLIIFGGGFSGQRIASVGRHLGVKVLCSRRREGSKGADFIFNTDQELSNEILEGATHILSCIPPLLSGEDPVLLKLKTQLLNSKKIKWVGYLSTTGVYGDSKGNWVNENTPPNPQQDRSIRRLSCEKQWLDTKLPIQILRLPGIYGPGRSVFESLLNGTTKMIDKPGQVFSRIHVDDIAGSVLFLINLYFQGKTPSIVNVADNLPANNLDVINFAAKIAKKSLPSRVPFEIAQKTMSPMAISFWQENRKVDNKLLCKKLGYSLIYPDFKSGLKNCFLQLKIN

SEQ ID NO: 37548 - protein, 175 aa, Bordetella parapertussis 12822
MNPYILTPDLNGEGLHIGIVRARFNEEIGQAQLQACLEELGKLGVDERDVMVVSVPGALELGVALARMAESYEFDALIALGAVIRGETYHFEVVSNESAAAISRIALETGIPVANGVLTVDTDEQAQARAAGKGADCAQVAVEMANLAAALEPEEDDEDEDDEDEDFDDEEDDGR

SEQ ID NO: 37549 - protein, 510 aa, Gracilaria tenuistipitata var. liui
MKSIILTILDGWGYSENKKGNAIQIADTPTIDKLWNSYPNTLLNASGRDVGLPEGQMGNSEVGHTTIGAGRIINQDLVRISKSIEDRSFFNNEAINSICQKINFYNTKLHLIGLCSNGGVHSHIKHLFALLDIAMRYKIQICIHAITDGRDTSPYGSKIFIEEINNQIQQFNHINICTISGRYYSMDRDCRWARTEKSYNTLLKNTLGFTKDPILMINEYYKKNISDEFIPPTRLHKGSIENNDGIIFFNFRPDRMRQLVHAFTKSTFKGFNTTSFHNLEILTLTQYDPSLDIEVAFPAKKNKNFIGEIIAKYGLKQLRLAETEKYAHVTYFFNGGIEEPFAGEDRQLIPSPKVETYDLDPEMSATKLTESAINAINKNTYKFIVINYANPDMVGHTGNLDATIHAIQKIDKCIKKIWLACQAMNSTLIITSDHGNADYMLDENNEPCTSHSTNPVPFILAEPTNIHTYHLRKNGNLADIAPTILQLLNLNIPNEMNGISLLETKAKNKI

SEQ ID NO: 37550 - protein, 184 aa, Kluyveromyces lactis
MHTPRLPVLTLVKTPLNKSRMSVLNGLSWVTLKEELTSTKLMKSSPKKPNLLWTAVSRLSLCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 37551 - protein, 446 aa, Yersinia pestis biovar Microtus str. 91001
MMKLPDIARLTPRLQQQLTRPSAPPEGLRYRGPIVEIGPTLLRASLPNVAQGELCRIEPQGMLAEVVSIEQEMALLSPFASSDGLRCGQWVTPLGHMHRVQVGADLAGRILDGLGAPIDGGPPLTGQWRELDCPPPSPLTRQPVEQMLTTGIRAIDGILSCGEGQRIGIFAAAGVGKSTLLSMLCADSAADVMVLALIGERGREVREFLEQVLTPEARARTVVVVATSDRPALERLKGLSTATTVAEYFRERGLKVLLLADSLTRYARAAREIGLAAGEPPAAGSFPPSVFANLPRLLERTGNSDRGSITAFYTVLVEGDDMNEPVADEVRSLLDGHIVLSRRLAGAGHYPAIDIAASVSRIMPQIVSAGQLAMAQKLRRMLACYQEIELLVQIGEYQAGEDLQADEALQRYPAICAFLQQDHSLTRDPDTAHLDTTLEHLAQVVG

SEQ ID NO: 37552 - protein, 350 aa, Oryza sativa Japonica Group
MGSTRTPSIAIPVDSDASPRKNTPETVTSPLVNGEKSIFRDQVRGYSALGSPLRREVGNRSITRSFCIDNTDLEDGKAEKDRDRPSHFLSLPKIQNQALLSGLAYCISSCSMILVNKYILSGYGFSAGIFLMLYQNIVSVTIVSTLSLSGVIPTEPLTWKLIKVWLPVNIIFVGMLITSMFSLKYINVAMLTILKNVANVLTASGETYFFKKQHDRQVWISLTLMIISAIAGGITDLSFNAIGYTWQILNCFLTASYSLTLRHVMDSAKQATKSGNLNELSMVLLNNILSVPLGIILVLGFNEVEYLFETPLLRMPMFWIVITASGVLGLAISFTSMWFLHQSSATTYRY

SEQ ID NO: 37553 - protein, 626 aa, Bacillus anthracis str. A2012
  misc_feature (559)..(559): Xaa can be any naturally occurring amino acid
MTICSVNNVTKSFGGNIIFENISLEIKNGERVGLVGRNGSGKTTIFQLLTGMESLDAGAIHMKKGTRIGHVAQIPKFDESMTVYEVLSSAFKIEKELEREMRTLEKDMAEEQESSVLQKLMERYGIIQEKFAFLGGYEIEANIMKVANGLQVTELFPRSFLELSGGEQTKVSLAYMLLQKPDLLLLDEPTNHLDLFAVEWLEQFLKEYNGTVMVISHDRYFLDEVVTKIFDLEDGEIHVYHTNYSRFVEEKEERLLQEFQAYQEQQKKIKKMKEAIKRLREWANQANPPNEGLHKRARSMERALERMQKLKKPILERKQIGLQFEGQDRSGKDVVVIKEVSKGFADHPLFNEVNLHVRFQERAAIVGRNGTGKTTLLKLLLEEIEPDAGEIRIGSSVKIGYLSQHAYGNMKSDVLEAFREYVAVTEGEARHILAKFLFYGPAVFKKVTQLSGGEKMRLRLAQLMYQDINFLILDEPTNHLDIESREVLEEALEQYNGTILAVSHDRYFLNKLFEKTYWIDEHKLFEFAGNYAWARQKWEERLETQVIKQQRQGRKSIEXAPVKKKEARNIEEIETELMHVEEDIYTLECTMEHVVDIKRLEQLYEEKTKKELLRAELYNELENIVE

SEQ ID NO: 37554 - protein, 384 aa, Prochlorococcus marinus str. NATL2A
MQDKLNLMIPGPTPVPENVLSSMSKHPIGHRSGDFQKIVQKTTEQLKWLHQTTADVLTITGSGTAAMEAGIINTLSKGDQVICGDNGKFGERWVKVARAYGLDVKVVKADWGTPLDPNQFKRILEEDTNEKIKAVILTHSETSTGVINDLKSINNEVKNHSKAITIADCVTSLGACNIPMDEWGIDVIASGSQKGYMIPPGLSFVAMSKRAWEANNQSNLPKFYLDLKQYLKTVNQNSNPFTPAINLYFALEASLTMMQKEGLNNIFARHARHQKATQEGIKAMGLNLFTKENFGSPAITAVKPENIDAESIRKAIKNDFDILLAGGQDHLKGKIFRIGHLGFVNNRDIISVISALESTLDKMGKLNVPTGQGIAKTISVLNNE

SEQ ID NO: 37555 - protein, 365 aa, Pseudomonas aeruginosa PAO1
MADQDQLKALRLRIDSLDEKLLELISERARCAQDVARVKTQTLGEGEAPVFYRPEREAWVLKHIMQLNKGPLDNEEVARLFREIMSSCLALEQPLKVAYLGPEGTFTQAAALKHFGNAVISTPMAAIDEVFREVAAGAVNFGVVPVENSTEGAVNHTLDSFLEHDMVICGEVELRIHHHLLVGETTKTDNITRIYSHAQSLAQCRKWLDSHYPSVERVAVSSNADAAKRVKSEWNSAAIAGDMAASLYDLSKLHEKIEDRPDNSTRFLIIGNQEVPPTGDDKTSIIVSMRNKPGALHELLVPFHNNGIDLTRIETRPSRSGKWTYVFFIDFVGHHKEPLIKDVLEKIGQEAVALKVLGSYPKAVL

SEQ ID NO: 37556 - protein, 521 aa, Neisseria meningitidis MC58
MTQDKILILDFGSQVTQLIARRVREAHVYCELHSFDMPLDEIKAFNPKGIILSGGPNSVYESDYQADTGIFDLGIPVLGICYGMQFMAHHLGGEVQPGNQREFGYAQVKTIDSELTRGIQDGEPNTLDVWMSHGDKVSKLPDGFAVIGNTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNESKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVIALRAVITSDFMTAHWAELPYSLLGKVSNRIINEVKGINRVVYDVSGKPPATIEWE

SEQ ID NO: 37557 - protein, 309 aa, Bacillus sp. SG-1
MKVVQNIADLIGDTPLVKLNRLNPEGGADIYVKLEFYNPSKSVKDRAAFQMILEAEKAGLLKEGSTIIEPTSGNTGIGLAMNAAARGYRSILVMPDTMTQERINLLKAYGAEVVLTPGDEKMPGAIQKAKELTAEIENSFMPMQFENESNPNAHRKTTAVEIIEAMDELGKPLSAFVATAGTGGTITGTGEVLKEHYNDIEVHVVEPAGSPVLSGGQPGKHKLVGTSPGFIPEILNQDVYDEIHKIEDEDAYDIARRMASEEGILVGPSSGAACYAAIQVAKKLSPDDVVVCIACDTGERYLSSDLFRF

SEQ ID NO: 37558 - protein, 248 aa, Neisseria meningitidis MC58
MSTQDLNGKIALVTGASRGIGAAIADTLAAAGAKVIGTATSESGAAAISERLAQWGGEGRVLNSAEPETIESLIADIEKAFGKLDILVNNAGITRDNLLMRMKEEEWDDIMQVNLKSVFRASKAVLRGMMKQRSGRIINITSVVGVMGNAGQTNYAAAKAGLIGFSKSMAREVGSRGITVNCVAPGFIDTDMTRALPEETRQTFTAQTALGRFGDAQDIADAVLFLASDQAKYITGQTLHVNGGMLMP

SEQ ID NO: 37559 - protein, 151 aa, Pseudomonas putida KT2440
MTDEKKDDRPVYQAACHCGTVRFELRLTDGLRTARRCNCSLCRMRGAVAVSANLGDITVTQGEEALTLYQFHTREAKHYFCSRCGIYTFHQRRSAPDQYGVNVACIEGMSPFDFADVPVSEGRVHPKDRVDGGVGVAGWLRYEGNPEWGQG

SEQ ID NO: 37560 - protein, 318 aa, Arabidopsis thaliana
MAGGGNRRDEGSITIQSTNLFAALDTRKKKKKSDKAGKSKGSSKSREPEKEPEPQVYWAPTPLKVKSWADIDDEDDDDDYYATTAPPQSGWSTSLPSHTDSKDVHVEESESEEDILDEGDDDVEEEQEQETEVQVHPEPEVKKAPEVPAPPKEAERQLSKKERKKKELAELEALLADFGVAPKENNGLEESQEAGQEKKEDVNGEGEKKENAAGGESKASKKKKKKDKQKEVKESQEQQANNNADAVDEAAGSEPTEEESPIDVKERIKKLASMKKKKSGKEVDAAAKAAPEEAAARRKKLAAAKKKEKNHYNQQPVR

SEQ ID NO: 37561 - protein, 494 aa, Mycobacterium smegmatis str. MC2 155
MTTRWRTKSVEQSIADTDEPSTRLRKDLTWWDLTVFGVSVVIGAGIFTITASTAGNLTGPAISISFLIAAVACGLAALCYAEFASTVPVAGSAYTFSYATFGEFVAWIIGWDLILEFAVAAAVVAKGWSSYLGTVFNFGGGTMQIGGGLTLDWGALLIIAVVTFLLARGTKISAMVSLVITVIKVSVVLLVVFVGAFYINTANYTPFIPPAESGDGSGGGTGAEQSLFSLLTGAEGSHYGWYGLLAGASIVFFAFIGFDIVATTAEETRNPQRDVPRGILGSLAIVTVLYVAVSVVLSGMVSYRDLKTVDGESANLATAFAQNGVDWAAKVISIGALAGLTTVVIVLMLGQTRVLFAMSRDGLMPRQLAKTGPHGTPVRTTLIVGGAVAVAASVFPIGKLEEMVNIGTLFAFVLVSAGVLVLRRTRPDLPRGFRTPLVPVLPVAAILACVWLMLNLTGLTWIRFLIWMAIGVVIYFLYGRRRSVLATRDTTPTA

SEQ ID NO: 37562 - protein, 555 aa, Erwinia carotovora subsp. atroseptica SCRI1043
MSENYTVGDYLLDRLTQIGIQHLFGVPGDYNLHFLDHVIRNPDITWVGCANELNAAYAADGYARCRPAAALLTTFGVGELSAINGIAGSYAECLPVIHIAAAPCLASQRNGELLHHTLGDGDFSHFSRMAAEVTVAQASLTVENATAEIDRVIGEALAQHKPVYLFLPVDVAAAPVGARPYPLVIPEPLHSDDSLRAFTTAATDMLSKAKSVSLLADFLAQRFSLAGKIQRWLDKTPLPHATLLMGKGTLNEQHRSFTGTYSGSGSHESIRAHIEDADAIISIGVRYTDTITTGFSHQIPIEKNIDIQPTLARVGNQVFPSVPMSDAIAVLEKITEKFASRWDHCTITPPVLPQSEHRSALSQREFWQQIQRFLRPDDILVTDQGTSCFGAATLRLPAGCHFIVQPLWGSIGYSLPAAFGAQIAEPERRVVLLIGDGSLQLTVQELGSIIRDRLNMVIVVLNNEGYTVERAIHGSEQRYNDIAAWNWTQLPTALGANENEILCKQVRSPIALAQVLEQVNAESRLSLIEVVLPRMDIPALLHTITQSLETRNTVQ

SEQ ID NO: 37563 - protein, 254 aa, Glycine max
MSSDSRSRSRSRSPMDRKIRSDRFSYRDAPYRRDSRRGFSRDNLCKNCKRPGHYARECPNVAICHNCGLPGHIASECTTKSLCWNCKEPGHMASSCPNEGICHTCGKAGHRARECSAPPMPPGDLRLCNNCYKQGHIAAECTNEKACNNCRKTGHLARDCPNDPICNLCNVSGHVARQCPKANVLGDRSGGGGGARGGGGGGYRDVVCRNCQQLGHMSRDCMGPLMICHNCGGRGHLAYECPSGRFMDRYPRRY

SEQ ID NO: 37564 - protein, 306 aa, Magnaporthe grisea
MGMPPFVVDFLMGGVSAAVSKTAAAPIERVKLLVQNQEEMIRAGRLDRRYDGIVDCFKRTSQAEGVMSLWRGNTANVIRYFPTQALNFAFRDKFKAMFGYKKDKDGYAKWMAGNLASGGAAGATSLLFVYSLDYARTRLANDAKSAKGGGDRQFNGLVDVYRKTLASDGIAGLYRGFGPSVAGIVVYRGLYFGMYDSIKPVLLTGSLETNFFASFALGWCVTTGAGIASYPLDTVRRRMMMTSGEAVKYSSSFDAFKQIVAKEGVKSLFRGAGANILRGVAGAGVLSIYDQLQLIMFGKAFKGGSG

SEQ ID NO: 37565 - protein, 221 aa, Gentiana triflora
MVSSSVSSVTEVKVESYVFPPSVKPPSSTKSFLLGGAGVRGLEINGNFVKFTAIGVYLEESGVAVLSGKWKGKTAEELSDSVEFFTDIITGPFEKFTQVTLILPVTGQQYSPKVAENCAAQWKAAGIYTDADGIAIEKFLQVFQTESFTPGDSILFTHSPESLTISFGKNGAIPEVSNAVIENKKLSEAVIESIIGEKGVSPAAKKSLATRIAEILNHFDA

SEQ ID NO: 37566 - protein, 680 aa, Staphylococcus aureus subsp. aureus MRSA252
MKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHSGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 37567 - protein, 219 aa, Lactobacillus delbrueckii subsp. lactis
GETEFWFAMIKIIAIISLVVTGIIMVAANAKTPVGHASLSNFTGSFSLLPKGKYAFFTAFPMVFFSFAGIEFVTITIGEAKNPKKVIKKAVNETLLRILLFHIATLAVIMCVIPWGKITSGTSPFVQVFKIAGFNAVASVFNFVVLTAAASSLNSGIFSAGRHFFQLAEEAPKDSFLKKHFAKISANGVPAAGIVISVALMLIAPIMSFSSTAIEVFGT

SEQ ID NO: 37568 - protein, 867 aa, Debaryomyces hansenii CBS767
MILVNQAMRGNKDKDLEATVGPQSPRGGDKKGTRFNFGGFLKKIPLPVNKRSSEEVKEGAEGQTDPVEISMSPTAKSSPSDEIGVGSSGGNVIEGNSNYTHEIIPVGDPSRNKLRYATFTAKCISLENSELTSQIDLDEQSIDEPQDSVFTQVAGPPPVIIDRKYTKKKSKNPKLRINSNQSVTSVVDNPNPRGEVFENYQHFDNFEAYKQDLAEEDDVVEYLSESESDLNINPHQEENANDYKVGGYHPVSKGEVYFSRDFPNREYIILRKLGWGHFSTVWLAKSRYNRELNPSTSEDASVDTNDYYVAIKFVKSSDSYMEAAEDEIKLLKTLDKPLVYGKHLEEQHKQFFENHKINKHNQPVGHPGYKHIMRLLDDFEVTGPNGKHICMVFEVLGENVLNLIFKSKTISKDLKQNTKSPIGSKDMKPENNKNFKLFKSKLSLGLINNPKKEVLTSATDDNLSGVGCIKNNSSDSLTKLIGVQKTYGGIPLTLVKQIVKQMFLAVDYMHHCGIIHTDLKPENILIEIKDINNVIKVIENEKITKFNAKYKNRKDSSISTVNINTDKIGLNRANSTNPKTRQDSVGYGLYRKSRNSVCCKCDSPVRSSKPLSSSINSDTTFQEVSFYGNGNQSRKSSICKINEGGISPTTMSILKPKVEKNKDDSELISIKIADLGNATFSHYHFTNQIQTRQYRAPEIILKHKTWGSSADIWSIGCIIFELITGDYLFDPHNGNNFDKDEDHMAQIVELLGEFPTPDYLNNCDLTSTFLKKDSAGKYSLRNINKLKYWSLHDVLVQKYKFDENDINLQLINDLILKCLTYDLTERYDCKSLANHPWLNNDLDLDNFDFETSTNIPKDHNDIPGFTS

SEQ ID NO: 37569 - protein, 434 aa, Synechococcus sp. PCC 7002
MAIATEFKSIPRLSTGKFQQKLQLLLNPVGYLTRLASSAPDLAYMPAAGYDQPLVLAYHPEAIRQLLSNSNQAFAAPGELNGIIEPLVGQQSLVSLSGDRHRQERKLIMPAFHGARMHNYGALITQIIEEELSQLKPGQAFQMQDITQKITLRTIIEVVFGVQGGDRYAPIMAMTRKILNRFTSPIANSFLFFTSLQKDLGAWSPWGSFIRDRQALDELIYAELQERRAHPDPERTDILSLLMAATDEAGNTMDDQQLRDELMLLLFAGHETTAIAMAWGTYWLHTHPEVMAKVRAEITALGENPDPMDIYRLPYLAAVCNETLRINPVAMFTFARQAVATTQLLDYSIEGGTVLMGSIYLLHQRPDLYPNPREFRPERFLERQFTPYEFMPFGGGVRRCAGEALAMVELRLGLAAIATYNRLNLIGSSARRGQ

SEQ ID NO: 37570 - protein, 897 aa, Oryza sativa
MSPDADAAAAAAAGGEGAAAAGVGTAGEGRGVIRWDQILPRRSLRVLLVEHDDSTRQVVTALLRKCGYRAVAAVADGMKAWGVMRERAYAFDLVLTEVTMPTLSGIELLSRIVASDECKNIPVIMMSSQDSIGTVLRCMQKGAVDFLVKPVRKNELRNLWQHVWRRHAMNSQTNASENNAASNHLSANGGNGSKTGEHSDEESDAQSSGSKREVEIQSAEKLPEVVADGGAGSSREHKIQNGFIDGMNTKSHALKGNDDAPSGNACGDSELQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRKDSLTHPSYGFIPVPIPVGAAIPYHYGAIMQPMYYPQGAFMHCDSAAINKTAIQHVSCQSNYHENLGKPPQIDEHKQPEENHQLHHSRQILRESGEPVDLAKAHMERINQSASCSQDIRKGSGCTGSGETDANTNTVIALESGNESGVQNCSNNVLDGDRSRREAALLKFRMKRKDRCFEKKVRYHSRKKLAEQRPRVKGQFLSSISNGGRRSSGGAGRDAGRVRDRLAVGGVLRRRRGAGREPAVRQRVRDVPDDMHVAAAAASARAAVVVVAVDAVRAAAVLGASAAVPDAAAPAAISGGRERHVPASGGADDDEPAAITAASTVVTTAADDEEQQRVDGVAAVVLVPLLIAAVSAVVVQPVLLLLPLRQRQALRRRRRGERLHGADPSGVAAHRHIPDVTTRTNFSARYDRN

SEQ ID NO: 37571 - protein, 481 aa, Pseudomonas syringae pv. syringae B728a
MKTIRIRADVLAGLTTSFALVPECIAFALVAHLNPLMGLYGAFIICTLTALFGGRPGMVSGAAGSMAVVIVALVVQQGVQYLLATVLLGGLIMILFGLLRLGKLVRLVPYPVMLGFVNGLAIVIAMAQLEHFKVGDSWLSGTPLYVMIGLVALTMAIVYLLPRLTRIAPPALVAILSVGLAVYLLGLPTRTLGDMAHIAGGLPVFAMPDIPWNLETLRIIAPYAILMALVGLLETLLTLNLTDEITETRGYPDRECVALGAANVVSGAFGGMGGCAMIGQTVINLSSGGRGRLSGVVAGLMILMFVLFLSPLIERIPLAALVGVMFVVAQQTFAWASLRVLRKVPVNDVLAIIAVTVVTVLTDLATAVLFGIIIAAINFAWQQARELYADSHVEADGSKVYHLHGTLFFASTTPFLDQFNPAEDPTQVTLDCRHLSFVDYSAIAALKTLRERYAKAGKHLRVVHLSERCKRLLKRAGVQHA

SEQ ID NO: 37572 - protein, 588 aa, Mesorhizobium loti MAFF303099
MCGRQSMDQTRQAVHQSTRKSAHGSAQGSAHGSAKPTFSELFMPKLVTVWREGYHLPQFKADVMAGLTVAIVALPLSMAIAIASGVSPERGLYTSIVGGFIISAFGGSRFQIGGPAGAFIVLVAATVARVGVDGLLLATMMSGVFLLAIGYLRLGTYIKFIPYPVTVGFTAGIAVIIFSGQIVELFGLTLPGKEPGPFVPKLIALGEAAGTINPAATFVAALTIATIAFLKRWRPKWPAMLVAIGLASLVVALFALPAETIGTRYGGIPRSLQWPALPPVSLDRMIEVLPDAVAFALLGAIESLLSAVVADGMTGRRHRSNCELVAQGFANIASALFGGLCATGTIARTATNVRAGAHGPVSGMVHSVILLVLMLAAAPLASYIPLAALAGVLAVVCWNMFEKQAFATLLRASRGDALVLMATFLIVVFRDLTEGIVVGFALGSILFIDRMAKSVAVEADLVQDDIADTVNAAGAYDPSEASDADTIVYRISGAFFFGAASTVGSVLDRIADQRKNFILDCSAVPLFDSTAANVIESAAHKARRAGVRFIIAGAAPPIRRMLINHGVKRPLVTYAASISDARAQLVGK

SEQ ID NO: 37573 - protein, 531 aa, Zea mays
  misc_feature (481)..(481): Xaa can be any naturally occurring amino acid
MASNGNGTARVVVPEIKFTKLFINGEFVDAASGKTFETRDPRTGDVLAHVAEADQADVDLAVKSARDAFDHGKWPRMSGYERGRVMSKLADLVEQHTEELAALDGADAGKLLLLGKMIDIPAATQMLRYYAGAADKIHGDVLRVSGKYQGYTLKEPIGVVGVIIPWNFPTMMFFLKVSPYLVNYRTSLYKKAGWYRSGIPGMMFTLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVXWVNCYFAFDPDAPFGGYKMSGFGRDQGLAAMDKYLQVKSVITALPDSPWY

SEQ ID NO: 37574 - protein, 299 aa, Burkholderia thailandensis E264
MSEPIDLSQISPSLKAEILAEALPYIRRYHGKTVVIKYGGNAMTEERLKQGFARDVILLKLVGINPVIVHGGGPQIDQALKKIGKQGTFIQGMRVTDEETMEVVEWVLGGEVQQDIVTLINHFGGHAVGLTGKDGGLIHARKLMMPDRDNPGEYVDIGQVGEVEAINPAVVRALQDDAFIPVISPIGFGEDGLSYNINADLVAGKLATVLNAEKLVMMTNIPGVMDKEGNLLTDLSAREIDALFEDGTISGGMLPKISSALDAAKSGVKSVHIVDGRIEHSVLLEILTEQPFGTMIRSH

SEQ ID NO: 37575 - protein, 293 aa, Oryza sativa Japonica Group
MDHLWASVFGILGNIVSFLVFLAPMPTFLRVYRKKSTEGFSSVPYVVALFSCTLWILYAMVKTNSSPLLTINAFGCVVEAAYIAVYLVYAPRPARLRALTSFLLLNVAAFSLVVVVTVAAVAQPHRVRVLGSICLAFSMAVFVAPMSVIMVVIKTKSAEFMPFSLSFFLTLSAVAWFFYGLFTNDLYVTLPNVGGFFFGCVQMALYFKYRKPNTAAGGVMILPTTAAAAAVDGAVAEPAAAAQQLAEELEMELAAAGAHAVAVLPASALPVLAELHKMEQEIGTPRKGATKTV

SEQ ID NO: 37576 - protein, 517 aa, Kluyveromyces lactis NRRL Y-1140
MSNSIGDESPEEQKKRHLKLFETIDINHTGKIDIRTLQQAFEKSDHPLKGSPEAIEHIFKSLDQNKDSVIDFNDFEKYVTTAETQIKVGFQKIDKDNDGRIKMEELSKYLSQFREDHDIKDVADSKQRKKPSKISNFVDWAFNRKSYITYEQWRDFLLFVPRKEGSRLNTAYAYFYLFNEDVDLSSEGDVTLINDFIKGFGFFIAGGCSGVVSRTCTAPFDRIKVFLIARTDLSSTLLNSKDTLLAKNPNADLSKIKSPLIKAATTLYRQGGLRAFYVGNGLNVVKVFPESAIKFGSFEMAKRIMARLENVKDTSELSRLSTYIAGGLGGVAAQFSVYPIDTLKYRIQCAPLNTNLKKSSILLQTAKEMYQQGGIRLFYRGVHIGVMGIFPYAALDLGTFSALKKWYIKKEAKKTGLPEDEVIISNLIVLPMGAFSGTVGATLVYPINLLRTRLQAQGTYAHPHTYNGFSDVLKKTIQREGYQGLFKGLVPNLAKVCPAVSISYLCYENLKRLMKLE

SEQ ID NO: 37577 - protein, 412 aa, Oryza sativa Japonica Group
MEFFLQGRFIFGPDVRSLFLTIFLILAPVLVFCIFVARHLINDFPDHWGVSVMVVVVVFTIYDLTLLLLTSGRDPGIVPRNTHPPEPESIDGGSDMGNGQTPQQLRLPRTKDVFVNGVIVKVKYCDTCMLYRPPRCSHCSICNNCVERFDHHCPWVGQCIGRRNYRFFYMFVFSTTLLCLYVFGFCWVYIVKIRDAENSTIWKAMLKTPASIVLIIYCFICVWFVGGLSVFHFYLMSTNQTTYENFRYRYDRRANPYNRGMVNNFLEIFCTAIPPSKNNFRARVPVDQGLQQTRTPARGFMSPNMGKPVGDLELGRKPVSWDEPRSAADIRDLEVGLGGLLDEKEGRIAHASPDLSLPGELVEGRAGMHSRRSSWGHRSGTSESMDSIAVQMGTEANWGSISSGHGTTSSTH

SEQ ID NO: 37578 - protein, 465 aa, Neisseria meningitidis MC58
MSQGKIVQIIGAVVDVEFPRDMIPRVYDALKLDENGLTLEVQQLLGDGVVRAIAMGSSDGLKRGMTVSNTGAPITVPVGKGTLGRIVDVLGTPVDEAGPIDTDKSRAIHQAAPKFDELSSTTELLETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDENGKGRDVLFFVDNIYRYTLAGTEVSALLGRMPSAVGYQPTLAEEMGRLQERITSTQTGSITSIQAVYVPADDLTDPSPATTFAHLDATVVLSRDIASLGIYPAVDPLDSTSRQLDPMVLGQEHYDVARGVQSTLQKYKELRDIIAILGMDELSDEDKLTVMRARKIQRFLSQPFHVAEVFTGSPGKYVALRDTIAGFKAILNGEYDHLPEQAFYMVGSIEEAVEKAKTLN

SEQ ID NO: 37579 - protein, 132 aa, Cicer arietinum
MASKVNVASINISLILCLNLISLTMVKSNYVVPEVPVPIVDPYPKGTITCPINALKLGVCAKVLNLVKVKLGAPPTLPCCSLIQGLADLEAAACLCTALKANVLGLHLDVPISLSLILNNCGKNNSGFQCPL

SEQ ID NO: 37580 - protein, 432 aa, Xanthomonas campestris pv. vesicatoria str. 85-10
MTLWVLGLNHQTAPVDLRERAAFAGDALPRALESLRALPQVSEAALLSTCNRTELYAMADEAHSLVNWLETHAPGLSGHLYQHREAEAVRHLFRVATGLDSMVLGEPQILGQVKDAWAVARAHGALGSGLDRLFQQTFSVAKRARTDTRVGANPVSVASTAVRLAQDSFARLNESTVLLIGAGETIELAAKHLSEGRVRRLLIANRTLAHAQTLASQHGGFALPLTDLERHLAEADVVFSATAAREPLVTRAQVEQALRTRKRKPMLLFDLAVPRDIEASVGELGDAYLYTVDDLERAVEDNRRGRREAADQAEAIIDLQVARYVETLQATARQAPLKRLRAFGDSTRDELLAKARQQLHNGKPADEVLEQLAHALTNRLLHPPTAALRNAALNNDLELTTAADRLFPEKPGYQHPPIATPIVRTDDADPAP

SEQ ID NO: 37581 - protein, 479 aa, Pseudomonas putida KT2440
MSVQTTTTRNASAHTFKQDMQTRHIVMLALGGVIGTGLFLTSGYTVNQAGPLGAVIAYILGAIMVYLVMMCLGELAVHMPEVGSFSSYATRYLGPGTGYMVAWMYWLTWTVAIGSEFTAAGILMVRWFPDTPVWMWSALFGAAVFISNIISVRSFAETEFWLSLVKVLAVIAFLVVGGGAILGGFEIQQAHSAGLGNFTREGLFPTGFWSIAMTLLAVAFAFSGTELIGIAAGETKDPEKNVPKAIRTTVLRLALFFIGTIFVLATLLPREQAGVIESPFVMVFAMIGIPYAADIMNFVIITALLSAANSGLYAASRMLWTLSDQGNMPRRYATLSRRGTPFNAIVLSMAGGMASLLSSVFAPDTIYLALVSISGLAVVVVWISIAASQIAFRRHYIASGGKLEDLKFRVRGYPFVPLGAIFCCVLACVGIAFDPAQRVALYFGLPFIAWCYLAYWLTCKYRSRRTAPLEIVAPGSEAA

SEQ ID NO: 37582 - protein, 489 aa, Pseudomonas aeruginosa PAO1
MPDVRVLPCTLALFGALGDLALRKLFPALYQLDRENLLHRDTRVLALARDEGAPAEHLATLEQRLRLAVPAKEWDDVVWQRFRERLDYLSMDFLDPQAYVGLREAVDDELPLVAYFATPASVFGGICENLAAAGLAERTRVVLEKPIGHDLESSREVNEAVARFFPESRIYRIDHYLGKETVQNLIALRFANSLFETQWNQNHISHVEITVAEKVGIEGRWGYFDQAGQLRDMVQNHLLQLLCLIAMDPPSDLSADSIRDEKVKVLRALEPIPAEQLASRVVRGQYTAGFSDGKAVPGYLEEEHANRDSDAETFVALRVDIRNWRWSGVPFYLRTGKRMPQKLSQIVIHFKEPPHYIFAPEQRSLISNRLIIRLQPDEGISLQVMTKDQGLGKGMQLRTGPLQLSFSETYHAARIPDAYERLLLEVTQGNQYLFVRKDEVEFAWKWCDQLIAGWERLSEAPKPYPAGSWGPVASVALVARDGRSWYGDF

SEQ ID NO: 37583 - protein, 319 aa, Xanthomonas campestris pv. vesicatoria str. 85-10
MQDQRNLLVFSGNANKPLAQSICKELGVRMGKALVTRFSDGEVQVEIEESVRRQEVFVIQPTCAPSAENLMELLVLIDALKRASAQSVTAVIPYFGYSRQDRRMRSSRVPITAKVAAKMICAMEADRVLTVDLHADQIQGFFDVPVDNVYASPLLLADIWRAYGTDNLIVVSPDVGGVVRARAVAKRLDDADLAIIDKRRPRANVATVMNIIGDVQGKTCVLVDDLVDTAGTLCAAAAALKQRGALKVVAYITHPVLSGPAVDNINNSQLDELVVTDTIPLSEAARTCAKIRQLSVAELLAETIRRIAFGESVSSLYVD

SEQ ID NO: 37584 - protein, 202 aa, Chromobacterium violaceum ATCC 12472
MDAAGYVAGQDVMIALDCAASEFFRDGKYHLTAEKLSLSSEEFADYLENLVNKYPIISIEDGMAEQDWAGWKLLTDRLGQKVQIVGDDVFVTNPKILAEGIAKGVANSLLVKVNQIGTLSETLKAVDLAKRSRYTCVMSHRSGETEDSTIADLAVATNCMQIKTGSLSRSDRMAKYNQLLRIEEELGDAAHYPGRAAFYHLK

SEQ ID NO: 37585 - protein, 363 aa, Xanthomonas campestris pv. vesicatoria str. 85-10
MGIKCGIVGLPNVGKSTLFNALTKAGIAAANFPFCTIEPNVGIVPVPDPRLNQLADIVKPQKLIPTAVEFVDIAGLVAGAASGEGLGNKFLAHIREVDAITHVVRCFENDDVIHVNNKVDPIADIETIDTELALADLDSVEKALNRAERSAKGGDKDAAARKPVLAKLQAALADGKAGRAAGLDDEEKALVRDLFLLTLKPVLYIANVLEDGFENNPHLDAVRAHAAVEGAEVVPVSAAIEEELSQLDDADRDSFLADLGLEEPGLNRVIRAAYTLLGLQTYFTAGVKEVRAWTVKAGSTAPQAAAVIHTDFEKGFIRAETIGFDDFIKYRGEAGARDAGRLRLEGKEYRVQEGDVLHFRFNV

SEQ ID NO: 37586 - protein, 373 aa, Arabidopsis thaliana
  misc_feature (301)..(301): Xaa can be any naturally occurring amino acid
  misc_feature (309)..(309): Xaa can be any naturally occurring amino acid
  misc_feature (321)..(321): Xaa can be any naturally occurring amino acid
MEVKGATRSSIIVPSVQEMVKEKMITTVPPRYVRSDQDVAEIAVDSGLRNQIPIIDMSLLCSSTSMDSEIDKLDSACKDKFIWNSNLSLWHVFMNIQQLVNHGMESSFLNKVKSEVQDFFNLPMEEKKNLWQQPDEIEGFGQVFVVSEEQKLDWADMFFLTMQPVRLRKPHLFPKLPLPFRDTLDMYSAEVKSIAKILLGKIAVALKIKPEEMDKLFDDELGQRIRLNYYPRCPEPDKVIGLTPHSDSTGLTILLQANEVEGLQIKKNAKWVSVKPLPNALVVNVGDILEIITNGTYRSIXEHRGVVNXSGKERLSVAAFXHNIGLGKEIGPMRSLVERHKAAFFKSVTTEEYFNGLFSRELDGKAYLDVMRL

SEQ ID NO: 37587 - protein, 343 aa, Micromonospora echinospora
MNTTRILVTGGAGFIGSHYVRTLLRPAGPGGVRITVLDKLTYAGNLANLRPVAGHPAYRFVRGDICDSLLVDRLVAEHDQVVHFAAESHVDRSIADGGDFVRTNTLGTYTLLEAVRRRHGDRAVFVHVSTDEVYGSIEHGTWPETDPVLPSSPYAAAKAASDLLALAFVRTHGLDVRVTRCANNYGPHQHPEKLVPLAITNLLDGGDVPLYGDGLHVRDWLHVDDHVRALELVRTRGRAGQVYNVGGGTQLTNREMADRLLAACGAGPERIRYVEDRKGHDRRYAVDWSKIRCELGYAPRKDLDRGLADTVAWYRANRSWWEPLRRRPVAQAGRPTGTDHGLA

SEQ ID NO: 37588 - protein, 384 aa, Micromonospora echinospora
MDALPLTALVTRPVTEQFPDLRPGAARFDAPAGTLVHHAVRDVVTRYPARAGADIAHPRSRTVLDWAAGRFRALIGAPGGAVSFGPDMTSLTEGFVRSVAPALRPGDEVMCTALDHAANVDPWRESARRQGAVVRVADLSPSGELTVDAVTEQLSPRTRWVAVTAGSNVLGSAPDIPAICAAARSTGARIFVDGVQAPAHRFVDVAAWGCDAFVTSADKWYGPRCGVLWNRDGRPRSMVARTSDRPGAAHGPGIEVVLAAGMAAEVLLHWDRSAVFRHGERLANLLARGLRMIDGVRVLGRPDGRSPIPIVSFQVVGRSAADVAAILAAEGITVGHGTFGAERALRALSPDVPESLRAGVARYTTRDDVRALLGGVAAIAAPRA

SEQ ID NO: 37589 - protein, 124 aa, Zea mays
MSTATSNVHIAWLCNNTVDHHDLTQMTFGYSRDDVGKFIPVYLAQGILQHDPFEVLDQRGVGELVKFATERGRKARPNLKVGICGEHGGDPSSVAFFAKAGLDYVSCSPFRVPIARLAAAQVLV

SEQ ID NO: 37590 - protein, 364 aa, Medicago truncatula
MRRVCKNKLFSNKSLDASQYLRRGKIDELINYVSQCSLKGEAIDMGKLAFKTSINLLSNTVFSVDFANNKDLVMDMSETVGSPNMADFFPLLRLIDPQGIKRTYVFYVGKLFGIFDNIIDQKLKLREGDGFVTNNDMLDSLLAEENKKELDREKIQHLLHDLLVGGTDTTTYTLEWAMAELLHNPNVMSKVKKELEETIGIGNPIEESDVTRLPYLQAIIKETLRLHPIAPLLLPRKAKEDVEVNGYLIPKGAQIFVNVWAIGRDPKVWDNPNLFSPERFLGTKLDIKGQNFQLTPFGSGRRICPGLPLAMRMLHMMLGSLLISFDWKLENGMKPEEIDMEDAIQGLALRKCESLRVIPTKISN

SEQ ID NO: 37591 - protein, 534 aa, Rhizobium leguminosarum bv. viciae 3841
MAEPLRLKAKSASPGIASGPAFLAEEPKAPSAAGRPDAAPASRAVGGYGALEKAIDISIGELEHLADGADAESRDIIDFQIEVLRDPTIAEATGARMEADENVVFAWVATLDAYIGELEAADEEQMRARAVDILDIKNRVLGALAGTPIADFPPGSVFVGKDMEPSRFLAHDWSKGGGIALFAGSTAGHVALLARAKSVPMVIGTGRFSAADGDPVSVDGNAGAVILQAGSMLIPPLVPAQEPAGDTQTIGGELRTADGVPILLSININDPAEIDALDPATAGVGLMRSEFSVASVADAANEERQLAIYRSVLEQAGDRPVTIRMLDIGGDKPLAGLEDLPVLASGLRGIRLLLARPEIARVQARALLRAAVFGRLSVMLPMVTFPDEIDRMRELFREEAEKLGRRALPHRMPPIGMMVEVPSAALMLDAFGAAAFFSFGTNDLTQYLAASTRDDIDADAGKAAPAVLRLLAQAVKLTAGKPVSICGDMAGNPHYLPGLLAAGLRHFSVAPARRPAIRSAIIGLNADGTRAAGE

SEQ ID NO: 37592 - protein, 380 aa, Medicago truncatula
MEFIDVIMFLFALAFLRWWWRRWSKTGGGTKNLPPGVPGWPIVGNLFQVILQRRPFIYIVRDLRLKYGPIFTMQMGQRTLIIVTEADLIHEALIQRGPQFASRPKDSPIRLIFSMGKCAINSAEYGPLWRSLRRNLVTEMISPLRVKQCSWIRKWAMEAHMRRIQNEAHENGFVEVMSNCRLTICSILICLCFGAKITEERIRDIESVLKEVMLITLPKLPDFLPVLTPLFRGHVKEAKKLRKKQLELIAPLIRKRKVYVESDGKCGDPEMVSAIGAAYVDSLFGLEVPSRGILGDEELVTLVSEIISAGTDTSATAIEWALLHLVMDQEIQERLYREIVDCVGKCGIVMDSDVEKMPYLCAIVKETFRRHPPSHFVLSH

SEQ ID NO: 37593 - protein, 238 aa, Zea mays
MSQLAAETGALNLSQGFPDFNGPQALLDAVGKHIALGHNQYAPMTGLPVLRQQVAAKIARSYGATVNADSEVTITPGATEAIFCAIQAVIRTGDEVIVFDPSYDSYEPSVELAGGRCVHVQLSQNGFALDFERIKAALSPRTRMIILNTPHNPTGALISRAELDQLAELIRDRDIYLVSDEVYEHLVFDGVAHVSVLAHEELYQRAFVVSSFGKTYHVTGWKTGYVVAPPALTAELRK

SEQ ID NO: 37594 - protein, 170 aa, Fusobacterium nucleatum subsp. vincentii ATCC 49256
MDLKNYVATIENYPKEGILFRDITPLMNNGEAYKYATEKIVEFAKEHHIDIVVGPEARGFIFGCPVSYALGIGFAPVRKPGKLPREVIEYSYDLEYGSNKLCLHKDSIKPGQKVLVVDDLLATGGTVEATTKLVEELGGVVAGLAFLIELVDLKGRERLSKYPMITLMQF

SEQ ID NO: 37595 - protein, 502 aa, Medicago truncatula
MSPLILLPFALLLFFLFKKHKTSKKSTTLPPGPKGLPFIGNLHQLDSSALGLNFYELSKKYGSLIYLKLGSRQTIVVSSAKMAKQVMKTHDIDFCNRPALISHMKFSYDGLDQFFSPYREYWRHTKKLSFIHFLSVKRVVMFSSVRKYETTQMITKISEHASSNKVVNLHELLMCLTSAVVCRTAFGRRFEDEAAERSMFHDLLKEAQEMTISFFYTDYLPFVGGIVDKFTGLMSRLEKLFKILDGFFQSVFDEHIDPNRKKLPPHEEDVIDALIELKNDPYCSMDLSAEHIKPLIMNMLLAGTDTIAAAVVWAMTALMKNPRVMQKVQEEIRKAYEGKGFIEEEDVQKLPYFKAVIKESMRLYPSLPVLLPRETMKKCDIEGYEIPDKNIGVHNAWAIHRDPEAWKDPEEFYPERFIGSDIDLKGQDFELIPFGSGRRVCPGLNMAIATVDLVLANLLYLFDWEMPEGVKWENIDIDGLPGLVQHKKNPLCLIAKKRIECV

SEQ ID NO: 37596 - protein, 310 aa, Physcomitrella patens subsp. patens
AYIALQAWKKAIVDDPNGILDTWVGKDVCEYKGVFCSPPEDPNLSYLEVVSGIDLNEADLKGPLVPELGLLREIGLFHLNSNRFYGTVPDSFRYMKTLFELDLSNNHLTGEFPQVLLDIPLLEYLDIRFNKFYGKLPRELFSKRLDALFVNNNNFNGEIPDNLGESTVSALVLANNYLHGSIPKSIGDMKNLNEIVALNNDIDGQLPDNIGNLKNVTLFDYSDNHITGGLPKSIKGMSSLETFDMSKNKLGGIVTAELCELDNISAINLDNNYFTGVAPSCAALGDILSLDGNCVPGSQGQKDAATCAAF

SEQ ID NO: 37597 - protein, 363 aa, Arabidopsis thaliana
MAKDGPNWDGLLKWSLSHADGTRPTRQLSEEDRKWFMEAMQSQTVDVVKRMKEITLVMQTPEQVLVEHGVTPEDIQDLLDELQEHVESIDMANDLHSIGGLVPLLSFLKNSHANIRAKAADVVSTIVQNNPRSQELVMETNALESLLSNFTSDTDIHARTQALGAISSLIRHNKPGVTAFKLANGYAGLRDALASDSVRFQRKALNLLQYLLQEDDSDRSIATGLGFPRVMMHLASSDDAEIREAALRGLLELSREKNDGSSSIDKSDEKLRQLLEERIKGITLMSQEDLETVKEERQLVDLLWSICYNEPSSLREKGLVVLPGEDALPPDVASKLFEPPLRASAANRNATEKKDEPMKLLGP

SEQ ID NO: 37598 - protein, 570 aa, Pyrococcus horikoshii OT3
MDVEKIALKHALINAIEHGGKANLKAVIGKVLGENPELRPRAKEIIPIINKVVEEVNSLARDEQLEKLKDIYPEYFEKKEEKKEKKGLPLLPKAEKGKVVTRFAPNPDGAFHLGNARAAILSYEYAKMYGGKFILRFDDTDPKVKRPEPIFYKMIIEDLEWLGIKPDEIVYASDRLEIYYKYAEELIKMGKAYVCTCPPEKFRELRDKGIPCPHRDEPVEVQLERWKKMLNGEYKEGEAVVRIKTDLNHPNPAVRDWPALRIIDNPNHPRTGNKYRVWPLYNFASAIDDHELGVTHIFRGQEHAENETRQRYIYEYFGWEYPVTIHHGRLSIEGVVLSKSKTRKGIEEGKYLGWDDPRLGTIRALRRRGILPEAIKELIIEVGLKKSDATISWENLAAINRKLVDPIANRYFFVADPIPMEVEGAPEFIAEIPLHPDHPERGVRRLKFTPERPVYVSKDDLNLLKPGNFVRLKDLFNVEILEVGDKIRARFYSFEYEIAKKNRWKMVHWVTEGRPCEVIIPEGDELVVRKGLLEKDAKVQVNEIVQFERFGFVRIDRIEGDKVIAIYAHK

SEQ ID NO: 37599 - protein, 553 aa, Bordetella parapertussis 12822
MIHANGPRTGRPPALGRRGMVSSPHYLASGSGLEVLRRGGSAVDAAIATNATLCVVYPHMAGLGGDAFWLIAAGAAQGVQALQACGPAGALADMDFYRGKGHAEAIPARGALAALTVPGAVDGWRLAHERYGKLPWESLFADAIEYARHGAPVSRSLADWLAADAAILAADPGMAGIYLPEGKPQREGSYLVQADLARTLETLARLGPREGFYEGEVAREICRYLEAAGGPLRAADFERYRAEWVQPISGTYRGYEVFQMPPPTQGFAALQILKLLEQCDVAAWGAESAEYYHHVVEAIKIAFADRDEWLSDPAYVDMPLATLLSSEYCRQRHALIRSESALALDRIEAGIKFGGAASRKSPDGDTVYFCVADADGLVVSTIQSIYHDFGAAVVGGNTGVIMQNRGSFFSLDADHPNCLQPGKHTFHTLVPAMLMKDGQPVLAYGTMGGEGQPQTQAALLTRMVDFGYDVQQAIEAPRWLMGRTWGMSSRDLWLEARIADETLRELRLRGHPVKTVPNWDGTLGHAQAIRIDPVTRAFEGGADPRGDGAALGF

SEQ ID NO: 37600 - protein, 116 aa, Candida glabrata CBS 138
MLRTVVNVARQRPMMMAKANMQMLRPVRFYSQGLSKDVVQKRVVDVIKAFDKTSASANITEDTLFHKDLKLDSLDTVELLVAIEEEFDVEFPDKVADELKSVKETVDYILSNPDAN

SEQ ID NO: 37601 - protein, 438 aa, Oryza sativa Japonica Group
MAVIALKCPDVEVVVVDISAPRIEGWNSERLPIYEPGLDDVVRQCRGRNLFFSTDVERHVADAGIVFVSVNTPTKTRGLGAGKAADLTYWESAARIIADVSRSDKIVVEKSTVPVKTAEAIEKILAHNSKGGNIRYQILSNPEFLAEGTAIQDLFSPDRVLIGGRETPEGRAAVAALKSIYARWVPDDRIITTNLWSAELSKLAANAFLAQRISSVNAISALCEATGADVTEKDILNLVYICECYGLPEVANYWHQVIRINDYQKSRFVNRVVSSMFNTVAGKKVAVLGFAFKKDTGDTRETPAIDVCKGLVGDKAVVSIYDPQVTEEQVQRDLVMNKFDWDHPRHLQPMSPSSAKHVAVSWDAYEAARGAHAVCILTEWDEFRRLDYQRMYDAMHKPAFLFDGRNVVDPDKLRRIGFVVYSIGKPLDHWLRDMPAVA

SEQ ID NO: 37602 - protein, 247 aa, Vitis amurensis
HEEFSASSSSSSSRTNPNSSDSLLPLQCIGHKRKAGRKKFRETRHPIYRGVRQRNGNKWVCEVREPLKKSRIWLGTFPTPEMAARAHDVAALALRGHFASLNFPDSAWRLPRPKSSSAEDIQVAALEATKAFNPTAPSSSSLASALDNMSGVADSKKVLETSPNVESPKLKSQRMVLEVSPVDTKRSEKVGDGSTTVFMDEEAMFNMQGLINSMAEGLLLTPPAMCKGFSWDDATDSHIDLSLWNDD

SEQ ID NO: 37603 - protein, 476 aa, Sphingomonas paucimobilis
MTAYPSLHMIIDGEAVTGGDRRTQTIVNPATGETLGELPLADTADLDRALETAQRGFQRWRNSTPQERAAVLSGAARLLMERQETLARIATMEQGKTLAESRIEVMMVAGLFNFYAGEVFRLYGRALVRPAGTRSTVTYEPVGPLAAFSPWNFPLGNPGRKLGAPIAAGCSVIMKSAEETPASALGVLQCLLDAGLPSDVAQAVFGVPDEVSRYLLASPVIRKLSFTGSTVVGKHLAKLAADDLKRTTMELGGHGPVLVFNDVDVDRVLEVMVGHKYRNAGQVCVSPTRFIVQEDVYETFRDGFAERAKALRVGNGLEDGIQMGPMANARRPDAMERLNRSAVDAGATLNAGGERIGNQGFFYAPSVLSDVPLDAEIMNEEPFGPVALINPYRTADEMIAEANRLPYGLAAYSWTNDVKMQRRIAREVETGMLGINSVAIGGADSPFGGVKWSGHGHEDGPEGVQACLVTKAVHEG

SEQ ID NO: 37604 - protein, 335 aa, Leptospira interrogans serovar Lai str. 56601
MKIGVIGSGSFGTALGSLLADKGYEVILWCRNDSQVESINRNHINNKHLPNFTLPEKLTASKDLRNVVQGKDMIVSSPPSHALSEVLREIKEYLPEKVPIVSASKGIENGTLRLVSEIFESELPEKYHSYLSYLSGPSFAKEIIQKVPTIVSIASKNETTARKVQEIFSFLYFRTYWTPDVIGVEVGGSLKNVIALAAGVSDGLGFGQNTRAALITRGLNEITKIGLKLGADPMTFLGPSGMGDLILTCCGEQSRNRTVGFRLGKGETLEQILSSMNEVAEGVKTTQSAYELSQKLGIEMAITNEVYKMLYEGKNPREVVKDLMKRDLKREGVSV

SEQ ID NO: 37605 - protein, 525 aa, Chromobacterium violaceum ATCC 12472
MDKILILDFGSQVTQLIARRVREAHVYCELHSFDMPIEEIQAFAPKAIILSGGPNSVYESDYQADPKLFELGVPVLGICYGMQFMAQTLGGKVESGDKREFGYAQIKARHHSKLLEGLQDQIDDAGNGFLDVWMSHGDKVTQLPAGFQVIAETPSCPYAAMADEARGFYGVQFHPEVTHTKRGTEMIHRFVLHVAGCKPSWTMPNYIDEAVKKIREQVGDEEVILGLSGGVDSSVAAALIHRAIGDQLTCVFVDHGLLRLNEGKMVMEMFAQNLGVKVVHVQAEADFMAKLAGETDPEKKRKIIGAEFIEVFDRESGKLTNAKWLAQGTIYPDVIESAGAKTKKAHTIKSHHNVGGLPEDMNLKLLEPLRELFKDEVRQLGVALGLPHDMVYRHPFPGPGLGVRILGEVKKEYADLLRQADAIFIEELRNTVDEKTGKNWYELTSQAFAVFLPVKSVGVMGDGRTYDYVVALRAVVTSDFMTAHWAELPYSLLGRASNRIINEVRGINRVVYDVSGKPPATIEWE

SEQ ID NO: 37606 - protein, 286 aa, Zea mays
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSSSRSRDRDDYHDYYYHYRSGSGSRRSSERHRSHDSDGSRRRRGRSRSRSRSPVREGSEERRAKIEQWNREREAAQV

SEQ ID NO: 37607 - protein, 237 aa, Erwinia carotovora subsp. atroseptica SCRI1043
MTTIQQNLQDIQQQITAAATHCARAPEEITLLAVSKTKPVSAIEEAIAAGQRAFGENYVQEGVEKIHYFQENQPNTPLEWHFIGPLQSNKSRLVAENFDWFHTVDRLRIAQRLSEQRPTTLPPLNVLLQINISNEPSKSGIMVDELTELAASVAALPNLRLRGLMAIPAPETDHERQLAVFKQMTALFQTLSVNYPHIDTLSMGMTDDMRAAITAGSTLVRIGTAVFGARDYSSPKA

SEQ ID NO: 37608 - protein, 273 aa, Erwinia carotovora subsp. atroseptica SCRI1043
MQQRKIAFIGAGNMAQAIIAGLVNGGYPAQHISVCAPSGKNRDVLAAQYGVISSADNVRCAQEADVIVLAVKPQMMATVCEPLHEQVNVAGKLVLSIAAGINIARFQALLGEPLNIVRIMPNTPSLVGKGMSGMYAPASVSQADKDFTAQLMQSVGKICWVDSEQGINSVIAAAGSAPAYFFLFMEAMQQEAIRQGFDQETARLLVQQAASGAAALVEANPDTPLSTLRENVTSKGGTTAEALRVFNEQQLTQTVAEAMQAAIARAQEMETLF

SEQ ID NO: 37609 - protein, 455 aa, Arabidopsis thaliana
MNPEEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGIEA

SEQ ID NO: 37610 - protein, 403 aa, Populus trichocarpa
MGFVTGQLVQPYQDRRNEGMLLIFTEFSPMADPSFEPGRPGESAVELGRIVDRGLRESRAVDTESLCVLSGKLVWAIRIDLHILDNGGNLVDAANIAALAALLTFRRPECTLGGDDGQEVTVHPPEEREPLPLIVHHLPIAITFAFLGSEGKMVVDPTHSEEAVMGGRMTVTVNAIGDICSIQKAGGEGVPQSVIMHCLQLASMSAESITKKINNAVEAYSTERALRKIKRHPTSAAGNVSVAGSDVKEQNKTVEQVGGSELSRHHMERLRLVSEETCSSRSNDNDGDIKSSEQGGTSGGESNAVSFLGGPSSWDPYLKGVDDDSLKPNVASRGISTQHMEQKESKENSPKMDTEKPTEDIKQATLATDTSGTALETNGEKTLKDAVKPKNKRRKRASSMNAS

SEQ ID NO: 37611 - protein, 256 aa, Chromobacterium violaceum ATCC 12472
MELGSVATFSLYPDLYARFRPSYPEELYDWLLPLCPGRQRAWDCATGSGQTAVRLGESFSRVDATDISSSQLSAAEPHTQVYYRECPAEVTPFDDDCFDLICVSQALHWFHLPSFWPEMQRVLKPGGIFAAWGYHHCVVSPEVDRACSVLWSIIEPFWSSRCQLLWDDFRGSGCPLPLLKAPSFTISSDWALDHFLGFLNTTSASKLCKQALGESILDDACQRITRAWGPRNQVRRVDLPLHLMVARKDDAGGYAG

SEQ ID NO: 37612 - protein, 334 aa, Glycine max
MMGDSEVAKFGLKVGKNEKNGFPRGLDPAISKFFVQLQSVVKSRLSRLAKQDGMSLMSSVQRKGDKSFSYSEAELNEQLQAWRENPSWVDKPPLIKVTAPKGSLCNLDVEVDVGLPPDAVYNIVIDPDNRRVFKNIKEVVSRKVLVDEGHRQVVDLDQAAIWKFLWWSGTISINVLVDQNRKDHSMKFKQTKAGFMKKFEGCWRVEPLFVDEAMCHPFKPVTKEDYYACARGKGRIGSKVSLKQTLQPSIVPPPPLSWYLRGITARTTEMLINDMLAETARIRGGYEAEKSKAEELQGKPGENVDLVSNTSDIKERWKLRRENAKHSHRRLLTK

SEQ ID NO: 37613 - protein, 328 aa, Salmonella typhimurium LT2
MPLHHLTRFPRLEFIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIAQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLASLEGVLLDPVYTGKAMAGLIDGISQKRFNDDGPILFIHTGGAPALFAYHPHV

SEQ ID NO: 37614 - protein, 216 aa, Arabidopsis thaliana
MAPPIEVSTKSYVEKHVSLPTLNERILSSMSHRSVAAHPWHDLEIGPEAPIIFNCVVEIGKGSKVKYELDKTTGLIKVDRILYSSVVYPHNYGFIPRTLCEDSDPIDVLVIMQEPVIPGCFLRAKAIGLMPMIDQGEKDDKIIAVCADDPEYRHYNDISELPPHRMAEIRRFFEDYKKNENKEVAVNDFLPATAAYDAVQHSMDLYADYVVENLRR

SEQ ID NO: 37615 - protein, 472 aa, Synechococcus sp. PCC 7002
MLSPTIFSGSLPGLTDFVPSLSLATTPEADYGSFVLTGVLMTLVVIYAMSKLGGELSKRVGLPPVLGELVGGVLVGVSALHLIVFPETGATAADSSLMLFLQQLGGLDGTALEHIFASQSEVISVLAELGVIVLLFEIGLESDLRELSKVGSQAAVVAIVGVVAPFLLGTVGLVTLFHTPIIPAIFAGAALTATSIGITSKVLSDLGQLKSTEGKIIVGAAVIDDVLGIIVLAVVASLAKTGEVDLLNVVYLIIGASAFLLGSILLGKFFNQGFEAIAAKLKTRGALLIPAFAFALVMAIIANLIHLEAILGAFAAGLVLDETDLRKELDRQVMPIADFLVPIFFVTVGAKADLGVLNPFESANRAGLVIAAFLIVVAIVGKVITGWAVFGQPGVNRLAIGFGMIPRGEVGLVFAGIGSASGVLDKPLEAAIIVMVILTTFLAPPLLQAVLNKPQDPDVPADREALEKSLSV

SEQ ID NO: 37616 - protein, 173 aa, Nostoc punctiforme PCC 73102
MDAIYIPQLTKAPERTEEVQVKEFLPGLETLTPVRGHVRVQHHGTYLEVSAQAETIITCTCNRCLQQYNRRLGLDTKEIIWLDETVNQANDLPLEREVIMEELLESLPPDGYFYPNEWLYEQMCLAVPQRQLCDRNCPGIPVSSTVDTSDDSPATPVDNRWASLEALKKQLPG

SEQ ID NO: 37617 - protein, 361 aa, Pyrococcus horikoshii OT3
MQAVLLAGGKGTRLLPLTVYRPKPMIPFFNKPLMEYMLMNLIGIGVEEIIVLVGYLKEKIIEYFGRGDKFGVEIKYSNGENIKLGTAGALKKAEKFIDDTFIVASSDVLTNLSFDSFIRFHREKGGIATMALTKVEDPTPYGVAVLDNENRILYFKEKPKREEAPSNLVNAGIYIFEPEILDLIPRGKAFDFSLDLFPKMLEEGIPIYGFPFDEYWNDVGRPSTYLQATEDVFLGKLRLPQINVGRDKGNIERGGSLFTGSKCLIRNPKIVGFAVLGNNVKVGRDVKIERSVIFSNVTIEDEVEIREAIIGENVYIGRGAVIEPGSVIGDNSVIEEYSKIGANVKIWTDSKVGRESIVLPD

SEQ ID NO: 37618 - protein, 482 aa, Pseudomonas syringae pv. phaseolicola 1448A
MLDVPLLIGGQSCPARDGRTFERCNPVTGEVVSRVAAATLEDADAAVAAAQAAFPAWAALAPGERRARLLKAAEQLQARSGEFIAAAGETGAMANWYGFNVQLAASMLREAASMTTQITGEVIPSNVPGCFAMALRQPCGVVLGIAPWNAPVILATRAIAMPLACGNTVVLKASELSPAVHRLIGQVLQDAGLGDGVVNVISNAPADAAAIVERLIANPAVRRVNFTASTHVGRIVGELSARHLKPALLELGGKAPFLVLDDADLDAAVEAAAFGAYFNQGQICMSTERLIIDRKVADAFVAKLSAKIETLRAGNPDDSESVLGSLVDVGAGTRIKALIDDAVDLGATLVIGGQLQGSILQPTLLDGVTDTMRLYREESFGPVAVVIRGEGDEALLRLANDSEFGLSAAIFSRDTSRALALAQRVESGICHINGPTVHDEAQMPFGGVKSSGYGSFGGKASVEHFTQLRWVTLQNGPRHYPI

SEQ ID NO: 37619 - protein, 566 aa, Synechococcus sp. PCC 7002
MQITNKIHFRNIRGDIFGGLTAAVIALPMALAFGVASGAGAEAGLWGAVLVGFFAALFGGTPTLISEPTGPMTVVMTAVIAHFTASAATPEEGLAIAFTVVMMAGVFQIIFGSLKLGKYVTMMPYTVISGFMSGIGIILVILQLAPFLGQASPGGGVIGTLQNLPTLLSNIQPGETALALGTVAIIWFMPEKFKKVIPPQLVALVLGTVIAFFVFPPEVSDLRRIGEIRAGFPELVRPSFSPVEFQRMILDAAVLGMLGCIDALLTSVVADSLTRTEHNSNKELIGQGLGNLFSGLFGGIAGAGATMGTVVNIQSGGRTALSGLVRAFVLLVVILGAASLTATIPLAVLAGIAFKVGVDIIDWSFLKRAHEISPKGALIMYGVILLTVLVDLIVAVGVGVFVANVLTIERMSNLQSEKVQTVSDADDNIRLTTTEKRWLDEGQGRVLLFQLSGPMIFGVAKAIAREHNAMGDCDALVFDIGEVPHMGVTASLALENAIEEALDKERQVYIVGAAGQTRRRLEKLKLFKRVPPDKCLMSREEALKNAVLGIYPHLADGVTAPSSEMG

SEQ ID NO: 37620 - protein, 334 aa, Pseudomonas aeruginosa PAO1
MTIRLAINGFGRIGRNVLRALYTGHYREQLQVVAINDLGDAAVNAHLFQYDSVHGHFPGEVEHDAESLRVMGDRIAVSAIRNPAELPWKSLGVDIVLECTGLFTSRDKAAAHLQAGAGKVLISAPGKDVEATVVYGVNHEVLRASHRIVSNASCTTNCLAPVAQVLHRELGIEHGLMTTIHAYTNDQNLSDVYHPDLYRARSATQSMIPTKTGAAEAVGLVLPELAGKLTGLAVRVPVINVSLVDLTVQVARDTSVDEVNRLLREASEGSPVLGYNTQPLVSVDFNHDPRSSIFDANHTKVSGRLVKAMAWYDNEWGFSNRMLDSALALAAARD

SEQ ID NO: 37621 - protein, 496 aa, Candida albicans SC5314
MTSTNKPPALKEDILELIGNTPLVKLNKIPQSLGIKAKVYAKVELFNAGGSIKDRIAKNMVLEAEKQGKIKPGYTLIEPTSGNTGIGLALVGAVRGYRTIITLPEKMSNEKVSVLKALGAEIIRTPTEAAWDSPESHIGVAKKLEKEIPNSIILDQYGNPANPDAHYYGTGYEIWEQTEGKITHLVAGAGTGGTITGISKYLKEKNSKIHVTGADPKGSILAEPESLNNSTEGYLVEGIGYDFIPDVLNRKYVDDWIKTDDAESFKLARRIIREEGILVGGSSGSALQAALQVAKDLTEDDTVVVVFPDSIRSYLSKFADDEWLISNGFEVEDSPGANKADEFLNGKTIKDLVAGKAPVVTVTLSDTVAKTFDLLQSNGFDQLPVLNNSGRLVGLITLSKILKSLSTKKIQTTNSISSIIIDFRKLADFEKSFTITKKSGFTKRSYEPIKLDTPLAALNKFFETNSNAIITDDELKPVQIVTKVDLLSYLTKNASF

SEQ ID NO: 37622 - protein, 545 aa, Oryza sativa Japonica Group
MELGLGMGMGLGDPPADYGSIAAVGMFVALICVCIVVGHLLEESRWMNESITALIIGLGTGGVILMVSSWKHSRILVFSEDLFFIYLLPPIIFNAGFQVKKKQFFRNFMTITLFGAIGTLISFSVISLGSLGLISRLNIGSLDLGDYLALGAIFSATDSVCTLQVLNQDETPFLYSLVFGEGVVNDATSVVLFNAMQNFDLANFSSVKFLQFIGNFLYLFATSTFLGVAAGLLSAYIIKKLYFGRHSTDREVSIMMLMAYLSYMLAELLDLSGILTVFFCGIVMSHYTWHNVTESSRVTTKHAFATLSFIAETFLFLYVGMDALDMEKWKIVGETFSPMKSIALSSTILFLVLVARAAFVFPLSFLANLTKKTEEGKISIKQQVIIWWAGLMRGAVSIALAYNKFTRSGHTQLPSNAIMITSTITVVLFSTMVFGLLTKPLIRLLIPARHLNRESSALSDPPSPKSFLDPLILNGSDVDPEIGVGIRRPTSLRLLLASPTQSVHHYWRKFDNAFMRPVFGGRGFVPFVPGSPTERSVPLLQGNEN

SEQ ID NO: 37623 - protein, 297 aa, Oryza sativa Japonica Group
MEDLSVEELASNLSTYKEQLREVRKIIKEKNDDPGISEYLDMEKELQEVITLTEELLATANQSGNTQNDVGLSPPNYSSGLQSEALDDPSQSHEKFAVGTKVQAVWSEDGEWYNATIEELTENGYYVSFEGWGNKEEVDPANVRSLEEEAADALRQAEKEAEATKMAIKRKIEQAATSDFQMRSLPTKLRIDPNDPEDVKATKRKKIHAFKSKARFEQLEFAQNKRQNAWQQFQTTKGKAKKVGFFSGRKKESIFKSPDDHRGKVGVTGSGKGLTEFQRREKHLHLKDGSSDALDEE

SEQ ID NO: 37624 - protein, 202 aa, Nocardioides sp. JS614
MSIPSLVTSALVAPTPGPVRWRHRLREDLRAARERDPAARSTPELVLAYPGLHAVWLHRLAHRLWHRPGGRLAARLVSHAGRALTGIEIHPGAEIGRRLFIDHGMGVVIGETAVVGDDVLLYHGVTLGSRSTAPGRRHPVVGDGVVIGAGARVLGPVVVGAGARVGANSVVVRDVAPGSTVLGIPARVPDAQLDDIDPALLI

SEQ ID NO: 37625 - protein, 485 aa, Phaseolus vulgaris
MAELVLFVSVPAAVLAFGVPAFFKVCTSEYRWRDVGLHGGRDWRKKTKLRFPPGSMGWPYFGETLQLYSQDPNVYFSTKHKRFGEIFKTNILGCPCVMLISPEAARFVLVTQAHLFKPTYPKSKERLIGPFALFFHQGDYHTRLRKLVQRSLSFEALRNLVPHVEALVLSGMNSWGDGQVINMFKEMKRISFEVGILTTFGHLEPRSREELKKNYRIVDAGYNSFPTCIPGTQYKKALLARKRLGKIISDIICERKEKKLVERDLLSCLLNWKGEGGEVLSDDQIADNIIGVLFAAQDTTASAMTWVVKYLHDEPKLLESVKAEQKAIHKSNEGNIPLSWDQTRNMRITHKVVLESLRMASIISFPFREAIADVEYKGFLIPKGWKAMPFGNGVHHACPGNEPQKCNPSRFYVAPKANTFMPFGSGGHACPGYELAKLEMLIMTHHLVTKFRWEAEGSNSGIQYGPFPVPVRGLPARFRKESTNF

SEQ ID NO: 37626 - protein, 323 aa, Leptospira interrogans serovar Lai str. 56601
MRLLITGGAGYIGSHVVALLLEKKHELVIVDNLEKGNRSNLFSETQLIQGNIQDESVLENAFSKPIDAVFHFAAWKAAGESMTDPSKYALNNINGTLKLLTFMEKAGTNQFIFSSSAAVYGSPEYLPIDEKHPVRPENYYGYTKLAIEQNLKWYETLKGFKFAALRYFNAAGYDPKGRVRGLERTPANLLPIIMEAAVGIRKDFEVFGTDYETPDGSCVRDYIHVTDLAKAHVLSLDYLDSEKKSLTVNLGSEKGYSVLEMVRLAEEVVGRSIPHKISGRRAGDPAKLLASSAMAQRLLQWVPEYSEAKTLLKTMWDVYQNPA

SEQ ID NO: 37627 - protein, 309 aa, Nocardioides sp. JS614
MNIYDDVTQLVGNTPLVRLNRVVGDAGATVLAKLEFYNPANSVKDRIGVAMIDAAEAAGVLAPGGTVVEATSGNTGIALAMVGAARGYRVVLTMPETMSRERRALLRAFGAELVLTPGSEGMTGAVRKAEEIAETTGAVPVRQFANAANPAIHRDTTAEEIWKDTDGEVDILVAGIGTGGTITGVGQLLKERKPDVQVIGVEPAESPILNGGAPGPHKIQGLGANFVPEILDTTVYDEVLDVPVEEAVTWARRAATEEGLLVGLSSGAAISAAVQVAQRPENAGRTIVVIVPSFGERYLSTLLFEGLVD

SEQ ID NO: 37628 - protein, 248 aa, Zea mays
LHPLRCSRFHRAVRNLTWPCRRWWSTAVVFPPVARPPGSAGSHFLGGAGVRGLEIGGNFIKFTAIGVYLEDAAVPALAKKWGGKTADELASDAAFFRDVVTGDFEKFTRVTMILPLTGEQYAEKVTENCVAFWKAAGLYTDAEGVAVEKFREVFKPETFAPGASILFTHSPAGVLTVAFSKDSSVPAAGGVAIENKRLCEAVLESIIGERGVSPAAKLSLAARVSELLAKETAAPADAPQAEPVSITA

SEQ ID NO: 37629 - protein, 402 aa, Micromonospora echinospora
MAGHGPPLAYLDNAATTQKPRSVLDAVVDFYTTANSNIGRGFYELSRRATGRYEEAREVVRRFVNAAHADEIVFTRGTTDAVNLLADTFAERIVGAGDDVVVTGMEHNSNLLPWRRLCERRGARLRIVPSPAGGPVRPEDLAAVLGRRTRLVAVSHVSNVLGTVNPVRELVRVAHDRGVPVVVDGAQAVAHLPVDVREIGADFYCFSGHKVYAPMGSGVLYGRRELLADLPPYQVGGGTVKGVSHDAPVSYVPVPARLEAGTPDIGAAVGLAAALTWLDGLDREAVRAHDADLVRYAVDVLCDVDRVRVVGDPAADPAGIVSIAVDGLHPYDVGGHLDAHGIAVRSGVHCASAFLDDLGLLGTVRLSFAVYSTRGEVDRVAEALRTVRAGEWTTRYPDIRFR

SEQ ID NO: 37630 - protein, 256 aa, Arabidopsis thaliana
MAAKPGAATPTYSPKIVGRSRLPIFKDSDLDWSRPDGRGFHQCRPALLQTGAVSSASGSAYAEFGNTKVIVSVFGPRESKKAMVYSDVGRLNCNVSYTNFASPTLGQGTDHKEYSSMLHKALEGVIMMETFPKTTVDVFALVLESGGSDLSVLISCASLALADAGIMMYDLITAVSVSCIGKSLMIDPVTEEEGCEDGSFMMTCMPSRYEITQLTITGEWTTPNINEAMQLCLDASSKLGEIMRDCLKQSASASDE

SEQ ID NO: 37631 - protein, 473 aa, Legionella pneumophila str. Paris
MSSQHTDKTLIKWIDNLIDEQSFLPIGSEYIPDNTPHSLPGAEVITGLAKVNQRPVAIYAHDSSVNRGYVTRQGARKIIHLMDKAEKLRIPIVAFLASPGVSLEENLLSGDEYTQIIARNIRLSGIIPQFAVILAPTLGAPAYSAVLMDLLFFNKHRSYLMVTSPTVVQQAIGEKVTMGELGSATLHATTTGIADFVDDSVTAQINHVKAILGFFPLHTNERPPVHPIMEPNHPIPDIPANPRMPFNMLNLIQAVVDNSNVIQYKRTYGQAMICAFVHIHGFAVGVVANQSIRYSGAIDSDAAQKAAKFIRICDAYSIPILTFIDVPGFMPGKREEQKGLLQHGARFCVAMQTRVPRLSVIVRKCYGAAAFLMMQTKSQNGDLVLALETANLGVMGKETTNKVQAMDGQPVQESSQSQLTEKSQIDDSLMEAYSLGLIDEIIQAAQIRSRLASHLEFLYRRMETMPPAKHSIV

SEQ ID NO: 37632 - protein, 224 aa, Oryza sativa
  misc_feature (152)..(152): Xaa can be any naturally occurring amino acid
  misc_feature (178)..(178): Xaa can be any naturally occurring amino acid
  misc_feature (199)..(199): Xaa can be any naturally occurring amino acid
RLFFFFSFCWKCAVVSLALICSFARMKSHLGRDAAVKPETVPEETVLAVAEVLRRSQMLRISEDGKMVGRASELLKADEIIKQVDSRTVAASPLPYNVELEDVQSFFAQYAKVNSVRLPRHIANKKHFCGTALVEFSEDDEAKMVLENNLFXFARANLEIKLKKDFILSPQSYKEAFXKAPSMKDEPTESHPNGLLLAXKLRRITLIVCCTHPTLSCTEITSSP

SEQ ID NO: 37633 - protein, 658 aa, Bacillus anthracis str. A2012
  misc_feature (598)..(599): Xaa can be any naturally occurring amino acid
MIEKYKHGKVKKLFEVKTLILLQVNALSKLYGAETILANIKLEVQTKDRIALVGRNGAGKSTLLKIIAGELSHDGGEIIKPKDVSMGYLAQNTGLETSLTIWDEMLTVFTHLQQMETKLRRLEQEMGKEENFSNEATYERLLADYDQLQLDYKDQGGYQYEADIRSILSGLGFPVETHQTTISTLSGGQKTRLALGKLLLTKPDLLILDEPTNHLDIETLTWLEQYLQGYPGAILIVSHDRYFLDKLVTQVYEISNKESRRFVGNYSKYLDLKSALYEQEMKRYEKQQDEIAKLEDFVQKNIARASTTKRAQSRRKQLDRMELLTRPLGDSKSASFHFDIEKQSGNDVLQVKDATIGYDKDPIIEHVTMRLTRGDSVALVGPNGIGKSTLLKSIVNKLPLLHGDVSFGSNVSVGYYDQEQANLTSSKRVLNELWDEYPLQPEKEIRTILGNFLFTGDDVLKPVSSLSGGQKARLALAKLMMQKSNLLILDEPTNHLDLNSKEILENALIDYPGTLLFVSHDRYFINRVTTTVIELSTEGAQEYLGDYDYYVEKKNEMIERAELEQEDETPVQKTVAQEKLNYLEEKERKKLERQRTRXXEELEQNIVQFEEEIATLEDQLCLPEIYADYEKASEITTKKQTLQEQLDACMAEWEELHV

SEQ ID NO: 37634 - protein, 176 aa, Physcomitrella patens subsp. patens
MAIGIGRSLSAPLLVINFMLYLVSACLAGWALNRNLGATIGIGAGPIGNIVTPTFLPLALIASMVGLASVFAGINHLRVFRSDSLSSAASTSLIAWLLTLLAMGVACKEIHTGGSNRQKRIRALEAFIIILALFELLYLLSLQAGLFGTSDGGYDETRSANAKTSTTYGTPTAAAV

SEQ ID NO: 37635 - protein, 544 aa, Physcomitrella patens subsp. patens
MESLDPAARFSGGSVVMSSEFFAKRGSECVGVLSSSGVGLESTLAANSWCVLISWMKQLEVVEEEPSKASGNGGEDACLVTQVPGWRNPCFASRIPSTDATFSKLVKREKPVILKILEGEEFFLEILGSNDETGVMIIILRCAEARLVYLHLVSNTTDWVEQALKVTTHASQKHILRRQCPLLVERLSWSWWGHWAKVVNTLSCQERTDELVWWPPRHRCRVTLSRALASSTDEAWHRWVLFRGFLQHVIASPAAPADVANDPWTSEGAMPALGVSGCSYIASWLLSSRTGVSISYGCSAKFQVCDVACCVFIYKHQQRDLWNDGECWVGQRAGYAASGYQFRLVLGTLMRPSTAVKAQSVRSSMATLRCSCFRCKSPGRNNVTQGFFLPVALIACMVGLASVLAGLHHMRVFRSESLAAAAATSLIAWLLVLLAMGLACKQIHTGGNRPRRLKVVEAFIIILALFELLYLLSLHLGFGRAGSHHGAGTGIGMGGVGHGHGHGHGSHDPSIPAHNHEHHVDYGRHTDMKIPVGHVHNPAHPTTV

SEQ ID NO: 37636 - protein, 329 aa, Oryza sativa Indica Group
MSAGWWGPQDLGAGTLSLISPTDIRPGFLPVFRSGSCADIGTKSYMEDEHVCVDNLIEHLGVRTPVIPAPGAFYGVFDGHGGTDAACFVRKNLLRFIIEDGHFPSSIEKAIRSAFVRADHAIADSHSLDRNSGTTALTALIFGRTLLVANAGDCRAVLGKRGRAVELSRDHKPSCRSEKIRIENLGGTVFDGYLNGQLSVARAIGDWHVKGSKGSISPLTAEPEFQEVRLTEEDEFLIIGCDGLWDVMTSQCAVTMVRKELMTHNDPERCSQELVQEALRRNSCDNLTVLVVCFSSDPPPQIEVPRFRVRRSISMEGLHMLKGALDSNA

SEQ ID NO: 37637 - protein, 392 aa, Oryza sativa Japonica Group
MAGKENAAAAQPRLTRAAAKRAAAVTAVAVAAKRKRFALSELPTLSNNKAVVLKPQPAPRGGKRAASHAAEPKKPAPPPAPAVVVVVDDDEEGEGDPQLCAPYASDINSYLRSMEVQAKRRPAADYIETVQVDVTANMRGILVDWLVEVAEEYKLVSDTLYLTVSYIDRFLSAKSINRQKLQLLGVSAMLIASFTHQFKNRYLLRIGLVDPGKYEEISPPNVEDFGYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 37638 - protein, 160 aa, Aspergillus niger
VAIKKMTPFDHSMFCLRTLREMKLLRYFNHENIISILDTQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAID

SEQ ID NO: 37639 - protein, 326 aa, Mesorhizobium loti MAFF303099
MNKPVTSARVPGRGRIYSSITDTIGDTPLVRLDKFAKEKGVVANLVAKLEFFNPIASVKDRIGVAMIEALEAAGKISPGKTTLIEPTSGNTGIALAFAAAAKGYKLILTMPETMSVERRKMLALLGAELVLTEGPKGMKGAIAKADELAATIPNAVIPQQFENPANPEIHRKTTAQEIWNDTQGEVDIFVAGIGTGGTITGVGQVLKKLKPSLHVVAVEPEASPVLSGGQPGPHKIQGIGAGFAPKILDTTIYDEIIKVSNEDSVANARLVARLEGVPVGISSGAALQAAIVVGSRPENKGKTLVVVIPDFAERYLSTILFEGLGA

SEQ ID NO: 37640 - protein, 486 aa, Pseudomonas syringae pv. phaseolicola 1448A
MTSQSLNSHRVDPDTAQKFYIDGRWSAPLNPASIAVINPATEEVVAHVASGSAADVDRAVAAARAAFASWSGTSVHARAEIIGRIHELILERKEQLAQAISLEMGAAINSARAMQVPLAAEHVRVARDLLATYRFKSVESGTAIEREPIGVCGLITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFAKAVPPGVMAAFRNVGQSCSAPTRMIVPRNRLAEVEALAAETAKAIIVGDPQREETVLGPIANEAQFHRVQAMIDAGLSEGAKLVCGGPGRVQGHEQGFYTRPTVFSEVDSSMRIAREEIFGPVLCLIAYDTVDEAVAIANDTVYGLGAHVQGQDLEQARSVASRIRAGQVHLNYPAWNPMAPFGGYKRSGNGREYGVHGFEEYLETKAIVGFG

SEQ ID NO: 37641 - protein, 190 aa, Candida albicans SC5314
MTSPKRRIEKDVMELMMSDHDVTLIDDSIQQFFVIFHGPPDTPYEGGVWKIRVELPDQYPIKSPSIGFTNKIYHPNIDEGSGSVCLDVINQTWSPMFGLLNIFENFLPHLLRYANPSDPLNTEASNLMTKDEAKYNDTVKKYVQQYAKNNFDITGKDDNEDNDDDDDELSDVGSLSSDDDNEDVAGSMEV

SEQ ID NO: 37642 - protein, 363 aa, Oryza sativa
LSLIGLVPLAERLSFLTEQIAFYTGPTVGGLLNATFGNVTEVIIALLALREGKIEVVKCSLLGSILSNLLLVLGTSLFLAGIANLRAHQPYDTKQAHVNTALLMLAVLCHSLPLMLRYAVTSGDHAIVSGDALTSTPPSSCSPSSATPCSILMLIAYLAYLFFQLNTHRQLFEPQQVEDDDDDDLVIAQDDEPVLGFSSAMIWLALMTLLTALLSGYVVSTIEAASESWELSVSFISIILLPIVGNAAEHAGAVIFALKNKMDITLGVSLGSATQISMFVVPVSVIVAWTMGIPMDLDFNLLETGSLFLAILVTAFTLQEGESHYLKGLILVLCYAVISVCFFVIRRRSAGGTDGVHHLDVIV

SEQ ID NO: 37643 - protein, 220 aa, Triticum aestivum
MAQQQSLIYSFVARGTVILAEFTDFKGNFTSVAAQCLQKLPSSNNKFTYTCDGHTFSYLVEDGFTYCVVAVDSAGRQIPMAFLERVKEDFSKRYGGGKAATAQANSFNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 37644 - protein, 509 aa, Candida albicans SC5314
MITKRLYSTIESSKKVLGTLSNPNLVKTEAYINGKWVPSSSGETFTVTNPALYPNPESELATMQSMSEEDFNSAIESADIAFNKFKKTTGRYRSELLLKLYNLMISNKDDLAKLVVLENGKPYADALGEVNYAASFFQWFSEEAPRIYGDIIPSANGTNRILTFKQPIGVCGILTPWNFPLAMITRKLGAAIATGCTAVIKPASETPLSATALAFLAEEAGFPPGVINVLPSADASGSGKYLTEHPLIKKVSFTGSTPVGKILMNQSASTLKKLSFELGGNAPFIAFDDVDVDKAVNGAIASKFRSSGQTCVCANRIFVHEKIYDEFAKKFVDKLKNETVLGNPLASGVTHGPVIHDRSMKKVRQHIEDAVDKGATILLGGSKRPDLGENFHDLTVLGDVTTEMLITQEETFGPVAPLIKFKTDDEVIKMANDTTVGLAGYFYANDVAKVFKIAEALNVGMLGVNTGAISEAALPFGGVGESGFGREGSKFGVEDYLVIKSAVLGGIEN

SEQ ID NO: 37645 - protein, 170 aa, Zea mays
GEPPPVPCRVPGKWGPVPGGLGPAPRGFGFFPGGGPKRVLRFPGLGDVFPWSGGSPKPLGNLVRAPFVCLLKPWGFLPPDFWGRPRFSLTPFPRYRALRGRPPRGFGLGAPPGPVGAWGGLCCLKAPFLFWLRPVAPFGFCFPRGVFCPPPLDIPALFFFRWGPPIPPHS

SEQ ID NO: 37646 - protein, 154 aa, Vitis vinifera
MDETKNRQKKGLMKKTWEQFKSFGHRRILSRTHHSSMKSKSRPGHTASLEGVKKGRVAPEGCFSVYVGHGKQRFVVKTEYANHPLFRALLEEAELEYGYNNGGPLVLPCKVEIFLKVLLEMDSSDEVHQGCSFARSPSSYRLLGPSRMITMNHL

SEQ ID NO: 37647 - protein, 327 aa, Arabidopsis thaliana
MEAMQSQTVDVVKRMKEITLVMQTPEQVLVEHGVTPEDIQDLLDELQEHVESIDMANDLHSIGGLVPLLSFLKNSHANIRAKAADVVSTIVQNNPRSQELVMETNALESLLSNFTSDTDIHARTQALGAISSLIRHNKPGVTAFKLANGYAGLRDALASDSVRFQRKALNLLQYLLQEDDSDRSIATGLGFPRVMMHLASSDDAEIREAALRGLLELSREKNDGSSSIDKSDEKLRQLLEERIKGITLMSQEDLETVKEERQLVDLLWSICYNEPSSLREKGLVVLPGEDALPPDVASKLFEPPLRASAANRNATEKKDEPMKLLGP

SEQ ID NO: 37648 - protein, 463 aa, Oceanobacillus iheyensis HTE831
MIQDKKISSKFIYFFGAFGGILFGYDIGVMTGALPFLQSDWNLQNDPTAIGWITSSLMLGAIFGGALSGQLSDRIGRRKMILIASIIFALGSIMAGISPHNGILFMIVSRIILGLAVGAASALVPAYMSEMAPARLRGRLSGINQTMIVSGMLLSYIVAFVLKDLPETMAWRLMLSLAAVPALILFFGVLRLPESPRFLIKNNKINEARKVLSYIRPKEKIESEISQIQASTKYEEKASQKTSWGTLLSGKYRYLVIAGLGVAAFQQFQGANAIFYYIPLIVENATGNAASSALMWPIIQGIILVLGSLLFLLIADKFNRRTLLTLGGTVMGLSFILPAILNIVIPNASPMMIVVFLSIYVAFYSFTWAPLTWVIVGEIFPLVIRGRSSGLASSFNWIGSFLVGLLFPVMVASMAQEAVFAIFGAICLLGVLFVRLCVPETRGRSLEEIEKIGESKQLHKKTV

SEQ ID NO: 37649 - protein, 188 aa, Triticum aestivum
MGSGSFLKVLVSNLDVLAGPIVSLAYPLYASVRAIETKSPIDDQQWLTYWVLYSFITLFELTFAAVIEWLPFWSYGKLFFNCWLVLPYFNGAAHVYEHFVRPMIVNQQVVNIWYLPKKEGSDKPDDVISAAQKYIEQNGSKAFETLVNKFKTTNARRSILEEVEAERRARAERELEARDVNPFFHPNY

SEQ ID NO: 37650 - protein, 480 aa, Neisseria meningitidis MC58
MKQLAMYINGRFENDFNGEWRDVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 37651 - protein, 374 aa, Oceanobacillus iheyensis HTE831
MQVKTAVLRTQGADSPYKESKPIKIETLELDAPQLGEVLIQIKAASLCHSDLSVINGSRPRPLPMALGHEASGVVVEVGEGVTYLEPGDHIVCVFVPSCGHCVPCKEGRPALCEPGADSNTAGTLISGGIRLHADGEAINHHLGVSAFSEFAVVSRNSLVKVKKDIPFEKLALFGCAVITGVGAVVNTANVKLGSTVAIVGLGGIGLSALLGAVAAGASRIIAVDINENKLKQAKELGATDVFNSTEETVIQQIKEATDGGVNYAFETAGAVPAMEVAYGITKRGGTTVTTGLPHPEHQFSFPYVTLTAEEKTLKGSYVGSCVPDRDIPRYMNLFKQDRLPVDKLMTDFISLDEINEGFDKLAKGDSSRIIIKM

SEQ ID NO: 37652 - protein, 535 aa, Arabidopsis thaliana
MSSELQISPAIHDPQGQEKQQQAAGVGILLQIMMLVLSFVLGHVLRRHKFYYLPEASASLLIGLIVGGLANISNTETSIRTWFNFHDEFFFLFLLPPIIFQSGFSLQPKPFFSNFGAIVTFSVLGTFVASMVTGLLVYLGGVMFLMYRLPFVECLMFGSLISATDPVTVLSIFQELGSDVNLYALVFGESVLNDAMAISLYRTMSLVRSHSSGQNFFMVIVRFLETFVGSMSAGVGVGFTSAHLFKYAGLDVDNLQNLECCLFVLFPYFSYMLAEGLSLSGIVSILFTGIVMKHYTYSNLSANSQRFVSAFFHLISSLAETFVFIYMGFDIAMEKHSWSHLGFIFFSILFIVIARAANVFGCGYLVNLARPAHRKIPMTHQKALWYSGLRGAMAFALALQSVHDLPEGHGQTIFTATTAIVVLTVLLIGGSTGTMLEALEVVGDSHDTSLGDGFEVVNSRYMTSYDDEDTPPGSGFRTKLREFHKSAASFTELDRNYLTPFFTSNNGDYDDEGNMEQHHEERIPFTRRGNLNNRG

SEQ ID NO: 37653 - protein, 508 aa, Chlamydomonas reinhardtii
MVSLGLETVLAGTPSNICKTKVVCTLGPKSRSVEVLEELLRAGMSVARFNFSHGSHDYHQETLDNLRQAMANTKVMCAAMLDTKGPEIRTGTLKDGKPVQLTAGQEVTITTDYALPGDEKTIAMSYKKLAQDVKPGSQILCADGSIVLEVVSTDPAAGTVRARCMNSAMLGERKNVNLPGVVVDLPTLTDKDVDDLINWALPNDIDFIAASFVRKGSDIDTIRQVLGERGRSIKIISKVENQEGIQNFDDILAKTDSVMVARGDLGMEIPTEKIFLAQKMMIQKCNYAGKPVITATQMLESMIKNPRPTRAEATDVANAVLDGTDCVMLSGETAAGNFPVEAVKVMTKICREAEASLDYYAMFKNILKQAPMPMSPLESLASSAVRTAHKVHASLIVVLTREGSTARLVAKYRPLVPVLTVAVPVLTTDSLTWTCSGEAPARQCLVTRGLIPVLAEGSARATDSDTTDEILAAAIEHAKRARYCAKGDSIVALHRIGNASVIKIVDIK

SEQ ID NO: 37654 - protein, 513 aa, Streptococcus pneumoniae R6
MSILEVKNLSHGFGDRAIFEDVSFRLLKGEHIGLVGANGEGKSTFMSIVTGKMLPDEGKVEWSKYVTAGYLDQHSVLAERQSVRDVLRTAFDELFKAEARINDLYMKMAEDGADVDALMEEVGELQDRLESRDFYTLDAKIDEVARALGVMDFGMDTDVTSLSGGQRTKVLLAKLLLEKPDILLLDEPTNYLDAEHIDWLKRYLQNYENAFVLISHDIPFLNDVINIVYHVENQQLTRYSGDYYQFQEVYAMKKSQLEAAYERQQKEIADLKDFVARNKARVATRNMAMSRQKKLDKMDIIELQSEKPKPSFDFKPARTPGRFIFQAKNLQIGYNRPLTKPLNLTFERNQKVAIIGANGIGKTTLLKSLLGIISPIAGEVERGDYLELGYFEQEVEGGNRQTPLEAVWNAFPALNQAEVRAALARCGLTTKHIESQIQVLSGGEQAKVRFCLLMNRENNVLVLDEPTNHLDVDAKDELKRALKEYRGSILMVCHEPDFYEGWIDQIWDFNNLT

SEQ ID NO: 37655 - protein, 428 aa, Bacillus cereus ATCC 10987
MVAEKGTQTKTQQQREQHFELLNSTQIVISEALEKLGYPNEVYELLKEPVRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRDIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAGGVTVSYFEWVQNNQGYYWTEEEVEQRLEKVMVRSFDSIYETAQVRKVNMRLAAYMVGVRKMAEASRFRGWV

SEQ ID NO: 37656 - protein, 175 aa, Triticum aestivum
MLRAGGSRLVAPGLRRLLGPGAGERPAPGLAAAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 37657 - protein, 388 aa, Fusobacterium nucleatum subsp. vincentii ATCC 49256
MVRNYMAIIYLAENKENISPLTKVRALASIPVGGSYRIIDFSLSNVVNAGIRNVGLFCGNEELNSLTDHIGMGAEWDLARKKDGIFIFKQMLDSNFSLNQSRIRKNMEYFFRSTQKNIVVLNAHMVYNLDIADLIEKHEASEKEITMVYKKVKNANEHFNHCSSVKIDENNRVIGIGQNLFFKEEENISLDAFVLSKELMLKLLVDSIQEGKYNILSEIIARNLPSLNINAYEFKGYLQCINSTREYFDFNMNLLNQEVRDDVFGLKSGRKILTKVKDTPSTFFKETADVENSLVSNGCIIEGTVKNSILSRGAIIEKDVVLEECVILQDCHIKKGAHLKNVIVDKNNIIHENEKLSASREYPLVIEKSMKWNTKQYQDLMDYIRNKE

SEQ ID NO: 37658 - protein, 384 aa, Fusobacterium nucleatum subsp. vincentii ATCC 49256
MRMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDKKGWYKGTANAIYQNIKFIEEYDPEYVLILSGDHIYKMNYNKMLQFHIQKEADVTIGVFKVPLKDAPSFGIMNTNDDMSIYEFEEKPKEPKSDLASMGIYIFNWDLLKEYLDEDEKNPNSDNDFGKNIIPNMLNDGRKLFAYPFKGYWRDVGTIQSFWDAHMDLLSEDNELDLFDKSWRVNTRQGIYTPSYFEKGSKVQNTIIDKGCLIEGEIKHSVIFSGVKVGKNTKIIDSIIMADTEIGNNVTIRKAIIANNVKITDNINIGDGEKIAVVGEKKIIDSQSLVK

SEQ ID NO: 37659 - protein, 764 aa, Sinorhizobium meliloti
MPGIDKTDRAMTSVTAQEALDFHSQGRPGKLEISPTKPMATQRDLSLAYSPGVAVPVKAIADDPATAYDYTARGNMVAVISNGTAILGLGNLGALASKPVMEGKAVLFKRFADVDSIDLEVDTENVDEFVNCVRFLGPSFGGINLEDIKAPDCFIIEQRLREVMDIPVFHDDQHGTAIIAAAGLVNALTLTGRDFKTAKLVCNGAGAAAIACIELIKAMGFNPENIIFCDTKGVIYKGRTDGMNQWKSAHAVETDRRTLAEALDGADVFFGLSAKGALSADMVRSMGARPIIFAMANPDPEITPEEVALIRDDAIVATGRSDYPNQVNNVLGFPYIFRGALDVRASTINDAMKIAAAEALANLAKEDVPDDVAAAYQGNRPRFGPQYIIPVPFDPRLISAIPMAVAKAAMETGVARKPIEDLKAYGQQLSARRDPIASTLQRIVERVRRQPKRIVFAEGEEVQMMRSAIAYANQQLGTALLLGREEVMRETAEREGIDLDRAGIQIVNARLSKRVGAYTDFLYSRLQRKGYLFRDVQRLINTDRNHFAASMVALGDADGMVTGLTRNYSTALEDVRRCIDPKPGHRVIGVSIALCRGRTVLVADTAVHKHADLRGAGAMLAYSTFGHPSGERSERVREAVKILDRRRVDFEYDGEMAADVALNARVMEQYPFCRLSGTANVLVMPAFHSASISTKMLQELGGSTVIGPLLVGLDKSVQIASMSAKDSDLVNLAAIAAYNAGTRRGSAESRKTAGTSSVAASPDG

SEQ ID NO: 37660 - protein, 145 aa, Zea mays
ARSRGRPGRAGISKNSHWLLTLHCTTGSFPCDLAPPSSAPAKMCTVTRAHLDQRLAAAKRCSREAAIAGAKAAAVATVATAVPTLASVRMLPWARAHLNPTGQALIISTVAGMAYFIVADKTIVSMARKHSYEDAPEHLKNTSFH

SEQ ID NO: 37661 - protein, 326 aa, Bacillus cereus ATCC 10987
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVENVQKDGEAFQVETTKRDGSREIYIAKYIVVATGYYDNPNYMNVPGEELKKVAHYFKEGHPYFDRDVVVIGGKNSSVDAALELVKAGARVTVLYRGSEYSPSIKPWILPEFEALVRNGIIDMHFGAHVKEITEHTLTYTVDGEAYTIQNDFVFAMTGYHPDHSFLTKMGVRIDEETGRPIYAQDTMETNAENIFIAGVIAAGNNANEIFIENGRFHGDAIAQTIATREI

SEQ ID NO: 37662 - protein, 193 aa, Picea sitchensis
MASAIMSSAAAMAAVAAPPKTSNGNGSSNGNVVSAFTGLKSTAQFPSSMKISNAGAEWERKTTSNGGRVRCMQVWPPYNNPKFETLSYLPRLTQEQLLKEVEYLLRNKWVPCLEFDEDGIIKRKYGSTPGYYDGRYWVMWKLPMFGCTEASQVLNEVNECAKAYPKAFIRVIGFDNVRQVQCISFIVHKPEYN

SEQ ID NO: 37663 - protein, 191 aa, Cryptococcus neoformans var. neoformans JEC21
MMRNTILRSTAAMASTSFARPAVRARPVLAAARTMGAGAGVSKRGYHAKVIDHYENPRNVGNLPKGDFDVGTGLVGAPACGDVMKLQIRVGEDGVISEVKFKTFGCGSAIASSSYMTERVKGMTLDQAGAVKNTEIAKELCLPPVKLHCSLLAEDAIKSAIKDYQTKRAQRLASANATLASSSSQPQQAAA

SEQ ID NO: 37664 - protein, 516 aa, Zea mays
MEAAAAVTPLALLLLLLLVTRWRWSSSRNSKLPPSPMALPLIGHLHLIRRLPHRSLDRILARYGPLVYLRLGPSTHCIVAGTADAARDLLKHEASIPQRPLTVVARHLAYDDAGFAFAPYGAHWRFMKRLCMSELLGPRTVDQLRPVREAELAAVLGAAASASASGEGEPIDVSRHLISMSNNAIMRMVASALPGHMTEAARDCAKHVAELVGAFNIEDYVGLCRGWDLQGLTRRTRQVRDKFDALLEMMITAKEEKRRRRQQGQGDHHDLLDILMDAAADENAEVRLTRENIKAFVLDIFTAGSDTTATSVEWMLAYLINHPACMDKLRAELDGVVGASRLVGEQDVPHLPYLQAVFKETLRLQPPAVFAQRETVDTVRVRGYVIPPKTSVIFNVFSIGRDPGWWEDPLQFRPERFMPGGAGAGIDPKGQHMQLIPFGSGRRACPGMGLAMQAVPAFLAALVQCFHWAVPIQQGQSKAPPLDMEEAPGLVTARKHPLLLIPTPRLNPLPLQATAT

SEQ ID NO: 37665 - protein, 944 aa, Cryptococcus neoformans var. neoformans JEC21
MSSLASAPPTASIPASDSYNSPVQSSGPGLSNGNSTPSKWKSVFKLGRTATIGRGKENRSALGGESFVLDNKEQQSFAGEVSPAVPTEPYLPPRKTQLRAHTDPYPPKSPSVKNNPGSVSVEHFDSKVLHEEGMPKTREEGSSESFNVHLNSSNGNLQTTSTSGEQSRPYSSVTDSASASTTERTSHSSGGHFLPGDGSLHGVASSNTYGTASTRSPTGGPLGIGNLKSRFFSAPLSAPAGKNKHDKSKSEKYRGLGKVATDFPQSTAPPSSAGGASSSGGGRKKSDGSSSLSSRGAASPRTPAKSKREPSANSSRRMPFGQTNDNGSNSGSVAARFLRRVVSAPNTKALFSNNLFSNAPDVPPLPAPKNQPNSSTSSKEKSSSPVVIVGNSGGHIDLTSSPDSDHPPSISPLSNSSTMYTSQTSHTPSASASATPTPSPLKQKNHFLSPTASPSPGQGSGLSAKGTRASRSLTTGTAPVLKNIRQLQGYSGSSPGGGGYMDGESRHKQVFKRTYSSNSIKTKQVEVTASSFQKIKLLGKGDVGKVYLVREKKTDKLFAMKVLSKKEMIKRNKIKRALAEQEILATANHPFIVTLFHSFQSQDYLFFVLDYCMGGEFFRALQTRPGKCLSEEHAKFYAAEVTAALEYLHLNGYIYRDLKPENILLHQSGHIMLSDFDLSKQSGEAGGAPAAIRHGGPNGQTILVDTRSCIADFRTNSFVGTEEYIAPEVIKGHSHSSAVDWWTLGILVYEMIFATTPFKGPNRNATFANVMKNEVLFPESVPVSSNCKSCIRKLLIKDENKRLGSASGASEVKQHKWFASVNWGLLRNMTPPIIPEESNGIDTINFRPLRESKSIDFDRDDITTDIIHAKAGSPSVSGNSTPGMLTPKELVQTTSSSSPIGGGAGGTSGHSSSAMPIPGSMRGYDKEKNPFGEFSSVTRDFGEC

SEQ ID NO: 37666 - protein, 327 aa, Nostoc punctiforme PCC 73102
MRKKLQQISKPLLKTFLALGLVLTLVLSHADGALAARSGGRIGGGSFRAPSSRTYTPRTYAPPGGGGYYPGGGFGGGFGFPFLLPFWGIGGGFGGLFSILIFFAIANFLLQTFRRVSGGETPEADYSSNSPVSVTRLQVGLLAQARELQNELNHIAETADTNTPEGRAEILQEASLALLRHPEYFVYAGGGTQQASLNSAESQFNRLSLAERSKFSEETLSNVNNQLKAALAKEALPPAGELDNPTRLFTEGPGEYIIVTFLAATLGKFDIPTAINSADDLRQALRQIGSIPSEKLLAIEVLWTPQAENDTLTSDDVLANYPDLRLV

SEQ ID NO: 37667 - protein, 446 aa, Bacillus pumilus SAFR-032
MEKKVSSKFIFFFGSFAGILFGYDIGIIAGAEGHIQQEFQLSPLWLGIVVSSLMGGAIIGSILSGLLGDKFGRRKLILVSSVIFFVGAIGSAIAPEEISLTIARIFLGTAVGTASSLVPAYMSEIAPAKIRGKLSGLNQLMIVSGLLLSYIVAFVFEPIPDSWRWMLGSAALFAIVLYIGMLKLPESPRYLIKHGMAHKAREVLGSLRSSREEIEEEMQEILEVAKEERSGIRELFQKKFRMALFIGVGMATLQQIQGANSIVYYATSIARNVGLAPQVAAGFTVIVGVIFVVTTVIFLQFVDRFDRRTILTVGGTGMALSFFAPAALGALGVSEGILNWVTLISLCCFILCYAFSWAPITWIIIGEIFPLSVRGIGAGISSAFNWTGSLAVGLVFPILADKFSFGVIFSSFGVICLIGLLFTRFVLVETKGRSLEQIETDMAARV

SEQ ID NO: 37668 - protein, 2828 aa, Bdellovibrio bacteriovorus HD100
MNCTFLNTIYLTQQAKRLLLSFSLMVLAGCSLELQIAAENSTPTTLKWSSDSLGQQGLLKAEWILPEKADIKEQQVLYFRGDSCATPILPVANVGPAETSHLPTFTPEDGVEYTFKVFVLSKDGSVASSSCSNPITYFGAFSIESLSQSIINEGNVTAAPFKGTCLLGSSIEFSAAATPLLTFTCSDRQWTQNLDFSSLPNLYSGDLIATVTAPGGTPKEYRLAITKDVVPPTITLNALSTITSVNQNAYTVSGTCSETGHNVSVTAGAVSAEVVCSGGTYSTSMNLSSLSGTSVVVSATHTDPVANTRTATSTVSRDVTGPAVNSLALNNGDAATNTLSATLNSSVTDAAEMYLSSVAACTGGSWVAYNAAAPWTLTNSNATNTVYAKFRDSLGNESPCVSDDILHDNVAPTLAFTLPVSGTIINSDNVNAFTVSGTCSENNRSVNFSGPGGFTGTTICTGSAFSAILDLSALPQGTFQLTASLNDVAGNSNTANSPTYNKDTQAPTGTLSINSGSATTNDLAVSLGLTSADAAEMYVTNTAGCATGGTWESFATGKSWTLPTADALNTVSVKFRDAAGNSSVCYDDSITHNSTVPSLSLASPADGSFVNLANVSAFVISGACSEDGRPVEISVTGQSATTATCSSGAWTKTLDLSTSAQGDLTFTLNHSRASGATAPTVTKVFAKDTVVPTVDSFVINNNDAYATSLSATLASTTTDGVQMYATNTALCLNGGTWETYNASKSWTLPTANNTNTIYFKVRDVAGNESDCAFDSIIHDSVSPTVTLTSPVAGTFINSLNQTALNLSGACSENGRLVNLTVTGHAGVTGSATCTTGSWTASLDFSSLADTSGTPFTVVASHSRVSGNNATASSTYPKDTQSPGAATITGAPTGTNSTSTLNITVGGTDITHYRYFIVVPGGTEVCTNSTAYTGSDIPVATKITDTLTEQGAYKLCVFGRDTAGNWSTATSQATWTRDTQGPVILTVDATTADGVYGPGQSVQVRVTFDENVTVTGTPQLTLETGTTDRVVNYSSGSGTTQLLFTYVVQTGDETPDLDYTSTTALALNGGTMRDALSNNATLTLPAPGTANSLAGTKNIAVEAYSSPLAKAILSNTPMGADSSDTLNITVSGLDVVSYKYKLGLSGSVDCSTYTDYSAEIPVATPITDTISAHPKYSFLKICVLGKDSTGKWQKAFAVTQAQWHYVENLPSFNLCGTVKSSTAPKGRLYDSGGPTANYSDNETIANCYFSINTGAAISATVSYDTENNISYDFLRLRETGAAGSVILGPVAGTVTNTAVNSTSGTLYAEFKSDGSVVGAGVILVWGGAPNLTPTMTLTNVTNATVNTVYSRVAAAYGLSTATVISVSGYDSEIRNVTTSSDFSSSVLVNPGDAVEVRMTSPNATDQYRLAHVRAGDASYYWMVATPLLPTTVTHVTATNPDGTYKPGDNIDIQVVFTKPVTVLGTNPVMTLAAGSGVTATYLSGSGSTELIFRYTVAYEHSAADLDYSSTTLTNAASIKDAMGSNATATLPAIGSANSLAGRKNLVIEGYPFVVATASNVPASNNSTTTLDATVGGTNVVSYKYKLGTSATTDCTVATGYGSETAISSNITADLSAFANERLKLCILGKHTNGTWQALWHPTEYQWDRFNVQNFSSMCSATATTATTGFIYDSGGASGQYQNNENCQFEINTGAPISLTFMAFNTEASWDKLSVYDGTTAGTLLLNQVSGTNIPATQTANSGKMTIKFTSDGSAIRDGWVAYWGNPGPILTTPPTFAKIHNAALNTRYATANTTISSLNQTAIATVTGADAQIRNITTGSYWGGSVAVSSGQVIQLRMTSPAANAQTNTATVTIGNAVSTWEISTPYPPPTPTLTGYPVGTSTTSTLNVTVSGFRVTQYKKAIITSGTCAAATYSAAYNTSTNITDNISALPNGPVTLCVLGGDATNLFQAAADAVSVTWTKDSISAVNITSTRMNRVQEGSGPRTINVSLTPAKSYDVTTYYKVTGDAVNPDHHDLSSGFITFPAGSTTATITVNFPDNSLVEGEKLLNLHFTHTDSPLATMGDNYQTQYFIADDEKNLKASQLSMARGHQCAIMEDSSLRCWGTNMYRQIDGSVSDFKASPFVINIAGVTGYRSVSTGEFHTCTVTLDNRLFCWGNSSDGQAGGGTTGNQWSPLHVDNTTTYLSVTSGDYHSCAITTANKLKCWGKNDYGQLGVNDTTLRTSPTDVDNANSYKFVHAGSRSTCAIRSDDKLFCWGSNVNYQLGDGSATARGVPTAIDAAESYKSVAIGSKHACGITLTNNLKCWGTNNYGQVGDNGVTTRTTPVSVSGSEVYKTVSVNDDGNIATARGFTCAITSNDVLQCWGVNSLIQLGNGTSNMQYVPATSDAGTTYAAIQTSGSRACGITLTGALKCWGNLLGDTSPQSSYSYGSGNARHQYAEKMTKASEWTFDTLSVFGADAIDDHYSGTCGISSNKLYCWGSMKATEGPFGDGSQTDARRPAPVMIDPSTNYSYIHTRRSHDFCAITSAGQMKCWGINNYGELGEASAVSATVHTPTVADSTTTYTKVVSFNHATCGITTTGVLKCAGNNDNGRLGLGDTTARTGFTVVDSGVSYSDVEMGMSHTCGRTTAGVLKCWGSNTQGQIAKASGTSAYYLPDVVDSGVTYTKIATGSFNSCGITSANKLKCWGANFLGQLGDGTSASRYTPTAIDASADYSDISMASGHTCGITAGQIKCWGNATYSGLAAPQYTGGHTVYMSPMVVDGANTYTKVWAANSSTCAKATSGEVRCVGRAYGGNFGYVDSAVLMTIGSGITKIIYTPTFIHKWQGY

SEQ ID NO: 37669 - protein, 371 aa, Candida albicans SC5314
MSIPVSMKAIVFYAPYDVRTEERPTPKIKDPKDVIVKVRYSGLCGTDLHSYRGHIKGPVGTIIGHEFVGTVVATGDNITKFSIGDDVISNFSIECGECWYCKHGYSGQCNVTNTFGKVGLDGGQAEYVRVPYAETTLTKKPSTTNSNDDVDDSVYVLMADIFTTGYYGVKKIKDFLSISAAEGIKPQSFEETTILQLGAGPVGLCALRILKYFGFGKVVVVDNVPSRLEEAKRLGATKVINFETEPDGIKKYITEETDGVGFDAVLEVVGSAAAHKTSFDAVRRNGFISSIGMGHEPFPFNGLDVYLKNINMSFGRCHSWSLFPESLAIFEEMKGDLASFIDYKAKLEDSKEAFDMFDKHKVKKIVFDLTS

SEQ ID NO: 37670 - protein, 172 aa, Picea sitchensis
MMASAEVEYRCFVGGLAWATDDRSLQDAFSPFGEILESKIISDRETGRSRGFGFVTFSDEQSMRDAIDAMNGKVLDGRNITVNPAQSRGNGGGGGGGGGRGFRGGGGGGYGGGRDRPDRGYGGGRGGGGSGGYGGRGGYGGGGGSRYGGGGGGGYGGGGYGGGGGSEGAWRR

SEQ ID NO: 37671 - protein, 240 aa, Magnaporthe grisea 70-15
MSRATPRKSRHRRDASGGGGPSGHHLPKTVATSDYESDAVHYLETRTPAVTEAALLPRLNRTNTEINLSVLQRWLPNIRSIASIAANAVVYAFSPTTHEWDKAGIEGAMFVCDQDPTELGMPRSCVYLLNRRSLDNLHIDLAAVSHFEVQNELLIFNLGDKVLGLWIHADQEDTRDTNAATIQERWARVRAAAVPVGQAEAQKTGGTSAAGETMGPAMQAIGRRLSISDLFGRARDTADG

SEQ ID NO: 37672 - protein, 519 aa, Ipomoea nil
MATLTLIFCTLVFAIFLYFLILRVKQRYPLPLPPGPKPWPVLGNLPHLGKKPHQSIAAMAERYGPLMHLRLGFVDVVVAASAAVAAQFLKVHDSNFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPVLGWFDVQGIVGKMKKLHARFDAFLNTILEEHKCVNNQHTTLSKDVDFLSTLIRLKDNGADMDCEEGKLTDTEIKALLLNLFTAGTDTSSSTVEWAIAELLRNPKILNQAQQELDLVVGQNQLVTESDLTDLPFLQAIVKETFRLHPSTPLSLPRMGAQGCEINGYFIPKGATLLVNVWAIARDPNVWTNPLEFNPHRFLPGGEKPNVDIKGNDFEVIPFGAGRRICSGMSLGIRMVHLLVATLVHAFDWDLVNGQSVETLNMEEAYGLTLQRAVPLMLHPKPRLQPHLYTLN

SEQ ID NO: 37673 - protein, 323 aa, Pyrococcus horikoshii OT3
MVKSVTDKIKFYEFEGGLSVFKKYGVPIREEDLEEIRKMDAILFGATTTPFDVPRYKSLIITLRKELDLYANLRIIPNFKLRKEIIIVRENSEGLYSGEGAYDSNKVVDFRIITRKGAERIAKFAVKLAKDRSTFLTFVHKANILESDRFFRKIVLDIARKEDVKVREEIVDSFTIKLVKDPWNLGIILSENMFGDILSDLATIHAGSIGIVPSGNYGEDIALFEPIHGSAPDIAGKGIANPIGAILSAAMMLDYLGLDGSIIWKAVGRYVRRGNLTPDMEGRATTLEVTNGIISEIYRLDEYEIDEVWRDEVRLGRILLEIS

SEQ ID NO: 37674 - protein, 522 aa, Ipomoea tricolor
MATLTLILCTLVFAICLYFLILRVKQRYPLPLPPGPKPWPVLGNLPHLGEKPHQSIAAMAQSYGPLMHLRLGFVDVVVAASAAVAAQFLKVHDANFSSRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGSSKSDPKAEEFKSMVEEMMVLAGSFNIGDFIPVLGWLDLQGIVGKMKKLHARFDAFLNTILEEHKFVNNQDTTLFKDMDFLSTLIRLRDNGAAMDGEDGKVTGVTDTEIKALLLNLFTAGTDTSSSTVEWAFAELLRNPKILNQAQQELDLVVGPNRLVTESDLTQLPFLQAIVKETFRLHPSTPLSLPRMGAESCEINGYFIPKGATLLVNVWAIARDPNVWTNPLEFNPHRFLPGGEKPNVDIKGNDFEVIPFGAGRRICSGMSLGIRMVHLLVATLVHAFDWGLVDGQSVDTLNMEEAYGLTLQRAVPLMLHPKPRLQPHIYTLN

SEQ ID NO: 37675 - protein, 309 aa, Triticum aestivum
  misc_feature (232)..(232): Xaa can be any naturally occurring amino acid
MAGLSLEHPWAFAFGLLGNIISFTSLLAPIPTFYRIFKSKSTEGFQSVPYVVALFSAMLWIFYALVKTGEGLLISINAAGCVIETVYIVMYLVYAPRKAKIFTAKIVVLLNVAGFGLILLLTLFAFHGETRVISLGWICVGFSVCVFVAPLSIIGRVIKTKSVEYMPFSLSLTLTLSAVVWFLYGLLIKDKYVALPNILGFTFGMIQMVLYMFYMNATPAVSNLKEGKQGLXEAAEEHVVVINVGRSKRAPRCGSPGHRDAKAIPANGLLKGRPQGTSDAPDYARSAKCSELRLQACSSPWSVKQTLGC

SEQ ID NO: 37676 - protein, 314 aa, Glycine max
MEKPGGGGVLSAKEAFEKLEKVGEGTYGKVYRAREKAMGKIVALKKTRLHEDEEGVPPTTLREVSILRMLSRDPHVVRLMDVKQGQNKEGKTVLYLVFEYMDTDLKKFIRSFRQTGQTVPPQTIKSLMYQLCKGVAFCHGHGILHRDLKPHNLLMDPKTMMLKIADLGLARAFTVPIKKYTHEILTLWYRAPEVLLGATHYSMAVDIWSVGCIFAELVTKQALFPGDSELQQLLHIFRLLGTPNEDVWPGVSKLMNWHEYPQWNPQSLSTAVPSLDELGLDVLSQMLKYEPSKRISAKKAMEHVYFDDLDKRHL

SEQ ID NO: 37677 - protein, 519 aa, Trametes versicolor
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTTSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 37678 - protein, 120 aa, Zea mays
  misc_feature (86)..(86): Xaa can be any naturally occurring amino acid
SVFSKYSLKPLVPRLSELIGVEVGMANDCIGEEVEMLSVDMPEGVELVLEKVRFYKVEKYNEAEYAKKLTFVGDIYGKKTLGIAHXAYVLIEGVTNYFKPLIDGLCYLYRTLFFFVGNYF

SEQ ID NO: 37679 - protein, 318 aa, Persea americana
  misc_feature (151)..(151): Xaa can be any naturally occurring amino acid
DIIKNAAEIIAKTSFGMNHQYAERVFEKLKAMQVTLYRSGRLLGVPFGRLVYLKQTLEERKLGKEIDDLLLSIITARKASHIAEPPKDLLGLLLPDNHVNELLGKKLSPRELVDECKTFFFGGHETTALASLWTLFLLAKQPKWQTLLREXIMEVTGGEPLDFTMLPKLEKMGWVMNEVLRLYPPAPNVQRQVREDIQVGDTIIPKGTNIWIDLVGMHHDPALWGEDVNEFRPERFKEDVLYGGCKHKMGYLPFGFGGRMCVGRNLALMEYKTVLSLILTRFSMSLSPNYLHSPTHLLSLRPSCGMPLILQPITPNHP

SEQ ID NO: 37680 - protein, 186 aa, Magnaporthe grisea 70-15
MGGQLSKMMGKIFGSKEMRLLMLGLDAAGKTTILYKLKLGQDVTTIPTVGFNVETVTYKNVKFNVWDVGGQDKIRPLWRHYFSGTQGLIFVIDSSDRKRMDEARQELHRIINDREMKDSLLLVFANKQDLENAMKPQEVTEALQLSKLKDKIWYVVPSCATTGEGLLEGLAWLSNNVKAPPAPAKK

SEQ ID NO: 37681 - protein, 643 aa, Ralstonia eutropha JMP134
MIRIDQLVLQRGTKVLFDHTSVTLNPGERVGLVGANGSGKSTLFAMLRGELHADGGDVTVPAQWRIAHVAQETPAVARSAVEYVIDGDTRLREIEAAIAEAQAVGDGSAEGEAHAAFADADGYTAPARAEALLLGLGFTLPQVSQPVSSFSGGWRMRLNLAQALMCPSDLLLLDEPTNHLDLDAIVWLEDWLARYPGTLVMISHDREFLDAICNVTVHIENQQLRRYGGNYTLFETLRLQQMAQQQAAYTRQQKEIAHLESFITRFKAKATKARQAQSRVKALEKMERLAPVHVAAGFAFEFREPDAAPNPMMVLDGVDCGYAEADPPATILHKLALSIQNGQRIGLLGANGQGKSTLVKTLAGTQDPLTGTLRLGKGLQIGYFAQHQLETLRDHESPLQHLARLAPDTREQELRDFLGSFNFRGDMATAPIEPFSGGEKARLALSLIVWQKPNLLLLDEPTNHLDLDTREALTMALAQFEGTLILVSHDRHLLRATADQFMLVADGTIKPFDGDLDDYRDWLLQQAAAKRNAAVAAHQGETGGNAAAVNRKDQRRAEADERQRLAQLRKPLTKELEKVEKRMTVLQTAKAEIDQFMADETSYAEANKSKLMEMLKRQGEVNGELETLEEKWLELQEQIEQIE

SEQ ID NO: 37682 - protein, 474 aa, Triticum aestivum
MDYGPSDSSGTDDDLPPPYPNNPNNRSIRGSGRASGNGRAIVPVSGNGRAIAPASSYPRAQTDMETQIQQLEQEAYCAVLRAFKAQSDALTWEKEGLITELRKELRVSDKEHREVLNRVNGDDIIRSIREWRSTGGLQASLPNNPQPIHHDPAPSPTTSGRKRQKTSQSVPPLPVPSPPVMHPQQMATPTQPSSSAAKKGFLPGTKGKKTKPGQKIPGGPAVKSMPPSAGPSGRGPHMNRNFPGRPAAPEPSQGQHHLNPLIGRKVMSRWPEDNNFYEATITDYNAEKDVYALVYDINTANETWEWVDFKEIKPEDIIWQGEDPGLYQGGRGAPGSGGKKSTSRVMPTPGTGRGRGFQKNVSKKDFPRSQNGVGKRSSDDIDILHTESLIKEVERVFSVSHPDPLEVDKAKKALKEQEQSLIDAIARLAEASDGESDERNRGRRMGPYGGHPHQGNYADAMAVDGDHMVGGAAT

SEQ ID NO: 37683 - protein, 448 aa, Streptococcus pneumoniae R6
MREYDIIAIGGGSGGIATMNRAGEHGAQAAVIEEKKLGGTCVNVGCVPKKIMWYGAQIAETFHQFGEDYGFKTTDLNFDFATLRRNRESYIDRARSSYDGSFKRNGVDLIEGHAEFVDSHTVSVNGELIRAKHIVIATGAHPSIPNIPGAELGGSSDDVFAWEELPESVAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTRNRQESRFKLITAGSEEKVVGLHGIGYGVDEMIQGFAVAIKMGATKADFDATVAIHPTSSEEFVTMR

SEQ ID NO: 37684 - protein, 429 aa, Arabidopsis thaliana
MVNPEENNRNLVVKPITEILQDDDKRSRKFGVEMKRQNRRALGVINHNLVGAKAYPCVVNKRRGLSQRKQESCDKKKLDSLHPSISRSQEETKKLKPSGNEFGDCIFIDEEEEKNEEVTLDQPMPMSLEEPYIEFDPMEEEVEMEDMEEEQEEPVLDIDGYDANNSLAAVEYVQDLYDFYRKTERFSCVPLDYMAQQFDISDKMRAILIDWLIEVHDKFELMNETLFLTVNLIDRFLSKQAVARKKLQLVGLVALLLACKYEEVSVPIVEDLVVISDKAYTRTDVLEMEKIMLSTLQFNMSLPTQYPFLKRFLKAAQSDKKLEILASFLIELALVDYEMVRYPPSLLAATAVYTAQCTIHGFSEWNSTCEFHCHYSENQLLERCRRMVRLHQKAGTDKLTGVHRKYSSSKFGYIATKYEAAHFLVSDSH

SEQ ID NO: 37685 - protein, 488 aa, Rhizobium leguminosarum bv. viciae 3841
MLLSSIRRDWSANPMREMLAGAVATFALIPEVIAFSFVAGVDPEVGLFASFVIGIVIAFTGGRPAMISAAAGSVALVAAPLVHAHGLPYLFAAGLLAGMMQIVFGLLRLGVLMRFVSKSVRTGFVNALAILIFAAQMPHIIGVGWMEYALLIAGLVIIYLTPRVTTAIPSPLICILILTVTSIALGLPVLTVADLGKLPDSLPVFGWPAVPLTLETLRIIAAPALAIAMVGLLESMMTASVVDDLTDTPSSKNRECTGLGLANAAASLFGGIAGCGMIGQTVSNVKYGGRGRLSTLFAGAFLLILMVLLKPWVSEVPVAALVAIMVMVSIDTFDWSSLRAVIVHPRMSSAVMVATVLVTVFTANLALGVTVGVLLSGVFFTFKVASLLRVDVAPDQAAGRLIYRVSGQVFFASADVFVEAFDVQDAVGKAVLIDVSEAHFWDITAVAALDKVVQRFRAHGIAVEVAGLNQASATLIGSLDSKVVLKEV

SEQ ID NO: 37686 - protein, 443 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVRQACKRGGKETKQIEEDGLVDVDGEKSKLAEDLSKIRMVESLDASASKELVDCAEEDRSDVTDCVQIVDIDSGVQDPQFCSLYAASIYDSINVAELEQRPSTSYMVQLQRDIDPTMRGILIDWLVEVSEEYKLVSDTLYLTVNLIDRFMSHNYIEKRKLQLLGVTCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNKTLQHYTRYETSALKNAVLAMEDLQLNTSGSTLIAIRTKYNQQKFKRVATLTSPERVNTLFSR

SEQ ID NO: 37687 - protein, 326 aa, Bdellovibrio bacteriovorus HD100
MKQVTVSAPSNIALIKYMGKIEGSGNKPTNGSLSYTLENLRTYVRLTEVDGAQDQWKPLVREDLQKIELSEKGQQRFIKHLQNLKDKWGIKQSFLIESANNFPSDCGLASSASSFAALTLAAAEMFQQINPQPWGTDKKYLSELSRQGSGSSCRSLFTPWALWQHEYAEPMAFEVKNLHHMVVIVEDSKKEVSSSEAHKLVTTSPRFTGRPERAELRLKDLSMALQFNDWHIARQIVWDEFIDMHRLFETSTPSFTYMNDGSKKVLEDCQAFWNKWQDGPLVTMDAGANVHLLFRHDQKKQFAQYREHFEKDFKVMAFEGVKDNVH

SEQ ID NO: 37688 - protein, 311 aa, Rhodococcus sp. RHA1
MTLDPDMAVLLDKLNDWDAAAGAQTTIEGARKRIEEMRALYFEPELLEVREVENVTVPGPAGGIPARIYRPDTEESTLPTVLYLHGGGWVMGGLDSHESHARRVCARTGSVVVAVDYRLAPEHPFPAGYDDCLVSLHWIHDTIDQLGGDASRVAVAGDSAGANLAASVALAARDAQLPLRAQLLLYVPVHFAKRYPSMDELADGYFLRMPANEDMGAGYLEDRRLSSDPRVSPIEGDLTGVAPAIVCGAECDPLRDHAPAYAAALEAAGVPVRLRISPGMLHGYWSMGVVPRANDLANQLCEELAELLTPE

SEQ ID NO: 37689 - protein, 264 aa, Novosphingobium aromaticivorans DSM 12444
MTTPALSPALTPDRLDRFARHIVLPEVGAIGQARLAASHVVLVGMGGIGSPALQYLAGAGVGRLTLIDDDVVEASNLQRQTIYTEEDLGKPKAQAAAAWVARFDPALEVVHHVTRIGRENAADLIAGADVVLDGSDNFATRLSVSDACVSVGVALSSVALGRFQGQVANFAGHRPGEACYRCFVGDAFDAEDCDTCADLGVLGAMVGMIGAFGAMAAMRVLLEGVSTLGDPQWGQLHVFDGLKPSLRTMRIARDPECRGCTSGQ

SEQ ID NO: 37690 - protein, 299 aa, Mesorhizobium loti MAFF303099
MSEKQILIFGAGYSGKAFARANRDAATILGTTRSREKFAALRQAGITPLLFDGALTGEIGEALQKTTHLVISVAPEEAGDPVLNAAREAIAGMPALEWIGYLSTVGVYGDHGGAWVDETAACRPVSKRSVMRVEAEQAWLKLGKEIGKPVAILRLSGIYGPGRNALVNLENGTARRLVKPDQVFNRIHCDDIAGALWQLIDGNTGGIFNVTDDEPAPPQDVVAYAASLMGVEPPPEIPFDTAQLSPMARSFYGENKRVANAAIKAAGYSLRFPDYRAAFDHMWASGDWRDGEARSPMKR

SEQ ID NO: 37691 - protein, 457 aa, Legionella pneumophila str. Paris
MLNPREVRTIEDAKRIVEERQLTHVKVGLFDIDGVMLGKYMRRNKFFSALEHGFAFCDVILGWDSKDKLYDNVKYTGWHTGYPDASVRIIPSTCREILFEENQLLFMAEFSQAAEAICPRGILRRVINKSAGMGYDVYAALEYEFFVFDETPDSVRAKGFRNLKPITPDNFGYSIIRNTVHAEFYHQILTMAEKMDFPIEGLHTETGPGVLEAAIAVDDAEAAGDKAALFKTFMKILAQRNNKMATFMAKWSGDYPGQSGHIHLSLRDRDGGKSAFYESGREYNMSKIQRHFLAGQQKLMPEFLAMLSPTVNSYSRLIPGYWAPTEATWGVENRTTALRVIPGSDKSQRIEYRLGSADANPYLALAAAIGSGLYGIENELEPEAEVKGNSYEQDHSPELALPRTLWESAQNLKNSSAAYELFGQEFVEHFAASREWEEREFRKHITDWELDRYFEII

SEQ ID NO: 37692 - protein, 206 aa, Mesorhizobium loti MAFF303099
MSRTLVLVRHGQSEWNLKNLFTGWRDVDLTEQGHAEAKAAGQKLKARGLKFDIAFTSALSRAQKTCQHILDAVGQSDLKTIRDQALNERDYGDLSGLNKDDARKKWGEEQVHVWRRSYDVSPPGGESLKDTGARVWPYYLHDLQPHVLRGGTVLVAAHGNSLRALIMALDGKSGEEIVKLELGTGVPVIYQLNADSTVASKEVLEG

SEQ ID NO: 37693 - protein, 298 aa, Oryza sativa Indica Group
MLPYATAAEAEAALGRAMTAAESLWFRYSAGIPDYVLFWHNILFLFVVFTLAPLPVALLELRAPAAVGPFKLQPKVRLSREEFFRCYRDVMRLFFLVIGPLQLVSYPTVKMVGIHTGLPLPSLGEMAAQLLVYFLVEDYLNYWIHRLLHGEWGYEKIHRVHHEFTAPIGFAAPYAHWAEVLILGIPSFVGPALAPGHMITFWLWIVLRQMEAIETHSGFDFPFNLTKYIPFYGGAEYHDYHHYVGRQSQSNFASVFTYCDIYMEPTKYHKAYQAKMKALGQTEGEKADSNGLSYAKLD

SEQ ID NO: 37694 - protein, 255 aa, Oryza sativa Indica Group
MSSRSPPPKDRRIRTERTSYRDAPYRRDSRRGPSRFPNDLCNNCKRPGHFARDCPNVALCHACGLPGHIAAECSSKDLCWNCKEPGHMANSCPNEGICRNCGKSGHIARECSAPPMLPGEMRLCSNCYKPGHLAAECTNEKACNNCRKSGHLARNCPNEPVCNLCNVSGHLARECPKSDAINERGGPPPFRGGAPPPFRGGYSDVVCRACNQVGHMSRDCMAGAFMICHNCGGRGHMAYECPSGRLMDRFPPRRF

SEQ ID NO: 37695 - protein, 525 aa, Campylobacter upsaliensis RM3195
MVEVKNLTMRFANQLLFENVNLKLTRGQRYGLIGANGAGKSTFLKILSKELEASSGEVCFDEGLRVAVLGQDQFAFENYTIKDAVMCANKRLYEALKEKEKLYLSEEFTDEINERLGELEMITAEEDPNYDCETRCEKILSSLKIKDFNALMSSLQSADKFKVLLAQVLFLGADVLFLDEPTNNLDLEAISWLENELLRHDGTLVVISHDRHFLNKICTRILDVDFKQIRDFAGNYDEWYMASTLLAKQAELKRDKTLKEREELENFIRRFSANASKAKQATSRTKALEKLELEEIKISSRRDPSIVFRPMREIGNEVLEFKGISKAYDKALFSNLELKIEKGDKIALIGANGVGKSTLAKIIAGALKADSGLVHLGATIELGYFPQDTSNIICENLKLYEWLMSEKFKDLDEIRKCLGRMLFSGTEQEKSVGSLSGGEKHRLMLSRLMLERGNFLLLDEPDNHLDLESIIALGEALYRFKGVVLCITHDRELVSAFANRIWHLEEGGLTDFRGSYEEFLGENNG

SEQ ID NO: 37696 - protein, 572 aa, Burkholderia vietnamiensis G4
MTTTQTRPEAGPQRAEHFAALDAAAPSPPRRVGLDALAGLSIAGLLIPEAVAYAGLANLPPQAGLIALLSGLVIYALTGSSRFAIVSSTSSSAAVLAATVLSESGLALAAQLALAAALVTVTGVLFILSGAARLGGMSDFVARPVLRGFTFGLALTIVIKQLPKILAVSVRHGDAPHVVLELVRGAPQANLASVALGAAALALLFALGRRSRVPATLVVIVLSIVAGYLVDWQRYGIAVVGHIDFRHIEFGLPRLDRNAWMQTVELAFALMLILYAESYGSIRNFALKHGDSVSANRDLVAIGCANLVSGLLHGMPVGAGYSATAANEAAGAQSRFAGLWAAAVVALIVGLLLPQLARTPEPVLAAIVIFAVSHSLHPSIFRPYWVWHRDRLVVIAALLAVLVLGVLHGLLVAIGVNLLLTLRKLSEPNVSVLGRLRDGHDFVDVANHADAKPVPGVLIVRPEAQLFFANADRMLNRVRALMKDAPDAHTVMLSLEETPDVDGTTIESLRTFAAECAARGLRLAIVRLKAHALNALRRAADDTLRDDAMSELSVDESLQLLQARGRDGASGG

SEQ ID NO: 37697 - protein, 1035 aa, Rhodopseudomonas palustris CGA009
MRHRTGHDRSQINLALVGYFGPLSLHLSTPFAGLGPICAVTMYRIVRREQFSDATFLWDVEAPDIAASAEPGHFVMLRLYDGAERIPLTVADFDRDKGLVTVVVQALGKTTREMRDKFKEGEAFEDFVGPLGLPQHIDKVDHVVFVGGGLGVAPIFPQLRAFKQSGARTTAIMGFRTKDLVFWEDKFREFADELIICTDDGSYGEPGLVTAALERVITQQKPDKVVAIGPMPMMHACVETTRPHGVKTMVSLNTIMVDGTGMCGSCRVTVGGEVKFACVDGPDFDGHKVDFHELHARQKRFKTEEDKANEHFAHVCNLEKQLIVEGKRNYKKLATLPPHQTPMPERDAHERATNFKEVNLGYSVEEALQEAERCIQCITPTCVAGCPVGIDIPVFIRNILFRDFDAALETIYQSSIFPSICGRVCPQETQCEAQCIIRKYKKHEPVAIGRLERFIGDNARAPKSKPIDLSKAIGKVAIVGSGPAGLAAAADLTRYNVETTVYEALHVLGGVLQYGIPSFRLPRDIIDREIQRLKDIGVKFETNKVVGKTFTIEQLMNGRGFDAVFVAAGAGAPTFLGIPGEFAGRVYSANEFLTRINLMGGDRFPYLDTPVSVGNSVIVIGAGNTAMDCLRVARRVGAATVRCVYRRSEAEAPARIEEIRHAKEEGVDFFFLHSPVEILVTESGDVRAVRLQKMELGEADERGRRKPVPLDEFIELECDTVIYALGTKPNPIIGQATPGLALNKWGNIAADDDTQSTNMPGVFAGGDIVTGGATVILAMSAGRRAAKSIAAWLRLNKTKWPITAQDADDFVAGKLAPAIEEDGVAHCPKCHQPLEGSEEYICCADSELQWRCDDCAKVSEGFAFPYGMCPHCGGKLQPLDRAGVSDEAGLGAIRTAFEIELGGRAFYARAAKETSDPTLQELFLSFAAMEEEHMTTLANRYHVAIPQATEGFHLGTAAIMAGVKGRIGDPTTLFEAAIEFERRAASFFKTRVGETPDGSVERQLYRELAAEEDEHVSVLQTEFARWKEGKRGLLT

SEQ ID NO: 37698 - protein, 332 aa, Oryza sativa Japonica Group
MAASTSQHALVSVKSLCTGANFGFEKRTSKVRFVLVGRCCSGTRKLGLVCASNSHSSVMEPAQLPLSPESGNTPKKSSESALILIRHGESLWNEKNLFTGCVDVPLTPKGVDEAIEAGKRICNIPVDVIYTSSLIRAQMTAMLAMMQHRRKKVPIVVHSESEQAHRWSKIYSEETKKQSIPVITAWQLNERMYGELQGLNKQETADRFGKEQVHEWRRSYDIPPPNGESLEMCAERAVAYFKDQIVPQLVAGKHVMIAAHGNSLRSIIMHLDKLTSQEVISLELSTGIPMLYIFKEGKFIRRGSPAGPSEAGVYAYTRSLAQYRQKLDNMFQ

SEQ ID NO: 37699 - protein, 340 aa, Erwinia carotovora subsp. atroseptica SCRI1043
MTDVKSDKNNTISADSRASSLNRFSIAPMLDWTDRHCRYFLRQLTSQTLLYTEMVTTGAILHGKGDYLAYSEEEHPLALQLGGSDPQALAQCAKLAEQRGYDEVNLNVGCPSDRVQNGRFGACLMGDAALVADCIKAMKDSTSIPITVKTRIGIDDQDSYEFLCEFIQTVAERGECDTFIVHARKAWLSGLSPKENREIPPLDYPRVYQLKRDFPALTIAINGGVKTLEEAKMHLQHLDGVMMGREAYQNPGILAQVDRELFGIDAATQDLAGVVRSMYPYIERELSGDASLGHITRHMLGMFQGIPGARQWRRYLSENAHKPGADSAVVERALALVNLV

SEQ ID NO: 37700 - protein, 104 aa, Brassica rapa subsp. pekinensis
YSSMFHPFNGSMDAEERRHISSTTEHSAIDNHCSANSSSVGRTQQSLQREAALNKFRMKRKDRCFDKKVRYESRKKLAEQRPRIKGQFVRQVQSTETSTQEAPQ

SEQ ID NO: 37701 - protein, 462 aa, Erwinia carotovora subsp. atroseptica SCRI1043
MRSIKRLPMPPTRGVLGHVDYLKRSDIHLQMLRWKAQYGCFFRLRLGLSSAVVIADTEWIRTIMKSRPDEFRRISSIESVFQEAGLNGVFSSEGERWELQRKLTEPMFQPAHLKYFYSSLRKVTSRLSERFTMLAETGEAIALVDEFKRYTVDITSLLAFGEDVNTLEQGDNPLSQSLRHLFPIINERCESPIPVWRYIRRARDKQFDASLNLIREYVDGFISRQRQRIQLNPQLLEAPENMLQVMLAEQQKDGTLKDDDIVANAITLLIAGEDTTANTLTWMSFLLCSAPSVEECVFQECKEAAEGVGAILPWPLPRMAWLTAVMYESMRLKPVAPLLYLEPTRDTVIDDFLIKKGTPLLLMLNASGFNDELFQQPYDFMPERWLERGKAAFSDLQPFGGGPRMCPGRSLALMEIKLGFHALCSGFHVEALQVASAVTESFAFTVTPSGFRVKLHKRELQQ

SEQ ID NO: 37702 - protein, 94 aa, Oryza sativa Indica Group
MRLTSHCSFCFRELNEKGSPLPKFGEWDVNDPASAEGFTVIFNKARDEKKTGGNSQGQDLAAKSEQPSGQGLYPAKPNSSKKWFCCMQPTAAES

SEQ ID NO: 37703 - protein, 328 aa, Erwinia carotovora subsp. atroseptica SCRI1043
MAKRVQFRAYGGPEVLQYGDFTPAEPAAGEVQVENHAIGINFIDTYIRSGLYPVPDLPSGLGTEAAGVVTKVGAGVSVLKVGDRVVYAQSGLGAYSEVHNVVAEKVALLPDAISFEQAAASFLKGLTVYYLLRQTYEIKPNQVFLFHAAAGGVGLIACQWAKALGAKLIGTVGSDEKAERAKQAGAWATINYRTENIAQRVAELTDGQKVEVVYDSVGKDTWEASLDSLRRRGLMVSFGNASGPVTGINLGILNQKGSLYVTRPSLFGYVTNRAELEQASNELFSLIASGAITVDVPQNQKFALADAQAAHRALESRSTQGSCLLIPG

SEQ ID NO: 37704 - protein, 260 aa, Rhodobacter sphaeroides
MTNADYALGARALLRSLALSGTTADRVVLHTDVPEEALAPLRALGARLVRVELLPTSPEFNAAHAREALHARAAFTKGGKPPFHTPLDNFAKLRLWQLVDYRSVVFIDADALVLRNVDRLFDYPEFCAAPNVYESLSDFHRMNSGVFTARPSTDTYARMLEALDVPGAFWRRTDQSFLQQFFPDWQGLPVFCNMLQYVWFAMPELWSWEQIRILHFQYEKPWQAHDKADRLRPLIDLWRAYAGDGPVPALSDMPDPCGLR

SEQ ID NO: 37705 - protein, 371 aa, Pseudomonas putida GB-1
MAAPREWIEESMSKQILILPGDGIGPEIMAEAVKVLELANDKFQLGFSLAHDVIGGAAIDKHGVPLADETLERARQADAVLLGAVGGPKWDKIERDIRPERGLLKIRSQLGLFANLRPAILYPQLADASSLKPEIVSGLDILIVRELTGGIYFGAPRGQRELEGGERQAYDTLPYSESEVRRIARVGFDMARVRGKKLCSVDKANVLASSQLWREVVEDVAKDYPDVELSHMYVDNAAMQLVRAPKQFDVMVTDNMFGDILSDEASMLTGSIGMLPSASLDADNKGMYEPCHGSAPDIAGLGIANPLATILSVSMMLRYSFNQSAAAEAIEKAVSLVLDQGLRTGDIFSEGCRKVGTQEMGDAVVAALRNL

SEQ ID NO: 37706 - protein, 164 aa, Xanthomonas campestris pv. vesicatoria str. 85-10
MSLIATFDTSRGPIVVELYPDKAPLTVANFVNLAKRGFYNGLSFHRVIADFMIQGGCPEGSGRGGPGYRFEDETNNGLGHERGVLSMANAGPNTNGSQFFITHTATPWLDGKHTVFGKVTQGLDVVDSVAQGDTINTLTIEGDTDAVLAAKADRVAEWNKILAA

SEQ ID NO: 37707 - protein, 345 aa, Oryza sativa Indica Group
MEHLERRGLAQGAYDGADPLDIGGFGDATGVDDAAEDVGDDLPLLDEVPAQDDLLRVVLIVADRGGGGGGRGSGISRGVAIRRGRGGHRDGDARCRLLPPELISLLSRAPTTETSSPPSAAMQQRRPASGRPSGTDGSDFSYRMVVDSRYQRVADGKSRLGRLILVQALHQVAGGALLLLALSKGAEMNKFAVMSVAAGLLAIVLGEIGDAHELVSISSYARRRRTMAVLLRMYTSLSSIAVAFSVACIIRSELFFKITKQNTESITSHELLEVVRVALDCNLQETCNEAAIGSQIHDNHDSILLLPFVELDWKLESIDYIAVSSCCFAQAVTAVQSSIWTRAWF

SEQ ID NO: 37708 - protein, 433 aa, Chlamydomonas reinhardtii
MRAAALAPVRSTAGCVPTRRSLRQTCTAVLPAAVRAYARPAASPSGPCSGGLALPPPTHVLLDPSCSRPAAPTASARSAGRGRGAVACNASSAGAASPSPSNSGGGSGAVELTAIEKSLAAFCSKFTRLFPVWVILAAVSGFYMPSLYTWFDNTCITYGLMFVMAGMGLTLTFGEIASVFTKQPQLLLLGMVLQYTILPAFGYVISRFLMAQPGLAPGLAVGVALVSCMPGGTASNIVAYIAKGDMPLSIMMTTASTLMAIATTPILTSLLVGTLVPVDPRAMFLSVLQLVLAPVLAGTALNQFFPAAVARVKLYTPFMATVVVFLIVGSMIGTNVAVVASSGAIIVASVFALHSTGFFLGYSLSKAMGLSDKIARTNSIEVGMQSSALAAVLAKVHFADPVVVAPCVLSACTHATIGSLLAGYWAATLKDEE

SEQ ID NO: 37709 - protein, 124 aa, Cryptococcus neoformans var. neoformans JEC21
MANLGVPVKLLHESLGHIITVELKTGEMYRGKLMEAEDTLNIALREITVTARDGRVSQLEQVYIRGSMIRFIIVPDLLAQAPMFKRIGPNAMRGRGIGAARGRATIQRANARRGTTRTNQGVRR

SEQ ID NO: 37710 - protein, 144 aa, Oryza sativa
TKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 37711 - protein, 351 aa, Saccharomyces cerevisiae
MPSQVIPEKQKAIVFYETDGKLEYKDVTVPEPKPNEILVHVKYSGVCHSDLHAWHGDWPFQLKFPLIGGHEGAGVVVKLGSNVKGWKVGDFAGIKWLNGTCMSCEYCEVGNESQCPYLDGTGFTHDGTFQEYATADAVQAAHIPPNVNLAEVAPILCAGITVYKALKRANVIPGQWVTISGACGGLGSLAIQYALAMGYRVIGIDGGNAKRKLFEQLGGEIFIDFTEEKDIVGAIIKATNGGSHGVINVSVSEAAIEASTRYCRPNGTVVLVGMPAHAYCNSDVFNQVVKSISIVGSCVGNRADTREALDFFARGLIKSPIHLAGLSDVPEIFAKMEKGEIVGRYVVETSK

SEQ ID NO: 37712 - protein, 477 aa, Myxococcus xanthus DK 1622
MRRAKIVCTLGPASQSQEMLEALLENGMDVARLNFSHGSHEQHAENIAKLRAASLKVRKAVGILGDLQGPKIRTGRFVKGSTELKEGGTFHITTDETVPGTDEIVSTTYPFLAADVNPGDRILLDDGLLELKVLETDKQKLIRTQVIHGGTLKNNKGINLPGVAVRAEALTPKDREDLVFGIKAGVDYIALSFVRQPSDLDTARQAMAEVGRTVPIIAKLEKPEAIARLDAILDKTDGVMVARGDLGVEIPPEEVPAVQKDIIRRSNLRGLPVIVATQMLNSMIDNPRPTRAEASDVANAVFDGADAVMLSGETASGKFPIESVQMMERIILAAESSARTTQSLMRVLETPVGLPNHFPDVIARVACEAAKASNASLIAAFTLSGVTARLLSHYRPPVPIVAFSPNQEVRRRLSLLWGVVPRVLEPTQDTEAMVKRVEEELLARGLGRKGDRIVIVFGAPVGQPGKINSLRLHTIQG

SEQ ID NO: 37713 - protein, 527 aa, Physcomitrella patens subsp. patens
MPAGSSLLQEFKFVENSRRDRTRVWSLQVRCDAGVSVVKELVGEDEGRRIVQDFTTVMKFGGSSVASAHRMKEVAQLILSFPEEKPIIVLSAMGKTTNNLLKAGDKAISCGVKNSGRIEELQVVRDLHKTTARELKLDESLITGLLDELEQLLMGIALMKELTSRTKDYLVSFGERLSTRLFAAYLNSIGTYARQYDSFDLGIITTDEFTNAEILDVTYPTVRERLFNDLEKDAAKGTPICIVTGFLGKGIETGCVTTLGRGGSDLTATALGKALGLREIQQVWKDVDGVLTCDPRVFPSALSVPFLTFNEASELAYFGAQVLHPQSMRPARDANIPVRVKNSYNPKAPGTLITRERDMSQVEMTSIVLKKDVTMLDIQSTRMLGQVGFLAKVFTTFEELGISVDVVATSEVSISLTLDPAKLWERALIEQANKMKSELSRIANVQLLKKKAIISLISNVKQSSAVLEKVFSVFKSNNINVQMISQGASKVNISMVVDDDDGPKCVQELHQAFWPDSDEVLAVNGHL

SEQ ID NO: 37714 - protein, 133 aa, Picea sitchensis
MSRSLGIPVKLLHEAAGHVVTVELKSGELYRGNMIECEDNWNCQLEGITYTAKDGKVSQLEHVFIRGSKVRFMVIPDMLRNAPMFRRLDARIKGKGSSIGVGRGRAVAMRARAQATGRAGPPAGRAGPAPVRR

SEQ ID NO: 37715 - protein, 344 aa, Saccharomyces cerevisiae
MSSSVASTENIVENMLHPKTTEIYFSLNNGVRIPALGLGTANPHEKLAETKQAVKAAIKAGYRHIDTAWAYETEPFVGEAIKELLEDGSIKREDLFITTKVWPVLWDEVDRSLNESLKALGLEYVDLLLQHWPLCFEKIKDPKGISGLVKTPVDDSGKTMYAADGDYLETYKQLEKIYLDPNDHRVRAIGVSNFSIEYLERLIKECRVKPTVNQVETHPHLPQMELRKFCFMHDILLTAYSPLGSHGAPNLKIPLVKKLAEKYNVTGNDLLISYHIRQGTIVIPRSLNPVRISSSIEFASLTKDELQELNDFGEKYPVRFIDEPFAAILPEFTGNGPNLDNLKY

SEQ ID NO: 37716 - protein, 472 aa, Salmonella enterica subsp. enterica serovar Paratyphi B str.
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLHDEFGAVTIGNIERYINDKAFEMGWRPDMTGVRQTDKRVAIIGAGPAGLACADVLTRNGVKAVVFDRHPEIGGLLTFGIPAFKLEKEVMTRRREIFTGMGIEFKLNTEVGRDVQLEDLLKDYDAVFLGVGTYQSMRGGLENEDADGVFDALPFLIANTKQIMGFGETSDEPYVSMEGKRVVVLGGGDTAMDCVRTSIRQGATHVTCAYRRDEENMPGSRREVKNAREEGVEFQFNVQPLGIEVNANGKVSGVKMVRTEMGEPDAKGRRRAEIVAGSEHVVPADAVVMAFGFRPHSMEWLAKHSVELDSQGRIIAPERSDNAFQTSNPKIFAGGDIVRGSDLVVTAIAEGRKAADGIMNYLEV

SEQ ID NO: 37717 - protein, 360 aa, Burkholderia thailandensis E264
MDDELNSRLKPLRERIDAIDTQLIALLNQRAAVALEVGEVKKHFNAPVFRPEREQQVIARLQDMSAGPLASEHISAIWREIMAASRDLEQTIHVAFLGPVGTYSEQAMFDYFGQSIEGLPCPSIDEVFRSVEAGAATFGVVPVENSSEGAVSRTLDLLLHTQLLIGGELSLPVHHNLLTRTGKLDGVKRVCAHAQALAQCQQWLASNAPHLERQAVASNAEAARLAADDATVAAIAGDRAATHYGLQIAYALIQDDPHNRTRFAVIGKEPAGPSGHDQTSLIVSVKNEPGAVFKLLEPLARHGVSMTRFESRPARVGTWEYYFYIDIEGHRDDAAVQGALAELGKKAAFLKILGSYPRAR

SEQ ID NO: 37718 - protein, 431 aa, Bacillus cereus E33L
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPQFQGVDSILLAAGILGATVMPHAIYLHSALTQRRVVGTNDEQKKKIFRFEFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAVLVIILNIFLLYQTFVG

SEQ ID NO: 37719 - protein, 1943 aa, Oryza sativa Indica Group
MWRRGSHSDAAYHLPTAAAAGGGGWAASSSAGGGGAASRRRRRPGLSCRPSHLFFALLVALFTASLLVVWQLLPIGDGGKAEEGVEGLPRPGGGGGGGVMRFSASSVALREFHGESRLEAARSERRWWPGLAPVRLALFVGTMNINAQSLMVATLAKSLKNLGYEVEVLAFADGKANDILENICHVNVVSPPSLKYIDWSKYNAVLLSSLEGKMVVSILMQEPFQFLPVVWLIHEDALGQFLRNPELHQSIPNHIEDWRTHFNACTYVVFPDSYLPLLHSALDTGNFLVISGSPVDILATKRYSSSHTQESARNQYGSKEDDVVVLVVGSYLFFDELPWDFATVLRASAPHIMDMAKTKNLGVQFIFFCGNDTDAYNSAFQELASHMGFPLGSVKHFSLTHDIRNLLVFADIVLYGSSRQEPVFPPLLLRSMASEIPIIVPNLTVITKYITDGTHGFLFNADDPSTMVSAFAQILGEKRLSARAFSVALEGKLLSKNMLAYDCITAHVMLLESVLHYPSYAKLPSPVSKLQERTWLWDLFETKAALENSSSDDDSQLLTRIIDNLVDESHESNQTTYSDSNDTSLYNYPSLSDWNDLNEVEIFEDIERREIEEASFFPLPFPIDERVERPLLSWDEVYKNARKSERLKPEGNERDEGELERTGQPVCIYEIYSGEGAWPFLHHGSLYRGITLSKGGRRPRSDDVDAVTHLSVLDNPYYSDRLCEFGAMFAVANRIDAVHKLPWIGFQSWQAAGRKVSLSEKAEATLEETMAGENNEDVIYYWAPMDMDQTSNFWSMCDWLNAGRCRTLFEDAFRTMYGLSDGITALPPMPNDGDYWSTLHSWVMPTPSFLKFIMFSRMFVDYLHSLNVNGTDPASCLLGASQLEKRHCYCRILEVLVNVWAYHSGKKMAYLNPVTGDIREQHPLDDRNEMWVKFFNFTLLKSMDEDLAEEADDGMHAGDDQWLWPLTGQVFWPGIADREREEKYIKKLDKKLKNKVPARAAAAAAAARAIAGLPPHEKISLPSNSEDLVSIYGSNPQGHAVDELEEVFFQEEFDPIKYILQSIPAEGDSSYFDKQSTLRLAQLDKIAERLSHHVMGHHEEMDIPVISIFLNFPKITCSVLCYQKCIYTDFLLRKSQITDNKFWPVKGMQLVMELEQDLKVANVICMNGRRHVSSSKNEVSRDLVVNVKSKKKQALLDVLPILTELRNAQDMQMELESFVEKENYFQAFQLLPEYLQILENYSGLSSVQEMGRGIEAWLARTIQKLDTHLLGVCQTFHEESYLTVIDAYALMGDIGGMAEKMQSFFLQEVLSQTHYVLKEMLEEVSRFTYSDLCAQVPEPKLRPCLLRTFQSLFSLMCSYYTIMSFCPGVKSIESEGENSLTGRNNTSQSADESLGDSVVFSTSTYQFLKNYEDLTIFILAGEAFCGFEASEFRQKLKGICLNYSVAFHRQNIYALKMVLERESWTIMSAEASRIISLAGLTGDGAALISPTSRISTLPIHGSTMADTGKEKNGFAAWTKIENPFFYKVENGTTESPKSNMMFNSVDNSSAHGSTNNGNGNKAPLDEENEDLLADFIDEDSQLPSRLAKTKIVKGNSSHWKDGDISSQTGSSLSLLRCDFFTGIRMMDKYARLMQKLEIVNVELFKGICQLFGIFYHYIYETFGNQDRGQSGKSLPDHQSFRLRVALSKITQDSDQWIKPQSISYSPSSPVSMDVMPTAPPSSMFTSYGLKERCAAAETISLVARVLNRSRAHLHSVLSQSNTSILEEFFGTMVDSVPDLAEHIHRTSARMLLHINGYPDKIANAKWEVKELGMEHNGYVDLLLGEFKHYKTRLDHGGISKELQDLLLEYGIDSIAEVLVEGLSRVLINGLLHIVSANVRPKLQIVDTFIKAYYLPETEYVHWARSHPEYSKSQVVGLVNLVATMKGWKRKTRLETIERIEAGP

SEQ ID NO: 37720 - protein, 286 aa, Geobacter metallireducens GS-15
MWDYTEKVREHFLNPRNVGDIPDADAVGEVGSLACGDALKLYIKLDDAKERIVDAKFQTFGCASAIASSSALTEIIKGKTLDEALATTNQEIADFLGGLPEEKMHCSVMGQEALEVAIAKYRGGPVPTHHDHGHEEVEPGEIVCKCFGLTDTFLKKVIAANKLTTAEQVTHFTKAGGACGGCIPKIKELISEVLGAQPTEERKKPEKLTNLRKMQLIQETLEKEIRPLLWADGGDLELVDISGSEVQIAFRKACAGCASSGNTAKFVELKLRDLVADDIVVQEVEG

SEQ ID NO: 37721 - protein, 295 aa, Gluconobacter oxydans
MNAEEAQQQAAILSSALPFLRRYAGDTIVVKYGGHAMGEGKLAHAFGYDISLLKLVGINPIVVHGGGPQISAMLDRLKIRSEFIDGLRVTDKSMVDVIEMVLSGSVNKQVTQLINRAGALAVGISGKDGGLIQARRLTRTKRDPDSEIEKVIDLGFVGQPEKIDPRVLYALLGAGLIPVIAPVGVGEDGETYNINADTAAGAIAGAVHASRLLMLTDVPGVLDENGKLIEELSADEAMRRIADGSISGGMIPKVETCLEAVRKGAKAAVILDGRVPHSCLLELFTRAGPGTLIKA

SEQ ID NO: 37722 - protein, 266 aa, Triticum aestivum
  misc_feature (25)..(25): Xaa can be any naturally occurring amino acid
  misc_feature (146)..(146): Xaa can be any naturally occurring amino acid
MAAAGVSREQRWSLAGATALVTGPXASGGIGHAIVEELVGLGARVHTCSENAAELEECRRRWEEMKLPVTVSVCDVSVRAEREKLMETATQTFDGKLDILVNNVGRNLAKASVECTAEEYSHLMSTNLEAAFHLSQLAHPFLRATXSVAGGGSIVNISSVASSLGYSTLAVYCISKGGVNQLTRSLAAEWAQDKIRVNSVAPGGINTELQKSVDPEIVENTLSRTPMHRLGEPVEVASMVSFLCMPAASYVTGQVIYVDGGRTISG

SEQ ID NO: 37723 - protein, 230 aa, Burkholderia vietnamiensis G4
MTQDELKRLVGQAAADYVIQNVPEGAVIGVGTGSTANCFIDALAAVKSRYRGAVSSSVATTERLKSHGIKVFDLNEIDALQVYVDGADEIDASGAMIKGGGGALTREKIVASVADTFVCIADGSKRVPVLGAFPLPIEVVPMARTAIGRRVAALGGVPVLRVTKDGAPYITDNGNEIIDVKGLQIAEPRAFEAKVNAWPGVVTVGLFAERGANLCLLGTENGVETIIYPA

SEQ ID NO: 37724 - protein, 489 aa, Leptospira interrogans serovar Lai str. 56601
MEFEFNTLILSGLIILSIGLLRISSKFGVPSLLLFLMIGMAAGSDGPGGIDFDNPILARQVGSIALAYILFSGGLETEWQKIRPVLWKGIVLGNLGVLITWAVMGLFSVYVLGFSPIIGFLLGAVVSSTDAAAVFNVLRTRNTGMKKGLTSLLELESGSNDPLAVLLTVSILSLLGPQIPKAEELVFHIIIQFSIGSVAGALFGYLIYKGLNRIRLEYEGLYPVLISASVLFVYSATELIGGNPFLAVYIAGLVLGNQSFVHKRSNLRFLDGIAWLMQIVMFLTLGLLVYPSRIPPLFGTGILFSCFLVFIARPIAVFISLIKSGYNFKEKLLVSWIGLRGAAPIILATFPFAQGVEGSDKIFHLVFFTVLVSLLIQGTSVPQVVRWLGLDAPLEQRASYPFEFENREQSDSNLLEFIVPYGSDTVGKFVYSLNFPENSLITLIYRGDKHIVPTGKTKLEEGDVLLILTPKGSEDKIREILSKVDSSLP

SEQ ID NO: 37725 - protein, 541 aa, Dunaliella salina
MVLVLFETAGGLALFKVLQEGKLKQTEDVSADFGTLEQAQKMVKLKAFSKFQDTTEAMEAATALVDSKLSKPMKKFLRKNVDGEELAILDKKLGGIVQEKLGIPCVYSNAVLELTRGIRNQLQGLISGLSGVDLKPMSLGLSHSLSRYKLKFSPDKVDTMIVQAIGLLDDLDKELNTYAMRVREWYGWHFPEMTKIVNDNIAYAKVVKLMGTRDQAASHDFSGIIEEDTEQHLKDAAIVSMGTEISQEDLMRIRELADQVIDLYAYRGQLFDYLKSRMNATAPNLTVLVGELVGARLISHAGSLINLAKQPASTVQILGAEKALLRALKTKHETPKYGLIYHASLIGQSSSKYKGKVPRVLAAKCALATRVDALGEGEDAQVGIDARSKVEARLRQLEGKTLITDGGKAKGKEQPAPYDKTKQQSPAAGLSTVPKAYNADADVAVPEKKKKKKDKSGEQAGPSEEQPQQPQQTDGQQEGEQPKKKKKEKKAAEAAAGDAQNGGGGAEEEAPKKKKKKAEAGAADGGAAEEAPKKKKKKAAE

SEQ ID NO: 37726 - protein, 729 aa, Bifidobacterium longum DJO10A
MRSASGNGFDSSDSFAVSGAAERTARLHDIPPSITPSHGDDSHLLSRIASPADVKALAPNELAELCREIRTTLLAYGHQHGGHIGSNLGMVEATVALHRVFDSPRDRIVFDVSHQSYVHKMLTGRAAAYLDPDRFSEVTGFTNPDESKHDQFVLGHTGTSISLACGLAKTRDMEGPNSGIGNVIAVIGDGSLSSGVAFEGLNNAAEQGGNLIIVFNDNEMSIAGDFGGMYGPLARLRASGGTAQPNLFNAFGLDYRYVEAGNDVSALVAAFEEVRDIDHPVVVHIHTLKGAGYDGEETHADRQTASASPVSFDSPTGVHPTDNVNHSEPWHSDHCNLSDHEPHEGQCEASHWQNPDAAIGKPDDPRKHYGKMAMAALEPRFAAEPGLVVISPATPGSNGITHEFRERAGAHYVDTGITESHAVAYAAGIARAGGTPVVATTASFFQRAYDQFFQEMSLNRSRVTVLDFLGGLSGSDNTHSGAYDVTMFSNIPGATMLVPTSARDYLADLAWATAPAGSADAPAGPVVIRVPGEAILTAERDATLLPVTGGQIADRPQSTSLPVSVSSASGGISAATVRGTVSVTAQRAGVRHMLDWRVNQTGSHVAIIGLGNAYPLAEQTAAALSADYGITATVIDPRQCTSLDSDVLESLRDGHQQVITLEDGQLEGGWGEKVTAYYANHHVSDGSRNPRVLNFGAAKEFTDRVSLGELNERYGLTVEQVTEAITRCF

SEQ ID NO: 37727 - protein, 403 aa, Zea mays
  misc_feature (337)..(337): Xaa can be any naturally occurring amino acid
VIVPDTSSPRQSPLPTQLHDCCSLLRLRSDPVPPMPPPPQLNGGKVTPNLAMDAAATRLLNLTVLQRLDPAVEDILITAAHVTLYDFNIDLNQWSRKDVEGSLFVVKRNSQPRFQFIVMNRRNTDNLVEDLLSDFEYELQPPYLLYRNASQEVNGIWFYNQHDCEAVASLFGRILNAYAKVPPKPKVPSTKSEFEELEAVPTSAAIDGPLEPPLGSTAVVLDTPDEPLINYFSVASSIGSESNAPLSGRVQLATESIPSSHVLLIIPSAAPAHQLPPSVASSAPPLPIHDTNAHTSRSTNNLVTPDFFAPPPSSSTPLAPPGASVIPTAPPLHPTSXASVQRSQYGAPLLQPFPPPTPPPSLTPAHSERPVVTRDRVKDALQRLVQSDEFIDLVYRELQKSLV

SEQ ID NO: 37728 - protein, 178 aa, Zea mays
  misc_feature (22)..(22): Xaa can be any naturally occurring amino acid
  misc_feature (33)..(33): Xaa can be any naturally occurring amino acid
  misc_feature (39)..(39): Xaa can be any naturally occurring amino acid
  misc_feature (53)..(53): Xaa can be any naturally occurring amino acid
  misc_feature (59)..(59): Xaa can be any naturally occurring amino acid
  misc_feature (68)..(68): Xaa can be any naturally occurring amino acid
  misc_feature (94)..(94): Xaa can be any naturally occurring amino acid
  misc_feature (122)..(122): Xaa can be any naturally occurring amino acid
  misc_feature (158)..(158): Xaa can be any naturally occurring amino acid
MHDVALALRSSLLHKDRCDCPXYFKIGVCQHDXRCSRLXNRPAISPTLVLANXHQRPDXSMTPGADAXGQPVDPENMRRACLRDILVTTYYDDXSWKHSDIDNVKVCGNLADHMQENVEVQXRDENEHCALHHALQWRLHSGRPIHHAYSHCDRLPKXACTTHAQIMCGRGGYCNFMH

SEQ ID NO: 37729 - protein, 343 aa, Triticum aestivum
  misc_feature (170)..(170): Xaa can be any naturally occurring amino acid
MGLSSSLVPVASALLLFCCFTAWNAAAAAASGGGGDGLRLNYYSESCPRAEEIVKEQVRRLYEEHGNTAVSWLRALFHDCTVKSCDASLLLETDAATGLVSEQASPRSFGMRNFKYVGAIKSALERECPGTVSCADVLALAARDGAAMLGGPAAIPMRTGRRDATESQYXKVEPYLPEPQRPGWSAGAVPGSRPMGLDAEAVVALLGAHSVGRVHCNNLVARLYPAVDGGMEPAYGAYLRGRCPTADAREDTRDVAYARNDRATPMVLDNMYHKNLLKGRGLLLVDQRLASDPRTAPFVKKMAADNGYFRETFAAALVRMSENGPLTGGQGEVRKDCRFVNAK

SEQ ID NO: 37730 - protein, 403 aa, Magnaporthe grisea 70-15
MAGQSSQIGSPKLPSFYSPRTQPAATTDDVPTSEATALDGALQSEPSASQPPQQTQGAPSTRPSAAILRGALGHDQPLPPPSLLSPAFTPPGTPGTSTPNPSSLIPRGVPVDSSVESGGCGSKRPRLLEKLPEVQCIVRARIPTTAGTQMFLHLYTNNVDNKEHLAIVFGNNIRSKSLDAVRPGETEMDRMIRGAYTGVLYPGRTSSSAAGASETSQQQQQQQQQQSDVERNDIPLVRIHSECYTGETAWSARCDCGEQLDEAARLMSLPSNAAGGIIIYLRQEGRGIGLGEKLKAYNLQDLGSDTVEANLLLRHPADARSYGLATAMLQDLGQTDIRLLTNNPDKIRAVEGPNREVVVRERVAMIPLSWRGRGGFRSKEVEGYLKTKIEKMGHMLDSGTMPS

SEQ ID NO: 37731 - protein, 177 aa, Medicago truncatula
MGMAAENQFHVLAVDDSIIDRMLIERLLKTSSFNVTTVDSASKALKFLGLVEDEMRTYDTHVASEINQDVDVNLIITDYCMPGMTGYDLLRKIKESKSFKDIPVVIMSSENVPSRINRCLEEGAEEFFLKPVQLSDVSKLKPHLLKSKVKEENEQPIKRKGMEETQSPDKTRPKVSI

SEQ ID NO: 37732 - protein, 215 aa, Saccharomyces cerevisiae
MDQENERNISRLWRAFRTVKEMVKDRGYFITQEEVELPLEDFKAKYCDSMGRPQRKMMSFQANPTEESISKFPDMGSLWVEFCDEPSVGVKTMKTFVIHIQEKNFQTGIFVYQNNITPSAMKLVPSIPPATIETFNEAALVVNITHHELVPKHIRLSSDEKRELLKRYRLKESQLPRIQRADPVALYLGLKRGEVVKIIRKSETSGRYASYRICM

SEQ ID NO: 37733 - protein, 550 aa, Vibrio cholerae O1 biovar eltor str. N16961
MLKNINPTQTQAWKALTAHFESAQDMDLKALFAQDSERFAKYSARFGQDILVDYSKNLVNAETMQHLFALAKETDLQSAITAMFKGEAINQTEDRAVLHTALRNRSNSPVLVNGEDVMPAVNAVLAKMKAFSERVIGGEWKGFTGKAITDVVNIGIGGSDLGPYMVTEALVPYKNHLTMHFVSNVDGTHMAETLKNVDPETTLFLVASKTFTTQETMTNAHTARDWFLKAAGDEAHVAKHFAALSTNGKAVAEFGIDTDNMFEFWDWVGGRYSLWSAIGLSIILSIGYDNFVELLAGAHEMDQHFVNTPFESNIPVILALIGIWYNNFHGAESEAILPYDQYLHRFAAYFQQGNMESNGKYVDRNGNPVTYQTGPIIWGEPGTNGQHAFYQLIHQGTKLIPCDFIAPAVSHNLVGDHHQKLMSNFFAQTEALAFGKSAQAVQAELEKAGKSAAEIAALVPFKVFEGNRPTNSILVKQITPRTLGNLIAMYEHKIFVQGVIWNIFSFDQWGVELGKQLANQILPELADSAAVTSHDSSTNGLINAFKAFRA

SEQ ID NO: 37734 - protein, 502 aa, Pseudomonas fluorescens
MTRSLTMNSSLPAIDGLRLPHQMLIGGQWVNAQSDKTLNVYNPATGDTLTDVPDGDVEDVNAAVESAAATLQSDAWRRMPPSARERILLRLADLLEAHGDELARLETLNNGKLLIYSKMMEVGASAQWLRYMAGWATKLTGSTLDLSLPLPPDVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 37735 - protein, 280 aa, Legionella pneumophila str. Paris
MHHLILGYGYCGYYLAQELLRHHQQVTVVSRQLKKELELSKLQHISHDLESPFHWSEPDSIIYYLIPPPSQGTCDTFLQQFLNQSSLNAKKIIYFGSSGVYGNHQGAWVDELSACIIDSPRQQRRLDAEQQWLAYCQQHNKELSLLRIAGIYGPNRIPADAAKSKIPIIKPTEAPFTNHIFVKDLSLIAYLLGQKQTTSAVYNVADGNPTHMGELQQTVANALGIESASYESFEQAWEKASPMKREFMRASKRLKIDLLKTALGEDIQLTCLYDAVKQSL

SEQ ID NO: 37736 - protein, 419 aa, Oryza sativa
MENMRSENFNQGVSMEGVKHAPEMANTNRRALRDIKNIIGAPHQHSTRSKRGLLDKPAAKNQSGHRPMTRKFAATLANQPSSAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCAAKSEPAVFLLKSVAL

SEQ ID NO: 37737 - protein, 327 aa, Vibrio cholerae O1 biovar eltor str. N16961
MTHSCRLSVAPMLDWTDRHCRYFHRLLSAQTLLYTEMVTTGAIIHGRGDFLAYNQEEHPVALQFGGSNPKDLAHCAKLAQERGYDEINLNVGCPSDRVQNGRFGACLMGEPDLVAECVAAMRAVVDIPVTVKTRIGIDDQDSYEFLTQFIATVAEKGGCEQFTIHARKAWLSGLSPKENREIPPLDYPRAYQIKRDFPHLTIAVNGGVKSLEEAKLHLQHLDGVMIGREAYQNPYLLAEVDQQIFGLETPVKKRSQVIHEMMPYIERELSQGTHLGHMTRHMLGLFQNMPGARQWRRHISENAHKPGAGLEVVEQALAKIPYQELGV

SEQ ID NO: 37738 - protein, 458 aa, Listeria monocytogenes str. 4b F2365
MAQTSTIQNDTKAAEEYAARVFETIKLRNPGETEFHQAVEEFLNSVIPALAKEPKYEANGILEQLTEPERLISFRVPWVDDSGTVHVNRGYRVQFNSAIGPYKGGLRFHPSVTGSIVKFLGFEQIFKNSLTGLPIGGGKGGSDFDPKGKSDSEVMRFCQSFMTELQKHIGPDTDVPAGDIGVGGREIGYLFGQYKRLRGAYDAGTITGKGLSYGGSLARTEATGYGLVYFTVEMLEAAGETIRGKKIVVSGSGNVAIYAIEKAHELGAKVVACSDSAGFVYDKEGIKVETVKQLKEVERKRISEYTTIHPSAEYYAGGDVWSVPCDIALPCATQNEINADQARALVKNGVIAVAEGANMPSTLDAVDIYHENKVLFGPAKAANAGGVAVSALEMAQNSTRMSWTFQTVDEHLQNIMKDIYKNSSNAASEYGAPGNLVIGANIAGFLKVADTMISQGII

SEQ ID NO: 37739 - protein, 298 aa, Saccharomyces cerevisiae; identical to SEQ ID NO: 1161

SEQ ID NO: 37740 - protein, 297 aa, Mesorhizobium sp. BNC1
MTEITETAEAQAALLSAALPYMQRYENKTVVIKYGGHAMGDIALGRAFARDVALLKQSGVNPIVVHGGGPQIGDMLKRMGIESKFEGGLRVTDQKTVEIVEMVLAGSINKEIVALINAEGEWAIGLCGKDGNMVFAEKARKTVVDPDSNIERVLDLGFVGEPVEVDRTLLDLLARSEMIPVLAPVAPGRDGYTYNINADTFAGAIAGAVKASRLLFLTDVPGVLDRDKKLINELTVSQARALIKDGTISGGMIPKVETCIEAIQRGVEGVVILNGKTAHSVLLELFTEHGAGTLIVP

SEQ ID NO: 37741 - protein, 963 aa, Ostreococcus tauri
MAPKRRREPAMPSFAATTGRRIARGGTRRVAGHKPLSREYVEARRASRAGRTRDVVEGDATGARGRGNGGEATTSGVASRDETLALAIADCLVAAERGEGALATLEADAEANGRDGRGKRRKGNDAHKGVGYIASKGRGRQTAGNRANLLGTLDLADEETVRELLGHLPQGHQNERAAIVKNLEKQHRRWYQLLRAGFNVLLYGFGSKKALMEDFETRYFRDGGVVIVNGFFPALTPKQVVVAAAAALTPVSEIMNDTQSNGSIISDKTPTETLLAKIQSATRGSATREPKRLYIVLHNIDGPTLRTSEAQALLGELASMDRVHLIASIDHVNAPLLWSKREAARFNWVWQEASTFASYALETANFPQLLASKGEERHVRGAANVLRSLTANGRAIFRLLAEHQLENEDSPGMPFDVFYASCREQFLVSSEVTLRVHLTEFTDHELIYSPFPSAPTPCASSRARSTPPKPETRDRLKPSHTRTLSHGTTARHFTSHDSTRSPSHAAVARDRPRRRRRRPHTSLATERARWRRRRLRPRFPPRRSRARPRASSRTPRSIYGRTRCGTCDDSSVGTSSLLRGGVGGHLNLTNFAALAETSAILQSLGMRVVVVTSGAVGVGCQVLHKKKPSDLAGKQALAAVGMVRLMRMYDDFFQSVGQTCAQVLISLDNIMDRQQYCNAQSTFKALLAQDIIPIVNENDTVAVQHTKFGDNDTLSAHVAALVDADYLFLLTDVDGIYTANPHTNPDAERIEVVENIEDLNVCTAESGESGLGTGGMATKLSAARLAAASGCNTIVMHTSSMPEMPEIILKQKSVGTLVLAMPRPLRGRKRWILLLPAVGDLVVTERAATALENNKSLFSTALLECRGDFTAEDAVRLLVREESGEERDLGRAIVNYASDEIASFIGKTSEEFYEIVGYAGAESIAHRNNICCWIPFGHEPSSANLVGMNASSSGSLSDVNAKT

SEQ ID NO: 37742 - protein, 396 aa, Zea mays
MAPAPAAASAGRKSHVTVLLLYVVCGLILLLLLASYSPRLQPHAHGRSLHRRLKLHPKSSLPSDASSGGNGGQQKTQHQNHHAASFDPTIAELERRLDDKEWEREHYSLLHGGEPDDHMKEWEEFLKEEEDFINDDDRFNIADRIRALFPKIDVAPQDGFVSLDELTAWNLQQARADQHHRSAREMELYNKNGDEIVSFEAFNALRQESHGEGNMLGFEWWKEDHFNASDANADGFLDKTEFNDFLNPSDSDNPKIINLLCKQEIRQRDKDGDGKLNFEEYFTGLHDHIHGYDDENADISQIGNITVAKDRFFKLDKDNDGFISEHELEPVLDKLYLSERYYSRQQAIHAISEADKDHDGRLTLEEMVENPYAFYGSVYLSSSDNDDEDYFHDEFR

SEQ ID NO: 37743 - protein, 255 aa, marine gamma proteobacterium HTCC2080
MTDKTNAESGETTHFGFETVNKNQKESLVRGVFDSVASRYDVMNDLMSAGIHRLWKRFTIELSAVRPGQTVLDIAGGTGDLAAKFSHLVGDDGQVLLADINDSMLKVGRDRLLDSGAVGNLHMVQCDAQMLPFPDASIDCITIAFGLRNVTDKDMALRSMERILKPGGRLLVLEFSKPVNPVLEKIYDTYSFRILPMMGQLIANDADSYRYLAESIRKHPDQETLLGMMEDAGLVNCEYHNMTGGIVAVHRGIKA

SEQ ID NO: 37744 - protein, 336 aa, Oryza sativa Japonica Group
MAPLGDGAAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 37745 - protein, 342 aa, Oryza sativa Japonica Group
MATLGLAPNMNPNKSFEVLPNPGDSVSSLSFSPKSNLLVATSWDNQVRCWEIVGGSSQPKASISHDQPVLCSAWKDDGTTVFSGGCDKQVKMWPLLSGGQAQTVAMHDAPVKEIAWIPQMNLLVSGSWDKTLRYWDTRQSNPVHVQQLPERCYALTVNYPLMIVGTADRNLVVFNLQNPQTEFKRIQSPLKYQTRCLAAFPDQQGFLVGSIEGRVGVHHIDDSQQSKNFTFKCHREGNDIFSVNSLNFHPVHHTFATAGSDGAFNFWDKDSKQRLKAFSRCPLPIPCSTFNSDGSIFAYAVCYDWSRGAENHNPATAKTSIYLHSPQESEVKGKPRIATSRK

SEQ ID NO: 37746 - protein, 317 aa, Oryza sativa Indica Group
MSSDAGDDDDVVHDFRPLIVVYKSGRLERPLATPPVPPGTDAATGVASRDVRLSAASFVRLYLPPPCAAVAGGERLPVVVYFHGGGFVIGSAASPAYHRCLNDLAAACPAVAVSVDYRLAPEHPLPAAYEDSAAALAWVLSAADPWLAVHGDLSRVFLAGDSAGGNICHHLAMRHGLTSQHPPHRLKGIVLIHPWFWGKEPIGGEAAAGEQKGLWEFVCPDAADGADDPRMNPTAAGAPGLENLACEKVMVCVAEGDTLRWRGRAYAEAVVRARGGEAAAVELLESEGVGHVFYLFEPGHEKADELLRRIAAFISAK

SEQ ID NO: 37747 - protein, 385 aa, Nocardioides sp. JS614
MLAHRLEGIPPTIFTEMSALAVRTRSVNLGQGFPDVDGPPAVIARAVAALEGGHNQYAPGPGVPALRQAIARHQLRHYGVELDPDAQVVVTTGCTEGIAAALLGLVDPGDEVVVLEPYYDSYTAMIQMAGGVRRPVTLRAPGFRLDPDELRAAVTPRTRFVLLNSPHNPTGTVLTRAELQAVADVAIEHDLVVVTDEVYEHLVYDDHEHVPLATLPGMFERTLTLSSAGKSYSFTGWKVGWATGPAELVGAVLAAKQWLTFTSGSPLQPAVAYALDEEPGFPTELAAELRAKRDLLCDGLARVGLDVRVPEGTYFASTDISALGWPDARSFCLALPERAGVVAIPTQAFYDSDAGRHLVRWAFCKDSEVIEEGLRRLAAADLTAS

SEQ ID NO: 37748 - protein, 448 aa, Archaeoglobus fulgidus DSM 4304
MKTLILAGGKGTRLWPLSRELMPKQFIKLFSESLFQKTVKRALYLSSPDEIYVITNKEYRFRVLDDLEEIGISIPEENIILEPEAKNTLPAICLGVKAAGEGKFAVLPSDHLIKADEEYLNAFRSAEKLSENYIVTFGITPTRPHTGYGYIKPGKELEGGFEVEQFKEKPSRELAEEYVSKGYLWNSGMFVFDSKVFVEELKELAPEFAKVLEEGEEAYKQIPEASFDYAILEKSGRVAVVPIKTFWSDLGNFDSIYEVMEKDERGNAIKSESCIPVDSENNLVITQRLTALIGLRDLIVIDTDDALLVARRGEAEKVREVYRLLAEKGDKAVEVHRTAHRPWGSYTVLEENKSYKIKRITVKPKKRLSLQRHYHRSEHWVVVKGTARIVVDGNEILLRSGESTFVPAGAIHRIENPGKIPLEIIEIQIGEYLEEDDIERFEDDFGRR

SEQ ID NO: 37749 - protein, 478 aa, Oryza sativa
MSKFETRLFVNGEFMEAEHAETFSLSNPATGETVAEIPIAGEVDIDNAVKAAERAQPAWSRVPARRRAAIIRKFAALMDQNKHKLSELDSICMGKPLHGGLEDIQEAVDISNYFAGLVEIAGGETSLNSPEVLSISMRQPYGVVASIIPWNFPSMIWCHDVVPAAGAGNAVILKTSEKSPLSGIFLAKLAFEAGFPAGIINVVSGPGSTGALLSSHMKIRRISFTRSTGAGRAIMQAAAKSNLKAVSLELGGKSPLIVFDDADLEKTAAAAVGSITINSGQICTASSRLYVQKGVSETFKLKLKQKMEALKLGNPLQSGTEMGPQADKKQAEAIAKFLEIGNQEGVALTGGKPAKDKGDNFIQPTVFTGLSDSSRLNIDEIFGPVLVLHEFETEEEVIRRANATEYGLYASVFSKNIDTALRVARALEAGNVGVNTTSPFGAYELAFGGFKGSGVGRQKGSRSVLDWTEEKSVYINHE

SEQ ID NO: 37750 - protein, 486 aa, Oceanobacillus iheyensis HTE831
MLKTDKQSYLNFINGRWKSSEGGETKEVLNPADKNDVVGVIQRSTIDDVNEAIASAKSAKESWRKLSGNERGNYLYKVANILESRLDDVAETLTREMGKTLPEAKGETARGVAILRYYAGEGLREVGDVIPSTDSSGIMYTTRTPLGVVGVITPWNFPVAIPIWKMAPALIYGNTVVIKPATEAAATAAKVMECFADAELPDGVVNMVTGSGSIVGNRIAEHPDVNGVTFTGSDQTGKHIGQTALARGAKYQLEMGGKNPVIVADDADLDLAVKATISGGLSSTGQKCTATSRVIVQRSVYDAFKEKLLTQIQALTVGNGLEDGNWMGPSVSESQLETVLHYIKKGKEEGATLLTGGHRLTDAEHKDGNFVEPTVFEDVTNDMTIAQEEIFGPVLALIKVETFEEAMKLANDTEYGLSAAVFTENIRKMLTFIDDIEVGLVRVNAETAGVELQAPFGGMKSSSSHSREQGKAAIEFFTSIKTVFIK

SEQ ID NO: 37751 - protein, 344 aa, Burkholderia vietnamiensis G4
MSAPSTLPPRRVSVAPMLDWTDRHCRSFHRTLTRDTWLYTEMITTGALLFGDAQRHLAFTPNESPVALQLGGSEPDDLARAAKLGEQWGYDEINLNCGCPSERVQRGAFGACLMNEPQLVADCVKAMRDAVSVPVTVKHRIGVDAVEDYAFVRDFVGTVAQAGCDTFIVHARNAILKGLSPKENREIPPLKYDYAYRLKRDFPALEIVINGGIKTLDEVAEHLEHVDGVMLGREAYHNPYVLAGVDARFYGSTAPAPTREEAEAKLIEYCAAELKRGTYLGAIVRHALGLYRGVAGARGWRRVLSDNKKLARGDLSVFDEARTHLNDAIENFEKNALQDGKVFV

SEQ ID NO: 37752 - protein, 476 aa, Synechocystis sp.
MARTPQEVLKWIQDENIKIIDLKFIDTPGIWQHCSFYYDQLDENSFTEGIPFDGSSIRGWKAINESDMCMVPDPNTATIDPFCKEPTLSMICSIKEPRTGEWYNRDPRTIAAKAVEYLRGTGIADTVYFGPEAEFFLFDDIRFGPNGNSSYYFADSVEGRWNTGREEEGGNLGYKPGYKEGYFPVAPTDTAQDIRTEMLLTMAGLCVPIEKHHHEVASGGQNELGIKFDKFDKLVNSADNLIIYKYVIKNVAKKYGKTVTFMPKPIFNDNGSGMHVHQSLWKDGQPLFAGDKYAGFSQMGLWYIGGILKHAPALLAFTNPTTNSYKRLVPGFEAPVNLAYSQGNRSASVRIPLSGGNPKANRLEFRCPDATSNPYLAFAAIVCAGIDGIKNQIDPGEPLDVDIYDLSPEELAKIPSTPGSLEAALEALEKDHQFLTGTGVFSPDFVESWIEYKLDNEVNPMRLRPHPYEFSLYYDC

SEQ ID NO: 37753 - protein, 452 aa, Zea mays
ITGGAEAVKKALFGVSTIIYKHPSKENIPLETSIPDPTPSIIIPSELPVYPASNFYSAPDAAIPSVHPSMSVLGSTRHVPELAVPADDHGRLPIYQSILPVIPTYSAPKCSGELEFRVLCPGGKIGLVIGRGGATIKNIRQESGARIDVDDAKNDKEESIITIISTESTDDVKSAAVEAVLLLQAKINDSEDDRMNLRLLVPNKVIGCLIGRGGSIVNDMRKKTKANILISKGDKPRRASSSDELVEVSGEADKLRDALVQIILRLREAVLKESVESQNSDRDGQLTVAASDSLYGSSLPLPALLPHNQQIAPLGYDRRGEPERALEVFPRTSSYGYSSMQAFLDIYEFILILIVDILDQVTDDGYGGLPSYASKAYEEHVPRLEMTVPASGISKVMGKHGTNLDNIRKISGAHIEIIEPKSSRHEHIAYISGTSEQRHSAENLIKAFIMST

SEQ ID NO: 37754 - protein, 131 aa, Triticum aestivum
  misc_feature (16)..(16): Xaa can be any naturally occurring amino acid
  misc_feature (48)..(48): Xaa can be any naturally occurring amino acid
WIPRAAVLPVPINRFXPNILVDGRHPYAEDPWKTIKINKLTFDGVKLXDRCKVPTVNQENGMLGTEPTETMLTFRSGEVLRPSHENKHKVYFGQNLVCKESVSAKGKGRVVKVGDPVYVLQTYPSCDEVPA

SEQ ID NO: 37755 - protein, 293 aa, Shewanella oneidensis MR-1
MLVNAIKEYQLRVDDQLKQRFSTLEDTAPQLKAAMTHGALLGGKRIRPFLVYSVGQMFGVPLEKLDACAAAIECIHAYSLIHDDLPAMDDDALRRGQPTVHIAFDEATAILAGDALQTLAFEIVTEAVPGITSEQHIAMVRALAKASGYRGMCGGQAIDLASTDKHIDLKALTQLHNMKTGALISCAVELALIAANAPKDQYQTMMEFAHAVGLAFQVQDDILDIIATTEELGKPQGSDAESNKSTFPQLLGLQGAKDTATQLIQEALSALAKLPYNSQLIADFARYIIERRI

SEQ ID NO: 37756 - protein, 338 aa, Pseudomonas sp. 6G5
MNLNRFERYPLTFGPSPITPLKRLSQHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTAELVELGREITEEDVVLDTRFAYPEYGLPNEGTLEAIRLCGSLEGVLTDPVYEGKSMHGMIEMVRRGEFPEGSKVLYAHLGGAPALNAYSFLFRNG

SEQ ID NO: 37757 - protein, 522 aa, Xylella fastidiosa 9a5c
MTPNIHHDKILILDFGAQYTQLIARRIREIGVYCEVWPWDHSPEEILSFGAKGIILSGGPESTTSPGAPAAPQHVFDSDLPILGICYGMQTMAVHLGGATEAADKREFGHASVQVIYPDTLFSGLSDHPSEFRLDVWMSHGDHVSRVPPGFTITAATDRIPIAAMSREDKRWYGVQFHPEVTHTLQGQALLRRFVVDICGCQMLWTAANIIEDQIAHVRERVGCDEVILGLSGGVDSSVVAALLQKAIGSQLTCVFVDTGLLRWGEGDQVMAMFAEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVALGLPHAMVYRHPFPGPGLGVRILGEVKPEYAELLAKADAIFIDELHQADLYDKVSQAFAVFLPVKSVGVVGDARAYEWVIALRAVETVDFMTAQWAPLPYDFLSTVSNRIINELRGVSRVVYDISGKPPATIEWE

SEQ ID NO: 37758 - protein, 577 aa, Vibrio cholerae O1 biovar eltor str. N16961
MSANQNPSVQEVLGEVLGPWSDNERLKRESHFLRGTIEQDLQDRITGGFTADNFQLIRFHGMYQQDDRDIRAERSKQKLEPLHNVMLRARMPGGIITPHQWLAIDKFATEHTLYGSIRLTTRQTFQFHGVLKPNIKLMHQTLNSIGIDSIATAGDVNRNVLCTSNPVESELHLQAYEWAKKISEHLLPKTRAYAEIWLDGEKIEGPDEEPILGSNYLPRKFKTTVVIPPHNDVDVHANDLNFVAIGENGQLVGFNVLVGGGLAMTHGDTSTYPRRADDFGFIPLEKTLEVAAAVVSTQRDWGNRSNRKNAKTKYTLDRVGVEVFKAEVEKRAGITFAPSRAYEFTSRGDRIGWVEGIDGKHHLTLFIENGRILDFPGKPLKTGVAEIAKVHQGDFRMTANQNLIVAGVPADQKPHIEQLAREHGLIDDGVSEQRINSMACVAFPTCPLAMAEAERFLPSFVTEVEGILAKHALPKEENIILRVTGCPNGCGRAMLAEIGLVGKAPGRYNLHLGGNRNGTRIPKMYKENITDTQILQEIDELVGRWASERLDGEGFGDFTIRAGIIEEVIISKRDFYA

SEQ ID NO: 37759 - protein, 296 aa, Xylella fastidiosa 9a5c
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGSKGRITQIVEKPKPDDAPSNLAVVGRYVLSGKIFEMLENTSIGTGGEIQLTDAIAELLKYERVDAYRFQGRRFDCGAHIGLIEATLHLALEHRKHGQAVREILRDTLLPVDKN

SEQ ID NO: 37760 - protein, 380 aa, Triticum aestivum
TRPRDLKNTKGHISGLTGGEWNPKSKETILTSSEDGSLRLWDVSDFSSQKQVIKPKLKRPMRIPVTSCAWDHEGKRIVAGVGDGSIQLWTIKTGWGSRPDIHVEKAHTEDITGVKFSTDGQILLSRSMDSTLKIWDLRKMKTPLKVFDDLPNNYAETNASFSSDEQLIFTGTSVEKDGRNGGLLCFFDRRKLELVSRVGISPHYSVIRSLWHPRINQVFATVGDKKEGGTHILYDPSVSQRGALVCVGRAPRKKSVDDYEVQPLIHNPHALPLFRDQPSRKRQREKMMKDPLKSHKPEAPVSGPGFGGKIGTTKGSLLTQYLMKEGGLIKETWMDEDPREAILKYADAAKNDPKFIAPAYAQTQPETVFAESDSDGEEKK

SEQ ID NO: 37761 - protein, 444 aa, Vibrio cholerae O1 biovar eltor str. N16961
MSVYYTLCFLSAAAMLIAFINSKISRMQTTIAITAGSMMLSLLILIAGQNDWFHLNQIATETVTSINFENFLLKGILGFLLFAGGLGIKLPNLKDQKWEITVLALGATLFSTFFIGFTLYGFCQLIGIQFDLVYCLLFGALISPTDPIAVLAIVKKLKAPKRISTQIEGESLFNDGFGLVIFVTIFTIAFGHETPTVGSVTLLFIQEAIGGIVYGFLLGLLFHYLISATDDHSMELLLTIGIPTAGYAFADVIHVSGPLAMVVSGIMIGNWTRFIGFSKESEEHLDHFWELVDEFLNGVLFLLIGMSMLLFEFHQEDWILMAFAVPLVLCGRYLSVFVSYIGFKRYRSYNPWSIRILTWGGLRGGLALAMALSIPSGIMVIPEKLIDVKELILVMTYAVVVFSILVQGSTITPMIEKAKKAEKALQAERNTDNQSPMPQQEQQH

SEQ ID NO: 37762 - protein, 479 aa, Vibrio cholerae O1 biovar eltor str. N16961
MLYKKHSLHNIGRWVTNNSFFRKSGRIAVSTFNVAKFGGTSVANFEAMSRCSAIIENNPQTRLVVSSACSGVTNLLVELANGVASTERRQAILQQLADIHYVIIDQLADPTRVEKEVKAVLDSVASAAEAASFQSSKKLTDHLVACGELISTYILTQLMRERGVDAVRFDIREVLRTDDHYGRAEPQLKEIAQLAKEKLVPLCEQYVVVTQGFIGSDAQGNTTTLGRGGSDYSAALIAEAVQASGLEIWTDVPGIYSTDPRIAPKAAPIPEISFSEASEMANFGAKILHPSTLLPAVRHGIPVFVGSSKEPEKGGTWIRKQVESAPLYRALALRCNQTMVTLRSAQMFHAYGFLAKVFEILAKHKISVDLITTSEISVSLTLDKTDTSGGAPELPEAVRAELEELCTVEVEYNLCLIALIGNKMKESRGYAKQVFSVLEDYNLRMICYGASAHNLCFLLHESVSKQAVQKLHKELFEQE

SEQ ID NO: 37763 - protein, 429 aa, marine gamma proteobacterium HTCC2080
MSKQLLKDALDYHALPVPGKISVELTKPADTMRHLAMAYSPGVAEPCSQIALDPQLAYRYTGKGNSVAVISNGSAVLGLGNLGALASKPVMEGKALLFKRFANINAIDVLVDTQDVDTFVSTVSAIACTYGGINLEDIKAPECFEIERRLQALCDIPIFHDDQHGTAIVTAAALVNALEIQQKTLDNVNVVCLGAGAAAVACMKLLLEMGADPGRMLMLDRQGVIHAGRENLNEQKALFAVNTDKRTLDDAMKDCDVFVGLSGSDLVSQDMVKSMAPRPIIFACSNPDPEIKRELAMATRSDIVMATGRSDLPNQVNNVLGFPFIFRGALDVRASTINEAMKIATVNALAELAREPVPESVLDAYSLIDLEYGPNYILPKPMDPRLMPIIAPAVARAAQASGVARCAIDDDYEEQLWGGVGFGTDRNWR

SEQ ID NO: 37764 - protein, 430 aa, Synechococcus sp. WH 7803
MFDSLDLVIDTIVAREVLDSRGNPTVEAEVLLEGGASGRAIVPSGASTGAHEAHELRDGGDRYMGKGVIQAVNHIEERIAPALCGLSALDQAAVDAAMLELDGSDNKSSLGANAILAVSMANARAAANGLGLPLYRYLGGPMATLLPVPLMNVINGGAHAANSLDFQEFMLVPHGAPSFREALRMGTEVFHTLKKLLSAKGMSTAVGDEGGFAPDLGNVEAGEILVEAIEKAGYKPGEQISLALDVASTEFFADGRYAFDGGSYDSAEMVGQLEKLVEQFPIVSIEDGLAEDDWEGWKLLTERLGSKVQLVGDDLFVTNTKRLQQGIDSSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGNA

SEQ ID NO: 37765 - protein, 372 aa, Vibrio cholerae O1 biovar eltor str. N16961
MTIRSFIPPHRILMGPGPSAISPQVLQALSRPTVGHLDPLFIGMMDELKQLLKYAFQTENEFTIAVSAPGSAGMEACFVNLVEPGDKVIVCRNGVFGERMRDNAVRCGAEVVVVDDEWGCPVSVEKVQATIDEHPDAKILAFVQAETSTGALSDAQALGALAKQHGLLTIVDAVTSLGGVPLLVDEWQLDAVYSGSQKCLSCVPGLAPLTFSPRAIEKIQSRKTPIQSWFLDQSLVLGYWSGAGKRSYHHTAPVNSLYALHEALLLLQQEGLEHAWQRHRLMHEKLKQGLEQLGFQFVVAEPYRLPQLNAIYVPEGIEEAKVRSHLLNEYNLEIGAGLGALAGKAWRIGVMGYGARSENIALCLRALEESLR

SEQ ID NO: 37766 - protein, 420 aa, Bacillus cereus E33L
MVQKVKERVKIEDILMAHNCMKDIVMKTPLQRDTVLSEKYDCDVYVKREDLQLIRSFKIRGAYNLIQSLPKEQLQNGVVCASAGNHAQGVAYTCNLLKIPSKIFMPTTTPKQKVAQVQFFGGDFAEIVLVGDTFDSSFQEAQRYCEENRMTFVHPFDDPYVVAGQGTVAVEIMHDMEKPVDYIFTAIGGGGLASGVGTYVKGVSPATQVIGVEPMGAASMKEAFLQNDNVALEKIDSFVDGAAVKKVGKLTFETCKDVIDDIVLVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLIIRFKENNIQFMELNKNPVLFDLLI

SEQ ID NO: 37767 - protein, 509 aa, Nostoc punctiforme PCC 73102
MVSLLENPLRVGLQQQGMPEPQIIVIFGASGDLTWRKLVPALYKLRRERRIPPETTIVGVARREWSHEYFREQMQKGMEEAHPDVDLGELWQDFSQGLFYSPGDIDNPESYQKLKTLLSELDEKRGTRGNRMFYLSVAPSFFPEAIKQLGSGGMLEDPYKHRLVIEKPFGRDLASAQSLNQVVQKYCKEHQVYRIDHYLGKETVQNLLVFRFANAIFEPLWNRQFVDHVQITVAETVGVEDRAGYYESAGALRDMLQNHLMQLYCLTAMEAPNAMDADSIRTEKVKVLQATRLADVHNLSRSAVRGQYSAGWMKGQAVPGYRTEPGVDPNSTTPTYVAMKFLVDNWRWKGVPFYLRTGKRMPKKVSEIAIHFREVPSRMFQSAAQQTNANILTMRIQPNEGISLRFDVKMPGAEFRTRSVDMDFSYGSFGIQATSDAYDRLFLDCMMGDQTLFTRADEVEAAWQVVTPALSVWDAPADPTTIPQYEAGTWEPEQAELLINQDGRRWRRL

SEQ ID NO: 37768 - protein, 376 aa, Sphingobium chlorophenolicum
MPRALVPALVLEIAFGIAIGPNGLDLMEPGPTMELLARIGFGMLMLIAGLEIDLDMLLARGRKAERTSPLTLALAMSLLTVAMAGAGAWLLLDPATPPLHLAIYAVILSTTSVGIVVPTIQERRLADGPYGQTVLSTALLADFFTMIAISVLAGIVVSGRAEGALGSLALVAVGGVAIWLLPKLLARIPVTRLDSRTSLPLIRLSLAVLFLVAWLAETLGSELVLAAFLAGLLLGRIIPRGSHRRETLEAIGYGFIVPFFFINVGLKFDIPALFASPTALLLVPGFVAVAFANKIIPSLLLIPAHGRRMAVAAGILLSARLSLIVAASDIATRIGVLDTATNAAMVLVAIISAALAPLLFNLLAEPSPTTLAKAEA

SEQ ID NO: 37769 - protein, 574 aa, Chaetomium globosum
MTDIREQGLNKPIAIAEYLFKRLHEIGIRSVHGLPGDFNLVALDYLPKAGLRWVGSVNELNAAYAADGYARTKGISAVLTTFGVGELSAINGIAGAFSEHVPVVHIVGCPSTISQRKGMLLHHTLGNGDFNVFANMSSQISCDMARLNKPAEVPDQIDHALRECWIRSRPVYIMLPTDMAEKKVDGARLDTPIDLSEPKNETEREDYVVDVVLKYLHAAKAPVILVDACAIRHRVLEEVHDLMEKTPLPVFVTPMGKGAINENHPSYGGVYAGTGSQPAVAERVESADLVLSIGALKSDFNTAGFSYRTSQLNTIDFHSTHCTVRYSEYPGVAMRGVLRKVNERVDLSKLCRPSSPEVANDVTKNRDSSETITQAFFWPRVGEYLKEDDIVVTETGTSNFGIWETKYPRGVTGVTQILWGSIGWSVGAAQGAALAAKDMGADRRTVLFVGDGSFQLTAQEVTTMLRHNLKVTIFLIYNEGFTIERYIHGMDAEYNDIVRWQYTDVPTVFGGSDKQVRKFVIKTKDELEKLLTNKEFNEAGGLQFVELWMPKEDAPRALKITAEIAAKNNAKMSD

SEQ ID NO: 37770 - protein, 321 aa, Gibberella zeae PH-1
MAVASIQDRTSEFKSVLAQAQRKQTSSKVSSQRRSLLTDAQKDAANGHPTGPPRRSDFARKAAEIGRGISATMGKLEKLAQLAKRRTLFDDRPVEINELTFVIKQDLSSLNQQIGALQTITKQQHPKADQEGEHNKNVVYLLQGKLTDVSVNFKDVLEARTKNIQASRSRTENFISSVSQHAQPSIQQSASPLYGTPARNSPAPGQDTLSLNPVGDQQLLMMEEAQPSNTYIQQRGEAIEAIEKTIGELGSIFGQLATMVSEQSEMIQRIDANTEDVVDNVEGAQRELLKYWNRVSSNRWLIAKMFGVLMIFFLLWVLVSG

SEQ ID NO: 37771 - protein, 109 aa, Emericella nidulans
GASEHVPPITSKAEFQEKVLNAKGFVVVDCFATWCGPCKAIAPTVEKFAQTYTDASFYQIDVDELSEVAAELGIRAMPTFLLFKDGQKVSDVVGANPGALEAGIKALLA

SEQ ID NO: 37772 - protein, 1063 aa, Gibberella zeae PH-1
MKERDTQNMNGTQIELDSLPTTDSIKHEPPILYGAGNWINGFRRAEPRPGYLPTDAPERFYDLRAANAKTANTALARELKGRHLQMIAFGGSIGTGLFVASGGSLYRGGPASLLLSYVLIGGMQYCTMQSLGELCVAFPIAGSFSAFSTRFLDPSWGFAMGWNYCLQWLFVLPLEIIAGAFTIGYWDETIDRSVFVSVFLLTIVAINLFGVKTYGEAEFIFSIIKITAIVGFILLAIVINIAGEPEGHYIGGMYWRNPGAFKNGFKGFCSVLVTSAFSFTGTELIGLAAAETANPRKSLPTAIKQVFWRIMIFYLVALLLVGLLVPSDDSRLVGGDNVADATASPFVIAIEKAGTSLLPGIMNAIILIAVISVGNSAVFGSSRTLAALAEQSHAPHIFAYVDRQGRPLMAILFASCIGLLAFLADVKYHDAIFNWLLSISALSTLFTWGSICLCYIRFRAAWSHNAHTIEQLPFKSNVGVAGAWVALIGYILVLLSQIWIAASPVYAPDIVDGASGVAQNFFLKVLAIPIILLFYICHKAFVVQYMGDVHMKAMEASYATILWGVALAVVGFLSHRIIAIALRPHSSRFNGLPRPKGQQPFAGHALRILRGGGPNDVYLQWTRQWPDAPFIRCLSWLNEEILLVNSLEACREVLQTNAYFFAKPGFFHTLVGEFLGLGLLFSVGEQHKRLRRIIAGPLSRPSIRKLFPTFVTYSQKLNREIGEALERSKSGIVEIEDLIIRVTLDIIGVSLLGRELRDFRSESSPLSFEQCYNAILAQPLAGQIISFINPFIPLRWLPVSANLNFIRAKSALKTMMEGLIEQRTAEVGAAKLMNEDDKLSDDLLTRMIEASAEESQKLSKEELIDITMQVIAAGHETTASALVWTAYSLAKDPASQQSLRAEIHSLGTEMSAKGIDELPFLDNVIREAMRVHSPTLIIPWEAQKDMTIAGTHIPKGTTVQIVPAMIQLNPEIWGSDADVFRPGRWEDMGGNASSPYAMETFSNGPRMCPGKALALLNMKVLLVGLIRDFEMEIVDDGKEVELRNPSLTLKAKSLIQFKMRKVS

SEQ ID NO: 37773 - protein, 313 aa, Sphingobium chlorophenolicum
MGLLIDGVWRDAWYDTKSSGGRFVRKESQYRGGLDAGFRGEPGRYHLYAGFACPWAHRVLIMRALKGLEEMISVSMVNAYMGENGWTFLPGDDVVPDSINGADYLYQVYTAADPTYTGRVTIPILWDKVEKRILNNESSEIIRILNSAFDDVGALPGDYYPAEFRPEIDRINARVYETLNNGVYRSGFATTQEAYEEAFYPLFDTLDWLEEHLTGREWLVGDRLTEADIRLFPTLVRFDAIYHGHFKCNLRRIADYPNLSRLVGKLASHERVAPTINLRHAKAHYYGSHPSVNPTGIVPVGPAQPLPGLTLQS

SEQ ID NO: 37774 - protein, 306 aa, Gibberella zeae PH-1
MAPSTFKLNTGQEIPAVGLGTWQSPAGEVEKAVTYALKDGYKLIDCAYCYGNEEEVGAGLKAAFKAGVKREDIFVVTKAWATYNTRVELALDKSLKALGLDYVDLFLVHWPLLLNPDGNDDKFPKKPDGSRDVIRDYNHVDGWKLMEKLPATGKTRAVGVCNYSKKYLEELLPHATIVPAVNQIENHPELPQQEIVDFCKEKGIHIEAYSPLGSTGGPVMSAEPVVKIADKKGVSASTVLLSYHGNTVLAKSVNPERITANKTIVDLDDEDMKALNDYSAELQKNNQVKRYVYPPFGIDFGFPDKS

SEQ ID NO: 37775 - protein, 461 aa, Zea mays
MASFSSLSASSSTSTPSFNLPAKTSAGTGSLSFHRARESQKSRARMVTVRAEAVDTTISPRVNALRPSKTMAITDQATALRQAGVPVIGLAAGEPDFDTPAVIAEAGINAIRDGATRYTPNAGTLELRKAICKKLEEENGLSYSADQVLVSNGAKQCITQAVLAVCSPGDEVLIPAPYWVSYPEMARLAGATPVILPTSISDNYLLRPESLASVINENSRILILCSPSNPTGSVYPKELLEEIAAIVRKHPRLLVLSDEIYEHIIYQPAKHTSFASLPGMWERTLTVNGFSKAFAMTGWRLGYLAAPKHFVAACGKIQSQYTSGASSISQKAGLAALNLGYAGGEAVSTMVKAFQERRDYLVRSFRELPGVKISEPQGAFYLFIDFSSYYGSEVEGFGTIKDSESLCLFLLEKAQVALVPGDAFGDDKGVRISYAAAMSTLQTAMGKIKEAMALLRPPVAV

SEQ ID NO: 37776 - protein, 432 aa, Enterococcus faecalis V583
MATKEIKMPHLGESVTEAAIVQWLVKPGDSVKRYDPLMEVVSDKVTTEVPSDFDGVVKEFLISLDTDVPIGTAVMTLETEETTEETEVATLAPVKEASAEQAQEHETAETTSTATSHQKNNGRYSPAVLKIAQEKKIDLTQVTGTGRDGRITRKDVTNFTPTQARTPEKTVSPGTSPSISEEPVASQNESAATASPTETSTDKIVSADPVRKAIAKKMVQSVNEIPHAWLMVEADVTNLVQLRNSLKDEFKQQEGLSLSFFPFFAKAVIQALKKNPKINTSWDDGSIIYHKDVNLSIAVTTDEHLYVPVIQQADNYSIAGLAKEINRLAQEVRQGTLASKEMQGGTFTLNNTGTLGSVQSMGIINHPQAAILQVESINKRLVPTADGGFKVADMVNLCLSIDHRILDGQQAGKFLRDVKDNLAKYNADTDIY

SEQ ID NO: 37777 - protein, 567 aa, Oryza sativa Indica Group
MASKAVPDVVTDKKCDKTMAASSEMSQSQEVISRGGKLGTASYRETLLGDVATSSGVKEQDKDSCSVDESVKLDGNEDAEKSSLRGSVKDSSASAKGSDRASSLTKVSGSTKVSDHAADIVGSSKSSVYRASAGSDVSDESTCSSICSSASKPHKSNDSRWEAIQMVRTKEGSLGLGHFRLLKRLGCGDIGSVYLSELSGTKCYFAMKIMDKASLASRKKLLRAQTEREILQCLDHPFLPTLYTHFETDKFSCLVMEFCPGGDLHTLRQKQPGKFFPEQAAKFYVAEVLLALEYLHMLGIIYRDLKPENVLVREDGHIMLSDFDLSLRCAVSPTLLKSSNPGVDPNQKGNPSYCVQPVCIEPACIQPSCVTTTTCFAPRFFSSKSKKEKKAKTDIASQVRPLPELVAEPTDARSMSFVGTHEYLAPEIIKGEGHGSAVDWWTFGIFLYELLFGKTPFKGSGNRATLFNVVGQSLRFPESPVVSFAAKDLIRGLLIKEPQHRLAYKRGATEIKQHPFFEGVNWALIRCATPPDIPKPVEIPRSVASTSQKATTTAEKGSDNYLEFDFF

SEQ ID NO: 37778 - protein, 565 aa, Bacillus sp. SG-1
MSYQALYRVWRPQQFIDVVGQQHVTKTLQNALLQQKISHAYLFSGPRGTGKTSAAKILAKAVNCERAPVAEPCNECDSCLGITDGSIPDVIEIDAASNNGVEEIRDIRDKVKYAPNVVSYKVYIIDEVHMLSIGAFNALLKTLEEPPKHVIFILATTEPHKIPLTIISRCQRFDFKRITARDIVGRMTHIADESGVQYEEKALHVVARAAEGGMRDALSLLDQAISFSQDRVTVDDALTVTGAVSQVYLNRLAKAIFENQVADALQALEELLFQGKDPARLTEDLVLYFRDMLLHQTAPNLEESLERVMLDEDFKELAERVSPQHIYKFIDILNEAQQEMKFTNHARIYIEVSIVKLCQLEVESNVSSPEIGQLLQKVQSLENELNQLKAKGIPAAQPDAAPAPKKRASSSRKGFKVPTGRVQEVLKTATKEDLNLIKSRWGEMLEVLNQRQMRSQAALLNDAEPVAASSNSFVLKFKYDIHCQMAMENAGFTEALSSILGQLTGNEYQAIGIPENQWQSVREEFIKHQRNDDPDSAAGGEAEEEDPLIAEAKKLVGEDLIEIRE

SEQ ID NO: 37779 - protein, 78 aa, Pseudomonas putida GB-1
MSTIEERVKKIVAEQLGVKEDEVTNEKSFVDDLGADSLDTVELVMALEEEFETEIPDEEAEKITTVQAAIDYVNSHKA

SEQ ID NO: 37780 - protein, 469 aa, Enterococcus faecalis V583
MAEQTDLLILGGGTGGYVAAIRAAQKGLNVTIVEKYKLGGTCLHKGCIPTKALLRSAEVFDTLKQAASFGIETEAASIDFSKIQQRKEGIIEQLHKGVEGLCKKNKIKILAGEGAILGPSIFSPVSGAVAVTFNDPTREEEIIVPKNVIIATGSSSKTLPNLPLDEEFILSSDGMLELEELPESIAIIGGGVIGVEWASLLNSLGVNVTIIEFLDRLLINESATISKELKKRLEQRGINILLGSKVQEAKVTGQKVQVEVAGQETLTVDKVMVAIGRQPNINKLGLQNTSVKYTDKGIEVNEFYQTTEGHIYAIGDCIDTLQLAHVAMKEGELAVQHLLGETVEPLNYTNVPRGVYTNPEIASVGYTRETLPAEKEVVIGTFNFNGNGKSLVYGETDGFIEVIRDKKTDDLLGVSMIGPHVTDLIAEASTAMYLDAAPIEIGEAIHAHPTMTEVLQEAALDTYGLAIHK

SEQ ID NO: 37781 - protein, 290 aa, Alteromonadales bacterium TW-7
MNASFLTEIILPLALALIMFGMGLGLTTTDFTRLFKKPIAIAMGLVGQIIAMPLLALGLCYLLNLPTPIAIGLMILAACPGGTMSNVVSQLAKANLALSVSLTAASTAISIITTPFIIGFAMHQFAPQDDASFSILTTSLGLFVITLVPVAIGISLRHFKSEFAIKSEPFFRRFSLFFMLAMIAALVIKERALLASSFNDVFWACISLNIGSMIIGLLIASLSKLSLTDSLTLGIEVGIQNASLAILIAISFLNKPEYAVTGGVYGLAMFIGPLLLIAGLKFKNKRLVNA

SEQ ID NO: 37782 - protein, 141 aa, Chromobacterium violaceum ATCC 12472
MAIERTLSIVKPDAVAKNVIGKIYDRFESAGLKIVAAKMKQLSRAEAEGFYAVHKERPFFKDLVDFMVSGPVMIQALEGENAVLKNRELMGATDPKKAEAGTIRADFAESIDANAVHGSDSVENAAIEVAYFFAASEISSR

SEQ ID NO: 37783 - protein, 169 aa, Cryptococcus neoformans var. neoformans JEC21
MAHPFTLLVTVGSTLFPSLTSHVLLPTFLSLLQSLGVQRLVVQYGRAELKLQDDVKQTLNIDSQGDGIGVWSDNDGDRVRDEKQNGMVVEVMRFTNDFEGLVGKSDAVISHAGSGSILTVLRRAPPIPLLVVPNRSLMDDHQSELADALYKDGYVMVASVDVELNEASW

SEQ ID NO: 37784 - protein, 246 aa, Streptococcus pneumoniae R6
MNKKRFHSKIRTENDGGKSVENLKKMAGIKAAEFVSDGMVVGLGTGSTAYYFVEEIGRRIKEEGLQITAVTTSSVTTKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 37785 - protein, 343 aa, Triticum aestivum
SGNSTDVFTPQPVKALQGIKIKQLACGDSHCLAVTMAGEVLSWGRNQNGQLGLGTTEDSLLPQTIQAFEGISVKMIAAGAEHTAAVTEDGEIYGWGWGRYGNLGLGDRNDRLVPEKVSSVEGEKMVLVACGWRHTITVSSSGSLYTYGWSKYGQLGHGDFEDHLVPHKVEALKDSSTSQISGGWRHTMALTSDGKLYGWGWNKFGQVGAGDNADHCSPAQVNFPEEQKVAQVACGWRHTLAFTEKKNVFAWGRGTSGQLGHGEIVDRNTPVIIDALSPDGPGSKKLESSAAIPFAAKIWVSPSERYALVPDEKVAKSGDVSARGNGADASVPENDVKRMRVSS

SEQ ID NO: 37786 - protein, 306 aa, Myxococcus xanthus DK 1622
MKVNNILETIGNTPHVRINRLFPSRVTVHMKLERANPGGSIKDRIALSMIEDAEQRGLLKKDSVIIEPTSGNTGIGLAMVAAVKGYKLVLVMPESMSVERRRLMAAYGATFELTPRAQGMKGAIARANELLSQVPNSWMPQQFENEANIEVHRRTTVQEILKDFPEGLDYLITGVGTGGHITACAEELKKVWPKLKVFAVEPTKSPVISGGQPGPHPIQGIGAGFIPKNLHKDALDGAIQVTEEDAFEFTRRAAREEGIFVGISTGAALSAVNQKLGEMTDGSRVLAFNYDTGERYLSIEPLFPAQ

SEQ ID NO: 37787 - protein, 335 aa, Shewanella oneidensis MR-1
MSKRTITVIPGDGIGPSIIDSALKILDKAGCDFEYEFADAGLAALEKQGELLPQRTLELIEKNRITLKGPLTTPVGEGFTSINVTLRKKFGLYANVRPVLSFKGTQARYENIDIITVRENTEGMYSGHGQKVSEDGSTAEATSIVTRQGAEQIATFAYELARKESRKKVTIVHKANIMKSTSGLFLKVAREVSLRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKAAPIRKAVSAVIEEGDRTTRDLGGTHGTTDFTQAVLDRL

SEQ ID NO: 37788 - protein, 187 aa, Legionella pneumophila str. Paris
MSTLTSLPNILTLMRISIIPVFIMVFYFPFKWAHPTAAVLFAIASITDWLDGYLARKLEMMSHFGAFLDPVADKLLVSTSLLLLVGAKDIDYITIPAIVIVGREIVISALREWMAEVGSRASVAVGYIGKVKTSLQMIALVLLLAFNPLVSWWGSLGFVLLYVSAILTIWSMVIYLAIAWPELMKKS

SEQ ID NO: 37789 - protein, 519 aa, Burkholderia xenovorans LB400
MLTQAAMSALSIDPNSAGAATAHGRCARIVPVILAGGSGTRLWPVSRENYPKQLIDVVGSDSLLQATARRMDGFPAGWKVDASPVIVCGEEHRFVIAEQLHENGVDARLIVEPARRDTAPALTLAASLACADGGDAILVVMPADHSIADVPALQAALERAAQYAEQGSIATLGVPPTRPDTGFGYIRIGAELAGGGHAIDGFVEKPAEELAAKYVAAGMYWWNSGIFIVRASVWLDTLKRLQPEMHSACERAFSGGRQDGAYFRPLVEAFLSAPANSIDYAVMERLTETAEPDATDGAAASAPAQPAGVVIGLDAGWSDLGSWDAVWAAMEKDANGNAGRGRVTFEGAVSSYAHSEGRLVACVGTTNVVVVETADAVLVVDRSHVQDVKGLVSRIKAQHAPEADAHRKVRRPWGFYDSIDHGERFQVKRIVVTPGAQLSLQLHHHRAEHWVVVRGTALVTRGDEQFLLSENESTYIPLGTRHRLENPGKVPLEIIEIQSGTYLGEDDIVRFNDNYGRCS

SEQ ID NO: 37790 - protein, 291 aa, Vibrio cholerae O1 biovar eltor str. N16961
MMIKKCLFPAAGYGTRFLPATKSMPKEMMPVVNKPLIEYGVDEAIQAGITGMCIVTGRGKHSIMDHFDMNYELEHQIRGTNKEELLGDIRKIIESANFTFIRQREMKGLGHAILTGKELVGDEPFAVVLADDLCVNEEQGVLAQMVALYKQFRCSIVAVQEVPENETHKYGVIAGEMIKDDLFRVDNMVEKPEPGTAPSNLAIIGRYILTPDIFDLIEQTEPGKGGEIQITDALLKQAKAGCVLAYKFKGKRFDCGSVEGYIEATNFCYENMYKKNDQKVELAKKSTHKGQ

SEQ ID NO: 37791 - protein, 553 aa, Cryptococcus neoformans var. neoformans JEC21
MSLADALLADLDGLSDDEARSPSPGPEASSSSMPPPGLPNKGKRPASAMEVDDGEGGANEDEGDDMKLEDGTSAVGFVPEGGVRPADELDKEEVEKTDMKGVEDVKKVARLAGSQKLRDVLADIIKYTESPTDMSSSAGPLEENPEYHLVVTANNMSVEVDNEILIVHKFIRDHYAPRFPELEQLIAEPWTYIAAVNAIGQSEDLTKVTFPNTLPAATVLSITLTATTSRGRPLTPAEWETIQRAIAVAQNLRSAREQIFSYVESRMAAVAPNLSAIVGTGIAAKLLGLAGGLHAFSRQPSCNVMLFGAMKKTLATSHLSAASQQRHTGFIFQSSIVQSAQPEDRRRAQRAVSAKCALAARIDAGKGSRDGSYGRKCLADLQKRIEKMAEPPPNKMIKALPIPQETNRKKRGGKRARKAKEAYAQTELRKLQNRMEFGKAEEEIGVDDETVGLGMIGSAGRVRGEMADARSKAKLSRANKLRTQLLGRSVTSNDAASGMATSLSFTPVQGLEIVTPSLSAAQKVQAANDRWFSGGTFTHVRKGGSSIPGQEQK

SEQ ID NO: 37792 - protein, 363 aa, Xylella fastidiosa 9a5c
MATIIPTAWQPFKSETPLTTFPFRFPAEWEPQSAILIAWPHANTDWSAHLADVEETYIALVAAITRFQMVIICVLDDDLQTYTEARLRSASVAMQQVRFTVASYNDTWLRDSGPITLIGTNRDFRLLDFRFTGWGGKFEAKADDQLVSVLHANGLFKNTQMHSINFALEGGAIETDGAGTLLTTWRCLHERHPQRTRKTLDANLTAWLAQNRVLWLEHGYLEGDDTDAHIDTLARFASTDSIVYQSCDNTTDSHYAELQAMANELTALRTTEGRAYRLFPLPWTKPILDQDRRLPASYANFLIIEGAVLMPTYDDPADTIAQSVLAEAFPTREIVPVPCRPLIWQNGSLHCITMQIPAGLLAT

SEQ ID NO: 37793 - protein, 397 aa, Myxococcus xanthus DK 1622
MPIVVQKYGGSSVAGVEKLRKVAQRVKDKREAGYQVVVVVSAMGDTTDELLALAKGVSVDPPRRELDMLLTCGERISMALLSMALQEMDVPAISFTGSQSGIITTDAHAQARIVEVRPYRIHDELARGKVVIVAGYQGVSFKKEVTTLGRGGSDTTAVALAAALDAEACEIYSDVDGVFSADPRVVPDARKLESLSYDEMQELASAGATVLNAQAVEWAKARGITILARTAHGQGTGTAVQELAVPTDHRLKGVTADAEMAVLSASEPIRLAELLEFLDARAVRGRTLDCEGSVGGVRRTVITVPLADIHGADALRRELATRFGDAVSWREDLGTVTCVGVGLNADWAPLRRALAAAEELGAHVHAAHTSPLQLTLLVDKAHLKALTARLHRELLGG

SEQ ID NO: 37794 - protein, 269 aa, Myxococcus xanthus DK 1622
MRAMRGKTVVVTGASAGIGEALAVVLAGRGANLVLAARNEEALQRVKARCESAGGRAVVVPTDVGDAEACRHLVERAVEAFGGVDVLVNNAGVTMDARVDEVKDLSLFDRLMRINYLGAVYCTHHALPHLKARRGLVVAVSSLTGKTGVPNRSGYAASKHAMHGFFDSLRIELRGTGVDVTVVCPGFVATNIRDSALGADGQPVRQSKHDESAGNMDVDTCVAIILRAMERREREVVMTTKARVAQFLKLVAPGVVDRITAKTIQDRRR

SEQ ID NO: 37795 - protein, 523 aa, Sulfolobus solfataricus P2
MALYEKPSMDKLIEDLKILKEKVYKGGGEEKINFQHGKGKLTARERLNQLFDEGKFNEILTFATTRATEFGLDKNRFYGDGVIAGWGKIDGRQVFAYAQDFTILGGSLGETHANKIVRAYELALKVGAPVIGINDSGGARIQEGALSLEGYGAVFKMNVMASGVIPQITIMAGPAAGGAVYSPALTDFLIMIKGDAYYMFVTGPEITKVSIGEEVSYQDLGGAIIHATKSGVVHFVAENEQDAINITKRLLSYLPSNNMEEPPYVDTGDPADRAVQSAESIVPTDSVKPFDIRDLIYNIVDNSEFLEVHKLWAQNITVGFGRINGNVVGIVANNSAYYGGAIDIDAADKAARFIRFCDAFNIPVISLVDTPGYVPGTDQEYKGIIRHGAKMLYAFAEATVPKITVIVRRSYGGAHIAMSIKSLGADLVYAWPSAEIAVTGPEGAVRILYRREIQSAQNPEELLKQKITEYKKLFANPYWAAEKGLIDDVIEPKDTRNVIARGLEMLRNKREFRYPKKHGNIPL

SEQ ID NO: 37796 - protein, 193 aa, Bacillus subtilis
MFNLPNKITLARIALIPIFMIIMLAPFDWGRLEVGDESIPVAHLAGAILFIIASTTDWVDGYYARKLNLVTNFGKFLDPLADKLLVSAALIILVQFDLAPAWMVIVIISREFAVTGLRLVLAGTGEVVAANMLGKIKTWAQIIAVSALLLHNLPFELVSFPFADLALWVAVFFTVVSGWEYFSKNWEALKTSN

SEQ ID NO: 37797 - protein, 394 aa, Listeria monocytogenes str. 4b F2365
MKNLVKVKVFPKFTKGYKEGYPLILKERMEKWPKELQEGDVLELTDTNGQFIARGYHGEQNKGSGWLFTWDKKQQLDEDFLTNLITTAIEKRQFLFADDSTTAFRIFNGEGDGLGGFTVDFYDDYLVIQWYSLGIYAFQKMIIDIFLSFPEIKGIYEKRRFQEDTKDDFVAGQKATFPLIIKENGINYATYLDDGWMTGIFLDQRDVRRRISEDYSVSKNVLNTFSYTGAFSVAALFGGASKTTSVDVAGRSLSKTKEQLEVNGLDPNEQAIIVEDVFHYFKYAARKQLTFDLVVVDPPSFARTKKVTFRAAKDYPAMLREIIDITAPNGTIIASTNYAGFGMKAFKKLIAEAFQTSDRTYKIVETHSLPADFTVNKNFPEGNYLKVLFLTLDI

SEQ ID NO: 37798 - protein, 473 aa, marine gamma proteobacterium HTCC2080
MSDRLANNFQFLDVRREDPPKKDMETRTEAFVEIYDAFDAGEAAEQSHRCLSCGNPYCEWKCPVHNFIPDWLKLLSDGNLFEAAELSHQTNTLPEVCGRVCPQDRLCEGACTLNEGFGAVTIGNAEKYITDTALAMGWRPDLSDVIPTGKSVAIIGAGPAGLGCADILARNGVKAVVYDLYPEIGGLLTFGIPQFKLEKQVMERRREVFEGMGIEFKLNTEIGVDVEIDTLMAEHDAVFLGMGTYKAMEGKFPGEDLPGVHKALDYLIGNVNEKMGYPQDPNNFIDLFDKTVVVLGGGDTAMDCVRTAVRQQADKVYCVYRRDEVNMPGSRREVQNAKEEGVEFLFNRQPVEVMEYFGEAIGIKVVETRLGEPGADGRRRPESVAGSETVIQADAIIMAFGFQPSPADWFEGQGVAVNDWDAVVAPEEQVFKFQTANPKIFAGGDMVRGSDLVVTAIWEGRQAAEGILDYLGV

SEQ ID NO: 37799 - protein, 482 aa, Rhodococcus sp. RHA1
MTDYDKLYIGGKWVAPATDQVLEVFSPATEERVGSCPVASPADIDDAVATARRAFDEGPWPQTTPAERGEILAKAAKLIEERGDALNALISSEMGQPPAMVGMMQQTPSLATLNFYAGLANEFEWEQTRTGAFGQTKVLREPVGVVAAVLAWNVPLFLAVNKLSPALLAGCTVLLKPAPESPLSTHLLAEIFAEAGVPEGVISVLPGGAETGEYLVSHPGIDKITFTGSSPVGRKIGAIAAQNLKRCSLELGGKSAAIILEDADLAATMPMLVMSGLMNTGQACVAQTRILAPRSRYDEVLDALVAGAGFMTVGDPSDPAAQLGPLISEKQRDRVEGYIAKGKEQGARVVLGGGRPEGLDKGWYVEPTIFADVDNSMTIAREEIFGPVLSVIPYDSEDEAIKIANDSDYGLAGSVYTTDIDHGLAVAKQIRTGTYAINWYAFDPGSPFGGYKASGIGRENGPEGLEAFCETKSVLMPPGYTG

SEQ ID NO: 37800 - protein, 236 aa, Saccharomyces cerevisiae
MKLNISYPVNGSQKTFEIDDEHRIRVFFDKRIGQEVDGEAVGDEFKGYVFKISGGNDKQGFPMKQGVLLPTRIKLLLTKNVSCYRPRRDGERKRKSVRGAIVGPDLAVLALVIVKKGEQELEGLTDTTVPKRLGPKRANNIRKFFGLSKEDDVRDFVIRREVTKGEKTYTKAPKIQRLVTPQRLQRKRHQRALKVRNAQAQREAAAEYAQLLAKRLSERKAEKAEIRKRRASSLKA

SEQ ID NO: 37801 - protein, 116 aa, Arabidopsis thaliana
  misc_feature (99)..(99): Xaa can be any naturally occurring amino acid
MDGTNTGTNDESGCTMSGSRYVNTTLAKYDIGENSTPKDATIQIINHELMLDGNPRLNLTSFATTWMEPECHKLIMDSINENYLDMDEYPGTTELQTRXVNMIGRLFNAPLEASAT

SEQ ID NO: 37802 - protein, 169 aa, Synechococcus sp. WH 8102
MDLSRLSPSPSSGLVNLLVEIPAGSRNKYRFSHSTGLMVLDRVLHSSIRYPFDYGFVPNTLAADGSPLDAMVIMAEPTYAGCLIRARPIGLLELKDNNVDDAKLLCVPDADPGQREIHSIRQIAPAQLEEVAEFFRTCRSFEGRSIEVSGWRDAGSVPALLDQCIQAAN

SEQ ID NO: 37803 - protein, 278 aa, marine gamma proteobacterium HTCC2080
MVTVMTAVHSVPIKKLQGGDPIWEQMRAETERAASQEPVLVSFLHATILHHDELECALSFHLANQLDSPTVPAMMLREIMLAAFSSDATLRSAIRDDLQAVLDRDSACQEYHLPFLYFKGFQALQTHRVAHWLWQENRHSLALFLQSQVSQKFGIDIHPAARFGHGIMLDHATGLVIGETAVVGNHVSILQSVTLGGTGKQDGDRHPKIGDGVLISAGAKILGNIIVGEGAKVGAGSVVLHDVPSHTTVAGVPAKVVGVPDSETPALDMDHALPESDW

SEQ ID NO: 37804 - protein, 141 aa, Synechococcus sp. WH 8102
MISALARLIQQLSRAAVALVLGLCLLLTACSGDAEARLTGDYVEDTIAVAHNLREVIDLPQDAANRGEAESEARALINDYMSRYRPQPRVNGLSSFTTMQTALNSLAGHYASYANRPLPEALHDRIAKELGKAEKSAVRGS

SEQ ID NO: 37805 - protein, 453 aa, Campylobacter upsaliensis RM3195
MSECPFFPKPYKNKASTLLTFLLKRRSWLDGLYERSYQMQTGYVKMPNFDLYVINDTKEVKRIMVDEVREFPKSELLHRLLSPLLGESIFTTNGEVWHKQRELLKPSFELTRISKVFNLMSEAVADLMMRFEKYPDNSYIEVDEMMTFVTADVIFRTIMSSKLNEVQGRQILEAFATFQEESVKTAMRGMFYFPKWLSYLLGDRKRAKAGELIRKVLSDIIKPRYEANLEKSDYGDILSSLLLVVDAKTNQRFSFEEILDQVAMLFLAGHETTASSLTWTLYLLSLYPKEQERAYNEICEVLQDSKEIKIAHLRQFKFLTNVFKESLRLYPPVGFFAREAKKDTQVRNKLIKQGSGVVIAPWLIHRHELFWQNPHGFDPSRFEREYKKEAYLPFGMGERICIGQGFAMQEAILILANILKTYKLELKEDFVPDVVGRLTIRSLNGMWIKFSKR

SEQ ID NO: 37806 - protein, 91 aa, Picea glauca
MEQQQDRRELDAKAREGETVVPGGTGGKSLDAQERLAEGRSRGGQTRKEQIGSEGYQEMGRKGGLSSAGGPGGERASEEGRPIDESKYRHP

SEQ ID NO: 37807 - protein, 109 aa, Glycine max
  misc_feature (63)..(63): Xaa can be any naturally occurring amino acid
  misc_feature (96)..(96): Xaa can be any naturally occurring amino acid
ASSMISSPAVTTVNRAGAGMVAPFTGLKSMAGYTTIKTNNDITFIAINGGRVQCMQEWPPIGXTKYEILYYLSDLDDAQLAMEIEYLLTKGWILYXEFNWEHCFMYREH

SEQ ID NO: 37808 - protein, 868 aa, Gibberella zeae PH-1
MGATDIASRLRARFTKRRHSTAGSQASSNHSVTDISSSVGSRQVADRDRDRARSRQNGDGDRSSRAVSNSRGTLSSRRGMTATTDDSQRQRKDSDEFTKIKVSRRVSEPEPEPANSNSDSAENTSLETDGEAPGAVPPVKDHSTTRDAALKHSTPPVDQESLGEEPATAATSSSCSSSSSDQHQPPPSSDLRPPQPQPQINPPPLISPSLHQQEQSSPSRPRQASSNLDRIHEDAQDSDSDLESPTARSRAVASLDLDAASELAGHNDDDPLSLDQAPNSPRSVAFAPLAAATSTNFVTPSPGLPSSGILSVPGSPTARPAPPPRRQSLLSNRQTTLINTLLSNQSTHEPSITQPPTYAPINGNMVTRKIWVKRPHASPTLVTVNEDDLVDDVRDMILRKYSNSLGRSFDSPDINIRVIPRDQHSERVLNPEEPMGRTLDAYYPGGQTVEEALVIDIPRRAPKASPCPVIPAYVGNVYYSEDGRPTETSDGYFPSVGVGTHPGAVGSPHLPMAVPTHVNTQGQQHSIAVLGTGIIPPIPSPGRTRTHQSHPSRPGIVRTHTSSPTTIAGPSSVSLAAAAAVNHASHGTQHFSRLPHSRTHSNSSDAPGMPPAAPPLPTPPAPEPTYAPTPPARPSSPRPIPKTRKTKKSEHPSLPPGMLNGGVPPINVLIVEDNPINLKLLEAFVKRLKVRWSTAMNGRDAVKKWRSGGFHLVLMDIQLPVMNGLDATREIRRLERVNSIGVFSSSPDGEITTENPDEVDEKDRLDNTSLFKSPVIIVALTASSLQSDRHEALAAGCNDFLTKPVNFVWLERKVMEWGCMQALIDFDGWRKWKEISQEAEENEAAKKAAVAAAKAKSKKNRVSMTKPG

SEQ ID NO: 37809 - protein, 80 aa, Wolbachia sp. wTai
MKIIIGSASKRLGDSIISGLHAQLFPTQVSRFADGEVNVEVANDLRDQEVYVVQSLSSPVNDNLMELLLTIDAAKRSGAK

SEQ ID NO: 37810 - protein, 767 aa, Azoarcus sp. EbN1
MDQDFITAALDYHRSPTRGKISVVPTKSLTNQRDLALAYSPGVAAACDAIVADPGQARELTSRGNLVAVVTNGTAVLGLGNIGPLASKPVMEGKGCLFKKFANVDVFDIELAERDPDKLIDIIASLEPTLGGVNLEDIKAPECFYIEQKLRERMNIPVFHDDQHGTAIISSAGLINGLKIVGKDIGEVKLVCSGAGAAAIACLDLMVGLGVKRENVFVCDSKGVIRVGRDENMEPNKARYAQCTDATTLGEVIEGADVFLGLSTAGVLKPEMVKRMAKKPLIFALANPNPEILPEVAKEARPDCIIATGRSDYPNQVNNVLCFPFIFRGALDAGATKITEEMKLACVKAIAELARAEQSDIVAAAYGNADLHFGPDYIIPSPFDPRLIVKIAPAVAKAAMESGVATRPIEDFAAYAASLSDFVYQSGIVMKPVFSAAKRIPAEFKRVLYAEGEDERVLHAARVVIDEELARPILIGRPSVIEMRIQKIGLNLVPGRDFDIINPESDPRYRELWQEYHRMMCRDGVTPELAKAKMRRDTTLIGCMVLRRGDADALVCGTFGSYDYHFKTVEDVIGLKKGSKLFAAMSLLLLPKRMLAITDPYVNENPSAEEVAEIARMAAEELRRFGIEPRVALLSHSNFGSSRSTSARKMREASEILRRIAPGLECDGEMHGDSALSPDIRKKSNPESMLAGEANLVVMPNLDAANISFNLMKIANGDGVSVGPMLLGAALPVHILTPSATVRRLVNITAVSVVDAFEQRQFAAAQE

SEQ ID NO: 37811 - protein, 424 aa, Zea mays
MEMESCKLFIGGISWETTEDRLREYFQSFGEVLEAVIMKDRATGRARGFGFLVFSDPIVAERVVFLRHVIDGKLVEAKKAVPRDDHVVLNKSYNTSLQGSPGPANSKKIFVGGLASSVTEAEFKKYFAQFGVITDVVVMYDHRTQRPRGFGFISFESEDAVDKVLQRTFHELNGKMVEVKLAVPKEMALNPIRNQMNVNSFGSSRISALLMNEYTQGFSPSPISGYGVKPEVRYSPGLGNRGGGFSPFGHGYGIELNFEPDQSQNFGSGSSAGFGRPLSPGYAPSLGRYGSQIESGGAGNGPVLNAATKNHLWGNGGGLGYMSNSPISRSSFNGMSSLGSIGDNSRRNSYRSEGGGGLGLEAMRGGHVGGYSSGSSSLETDSLYSDSAWLSLPAKAEERMGAFDFMSRGPAGYINRQPNGGIAA

SEQ ID NO: 37812 - protein, 271 aa, Novosphingobium aromaticivorans DSM 12444
MTDSKVPYFHVDAFAARPLGGNQAAVMILEAWPDDATLQAIGAENMFAETAFLVADYTGEADFELRWFTPAVEVPMCGHATLASGHVVLGQDPMRGRVTFRTRKAGILEVSRDGDRYVLSLPAVATEPGSFDEAVPLLGAPVPVEVWQGPGYNIFLYASADDVLALSPDFKALLRFGDVQFIATAPGAGHASGAEIVSRVFVPGGGIDEDAATGSAHAALTPFWAARLGKTAFAAHQASARGADFACRLEGGRVLLGGDCVTVVEGLFRLP

SEQ ID NO: 37813 - protein, 631 aa, Myxococcus xanthus DK 1622
MSQSPSQTPSPSGLRIQPSDSPGDAGASAAQDPERYWLEHVYQGGVRQLTVRAVIAGMVIGAVMCLSNLYVILKTGWSLGVTITACILAFAVFGTLRSIRVLKTEFTDLENNAMGSVASAAGYMTGGGNMAAVPALLMLTGTLPSSGWLMVWFAVISALGVFAAIPIKRQLINVEALPFPTGTATAETIRALHGHGEVARRKSRLLGIAGGIGALVVALRDARFTWLANIPEKVSLPFTMLGKKASAWSLSFEFSLLLVGAGALVSFRTGWSMLLGAVLTYGFLAPAMVSQGAIGEVTYRAINSWMVWTGSAVLVSSGLLSFAFQWRSVARSFKSLSGLFKGKNAKEEDADPLAGIECPPAWFPLGFAILGPVAVFLMAYLFQIPWWAGVLAMPLAVVMGVIASRVTGETDTTPTKALGPVTQLIFGGLAPGNIPANVMSANATGGVGLHSADLLTDLKSGWLLGANPRQQFVAQLFGVVAGAAVVVPVFKILVPDASMLGTEEFPAPASMVWAGVSKLLATGVAALPGSARMGALCGAALGIFLVLLERWAPAKAKAYVPSPAGFGLAIVIPGSSSIAFFLGSAIAELLRRTKPKLAEDMVLPVSSGFIAGESLLGIGIAMAKAFGVMPK

SEQ ID NO: 37814 - protein, 184 aa, Myxococcus xanthus DK 1622
MHPPVPSLTDTTLVADLNARLRDVPDFPKPGIVFKDITPVLADPRLFGRVIDAMSAPFRGQHVTKVVGVEARGFLLGAPIALALNAGFVPARKPGKLPHRSVVERYSLEYGSDGVEMHEDAILQGERVLVVDDVLATGGTAEATARLVSRLGGELVGFCFLLSLDFLEGPNRLGRERVTTLLTF

SEQ ID NO: 37815 - protein, 399 aa, Zea mays
PRVRVLPVMIDVGTNNEKLLKDPLYLGLQEHRLEGDEYVSVIDEFMEAVFTRWPNVIVQFEDFQSKWAFRLLQRYRKTYRMFNDDVQGTAGVAIAGLLGAVRAQGRPMIDFPKQRIVVAGAGSAGIGVVNAASRTMARMLGNNDVAFESARSQFWIVDAHGLITEDREDIDPDARPFARRKSELGHQGLSEGASLVEVVKKVKPDVILGLSAVGGLFSKEVLEALKDSSSSRPAIFAMSNPTKNAECTPGEAFSILGEKVIFASGSPFHDVDLGDGKIGHSNQGNNMYLFPGIGLGTLLSGARVISDGMLQAAAERLASYMKEEEVLEGIIYPPISRIRDITKEVAAAVVREAVAEDLAEGYRDMDARELARLSEEETNEYVKTNMWSPVYPTIIYKKD

SEQ ID NO: 37816 - protein, 329 aa, Legionella pneumophila str. Paris
MNKKTIAMLGAGSWGTAVAIHLAKIGHKTLLWSHNPQHVALMAEQHSNPAYLPGIPFPENLIPSDDLIECVQLADYVIIAVPSHAFAEIINKIPKPTQGLAWLTKGVDPASHQLLSQLVASRFGVDFPIAVISGPSFAKEVARFLPTALTLASNNTNYQKKMHQLFHHDNIRVYLSDDLIGVQLCGAVKNILAIACGISDGLGYGANAKAALITRGLAEMTRLGLSMGARQDTFLGLAGVGDLVLTCTDDQSRNRRFGLLLGREVPIPEAEHQIGQVVEGKHNAAQICAIANKNKVEMPICEQINALLHGIVHAQQAVNNLMSRPAKEE

SEQ ID NO: 37817 - protein, 212 aa, Glycine max
  misc_feature (65)..(65): Xaa can be any naturally occurring amino acid
MRLSLRHALVFALIGALWNLQRAEGIRFVIDRDECFSHDVKYEGDTVHVSFVVIKADSPWHYGDXGVDLVVKGPSGEQIQDFRDKTSEKFDFVAHKSGVHKFCFTNKSPYHETVDFDVHVGHFSYFEQHAKDEHFTPLLEQIGKLEEALYNIQFEQHWLEAQTDRQAIVNDAMSRRAVHKAIFESAALIGASALQVYLLQRLFERKLGTSRV

SEQ ID NO: 37818 - protein, 305 aa, Bacillus cereus E33L
MKLCENITELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKEIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGAGKKVLCIAPDTGERYLSMGLFE

SEQ ID NO: 37819 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMNWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 37820 - protein, 134 aa, Oryza sativa Indica Group
MAGRLTAAGSRVLGGQGAAARAAVSALRHRAGMGLPVGRHIVPDKPLPTNDELVWDNGTPFPEPCIDRLAPHIGKYEALAWLCGGLGFFATLGLAATLNNKASKIPYVSAKYFIVIFYFLLDGQTVELLAFQQQ

SEQ ID NO: 37821 - protein, 293 aa, Synechococcus sp. WH 8102
MPEPIQSGDDALRVSVLSEALPYIQRFSGRRIVIKYGGAAMAHAELREAVFRDLALLACVGVQPVVVHGGGPEINQWLKRLEIPAEFRDGLRVTDADTMDVVEMVLVGRVNKQIVNGLNQLGTRAVGLSGSDGSLVEARPWGDGSHGLVGDVARVNPDVLEPLLERGYVPVISSVAATPGDGRAHNINADTVAGELAAALEAEKLILLTDTPGILRDRDNPNSLIRKLRLSEARQLIDDGVVAGGMTPKTECCIRALAQGVSAAHIVDGRVPHALLLEVFTDAGIGTMVVGRG

SEQ ID NO: 37822 - protein, 308 aa, Glycine max
MENSYKANGNGPTENGYSVARHSYQPSLKGSLPWLDIRVFYVRVCKCELDDSTPGFLTLNHVPLNPDTLLEINGVRTSIYSDGMSTLLKRDRVDRKSEEVTFVSTDSIRMSGSVKFEVFDKDVLLLSGALELCNTNGVVGESSYNGQRWSMNCESYIIPGTSFFKGKQLLLPDSSLPTIEVYIAGSFLSTPIILTKTLQLSQKKHAKKGVLDAIPEHEASENGKDTSSTLSLQAPDYLYDKHEDEDYNSVYPGTAYADGEDGELSWFNAGVRVGVGIGLSVCLGIGIGVGLLVKTYQGTTSHFRRRLF

SEQ ID NO: 37823 - protein, 331 aa, Campylobacter upsaliensis RM3195
MAIKVAINGFGRIGRCVARIIAERDDLELVAINDTTELELTKYLLKYDTVHGEFNASVELENSDLLINNKKVKMFYTRDINELDFAKYGAELVFECTGAHLTQEKCQAFLNKGIKKVLMSAPAKDNTPTFVMGVNSHLYKGEAIISNASCTTNCLGPVCRVLQDNFGIEKGLMTTIHAYTNGQSIIDAKAKDKRRSRAAAQNIIPTSTGAAKAMKLVMPELDGKLHGQSMRVPVIDVSSVDLTALLSKKVSKEELNEAFRKASETNLKGILAVDDEERVSSDFITSPFGAVVASDLTQVISEDFVKIVAWYDNEWGYSSRLVDMAVYVMGA

SEQ ID NO: 37824 - protein, 333 aa, Geobacter metallireducens GS-15
MGLMDQIKAKARNKLQTIVLPESYDDRMYAAAQQIVEQGLARVVMLGNADAIAKKAADLGADISKVELIDPASSPKLSDYADALVELRKSKGLTKEEALKLLTAADNLYYAGMMVRQGDAGGEVAGATGTTGDVLRAAFQTVGPAPGIKTVSSFFFMVTKTPSFGENGIIFFADCAVNPNPDAQALADIAVATARNCKAFLDVDARVAMLSFSTKGSATHADVDKVLKAMELAKGIDPALQIDGELQADAALLPKVGERKAPGSAVAGKANVLVFPDLDAGNIAYKLVERVAGAEAIGPIIQGLAKPVNDLSRGCSVDDIVNVAAITAVQAQG

SEQ ID NO: 37825 - protein, 396 aa, Campylobacter upsaliensis RM3195
MKSEIISIKDIDLAKKKVFIRCDFNVPQDDFLNITDDRRIRSAIPTIRYCLDNGCSVILASHLGRPKEISSKYSLEPVAKRLSRLMSKEVLLAKDVVGEDAKKKAQNLEANEILMLENLRFEKGETKNDENLAKELASMAEIYINDAFGVCHRAHASVEAITRFFDVKAAGFLLQKEIKFADNLLRHPARPFVAVVGGSKVSGKLQALINLLPKVDKLIIGGGMAFTFLKALGYDIGNSLLEEELLEDARAIMKRGRELGVKIYLPVDVAVARTCSSEAFMSYVPTQEIPSGFMGLDIGPASGKLFREALADAQTIWWNGPMGVFEIEKFAKGSLKMAHFIGDSHATTIIGGGDTADVVARSGEADEMTFISTGGGASLELIEGKELPGVKPLRGE

SEQ ID NO: 37826 - protein, 127 aa, Candidatus Tremblaya princeps
MHRMPILLPGTGTIGLARRISSLCCIRVGLMECGCYADGERYVEIADDVRNDDVFLLHALSHPVNDSIIELILASDASLRALASSVTLVIPYMAYGRQDKHAHGARLPLSARCIASLLSRAGARCIV

SEQ ID NO: 37827 - protein, 225 aa, Campylobacter upsaliensis RM3195
MIYAANLKCNHTRASFELYLKALNEVLKTQNENVFVFPPSVAFSQKESFFTQGAQNFYPCINGAFTGELGKEHLDEFGIKCVLIGHSERRIFENEALIKAKFDFAKEQGWQIFLCIGEDLKTKQKGLAKDFLKKQLENLDLNYEKLIIAYEPIYSIGTGVSAKNEDIEAILAFLRTLTKVSLLYGGSVNETNIKELTQIKHCGGVLVGSYALKVENFITLIKESK

SEQ ID NO: 37828 - protein, 328 aa, Glycyrrhiza echinata
MASSTSTTTSKEIDRELPPLLRVYKDGTVERFLGSSFVPPSPEDPETGVSTKDIVISENPTISARVYLPKLNNTTEKLPILVYYHGGAFCLESAFSFLHQRYLNIVASKANVLVVSIEYRLAPEHPLPAAYEDGWYALKWVTSHSTNNNKPTNADPWLIKHGDFNRFYIGGDTSGANIAHNAALRVGAEALPGGLRIAGVLSAFPLFWGSKPVLSEPVEGHEKSSPMQVWNFVYPDAPGGIDNPLINPLAPGAPNLATLGCPKMLVFVAGKDDLRDRGIWYYEAVKESGWKGDVELAQYEGEEHCFQIYHPETENSKDLIGRIASFLV

SEQ ID NO: 37829 - protein, 358 aa, Pseudomonas sp. Y2
MSQFHSLTVKQVRSETRDAVSILFDVPGDLRETFRFTQGQYLVLRTHLDDEEVRRSYSICTGINDGELRVAVKKVAGGRFSAFANETLAAGDVLDVMPPSGSFHVALDPARHGHYLAVAAGSGITPILSIVKSTLEAEPNSRVTLLYGNRASGGALFREQLEDLKNRYLQRLNLIFVFSREQQDIDLYNGRIDAAKCEQLFSRWLDVPNLDAAFICGPQEMTETVRDALKAKGLASERIHFELFATAGNEQRRQAREAARQVDSAVSQVTVISDGRALSFDLPRNSVSVLEAGNAIGAELPWSCKAGVCSTCKCKVIEGEVEMDSNHALEDYEVAAGYVLSCQSYPVSERVVLDFDQL

SEQ ID NO: 37830 - protein, 127 aa, Candidatus Tremblaya princeps
MHRMPILLPGTGTIGLARRISRLCGIRVGLMECGCYADGERYVEIADDVRNDDVFLLHALSHPVNDSIIELILASDASLRGLASSVTLVIPYMAYGRQDKHAHGARLPLSARCMASLLSRAGARCIV

SEQ ID NO: 37831 - protein, 169 aa, Oryza sativa Japonica Group
MAATADNGEKMIVLISSDGERFELSEAAASQSKTLSHMIEDDCTDNGVPLPNVTAVVLAKVVEYFKKHAAVTPKPATEAVAADKAKREEELKSFDAEFVDVDRTMLFELILAANFLNAQDLLDLTCQHAADLIKDMSVEEVREVFNITNDFTPEEEAEVRKENAWAFDN

SEQ ID NO: 37832 - protein, 324 aa, Azoarcus sp. EbN1
MPHAIRFHRTGGPEVLQWEAVDVPPPAQGEARVRQHAVGLNYIDTYHRTGLYPAPLPSGIGLEAAGVVEAVGEGVDDLAPGDRVAYAGGPLGAYADLRNMPADRLVKLPDPVSFEQGAAMMLQGLTAQYLLRRTYRVQPGDTILIHAAAGGVGLIVCQWAKALGATVIGTVGTDEKAALARAHGCDHSIVYTRENFAERVREITGGEGLPVVYDSIGKDTFMESLGCLRPLGMMVLFGAASGPVPPFDLGLLAKMGSLFITRPTLFTYSAKRPDLLAMAADLFEVVVSGKVRIEVNQRFALKDAAQAHRELEARRTTGSSILLP

SEQ ID NO: 37833 - protein, 395 aa, Arabidopsis thaliana
MEKKLKRRESMSTTAAESPPAKRRRTVTGNENSALIEGLPDHISEICLSLVHRPSLLSAVCTRWRRLLYSPEFPSFPSLYALFVDSTSDTGRVNPSVRFMCFNPVSSKWYPLPPPPPDPPLHRILYRHPSFISFNLPIQCVSAAGKLILIAGSNQQLSPAISHPLIFDPISSSWSSGPRIGSPRRWCATGACDGAIYIASGISSQFSSTVAKSVEKLDLTEQNRNNHRFNWEKLRDMRDLRFSREAIDAVGYRRKLLMVNVKGDAVKEGAIYDVVKDDWEPMPEEMLVGWRGPVAAMEEEILYSVDERRGTVRKYDDEKREWREVVVVEGGEEMLKGATQVTADSGKLCVVTGDGKIVVVDVAAEPAKIWNVEIPDGLEPVSVHVLPRMSQPNFC

SEQ ID NO: 37834 - protein, 41 aa, Triticum aestivum
FIHVDSNFSEYGLSDQYSFQHTAVQYATCLQQLMAAVTVRG

SEQ ID NO: 37835 - protein, 550 aa, Enterobacter cloacae
MRTPYCVADYLLDRLTDCGADHLFGVPGDYNLQFLDHVIDSPDICWVGCANELNASYAADGYARCKGFAALLTTFGVGELSAMNGIAGSYAEHVPVLHIVGAPGTAAQQRGELLHHTLGDGEFRHFYHMSEPITVAQAVLTEQNACYEIDRVLTTMLRERRPGYLMLPADVAKKAATPPVNALTHKQANADSACLKAFRDAAENKLAMSKRTALLADFLVLRHGLKHALQKWVKEVPMAHATMLMGKGIFDERQAGFYGTYSGSASTGAVKEAIEGADTVLCVGTRFTDTLTAGFTHQLTPAQTIEVQPHAARVGDVWFTGIPMNQAIETLVELSKQHVHTGLMSSSSGAIPFPQPDGSLTQENFWRTLQTFIRPGDIILADQGTSAFGAIDLRLPADVNFIVQPLWGSIGYTLAAAFGAQTACPNRRVIVLTGDGAAQLTIQELGSMLRDKQHPIILVLNNEGYTVERAIHGAEQRYNDIALWNWTHIPQALSLDPQSECWRVSEAEQLADVLEKVAHHERLSLIEVMLPKADIPPLLGALTKALEARN

SEQ ID NO: 37836 - protein, 199 aa, Azoarcus sp. EbN1
MAVLVGKQAPDFAAAAVLGDNQIQDITFSQFTKGKYAVLFFYPLDFTFVCPSELIAFDHRLDEFKKRGVEVLGVSIDSQFTHLAWKNTPVNSGGIGQVQYPMVADTKHEICRAYDVESEGGVAFRGSFLIDKAGVVRHQVVNDLPLGRNIDEMLRMVDALQFTEEHGEVCPAGWNKGKAGMKADPSGVADYLAHHAESL

SEQ ID NO: 37837 - protein, 308 aa, Burkholderia vietnamiensis G4
MTAPNAGAGRVTVVGSLNMDLVVRAPRLPLPGETLAGRAYAQAAGGKGGNQAVAAARLGAQVAMIGCVGADAHGAALRAGLEAEGIDCSRVATSASASTGVALIVVDDASQNTIVIVAGGNGEVTPATVAQHEAAIAAADVLICQLETPPDAVFAALSAGRRLGRTVVLNPAPAVAPLPDGWLPLVDYLIPNEVEAAALTGLPVRDPADAEAAARALQAAGARNVLITLGARGVQALSADGAARHYPAPVVQALDTTAAGDTFIGGFAARLAAGDGVDAAIRFAQRAAAVSVTRAGAQPSIPTLAELA

SEQ ID NO: 37838 - protein, 562 aa, Azoarcus sp. EbN1
MTRFRPKLLDTLPGYGRATFINDFSAGVTVGVLALPLAMAFAIASGMSPTAGVWTAIVAGFLISAFGGSKVQIGGPTGAFIPIVYAIVADFGVQNLLIATMMSGVMLLGMGAFKLGSMIRFIPVSVVIGFTNGIAVVIFISQIKDFLGLDIENMPGEFFGKMETLLAAMHTIDLPTVAISIASLAVLIAWNHAARQIAWMRRLPGPLAVLLVATAVNALVHLPIDTIGSRFGGIPQELPDIGLPALSLGTLGKLIAPALTIALLGAIESLLSARVADNLIDDRHDPNQELIAQGFANVVAPLFGGFAATGAIARTATNVRSGGHTPIAGMVHALVLLAVVLALAPLASDIPLAALSAIVVMVSVNMGEWHAFAWKDLARYSNQYRLILLGTFFVTVVFDLTLAVELGMLLASLFFIYRMSDLTRIERIPLEDYYGVEALSRSDDTPRIIAYRVFGSLFFGAANKLENLLLMQEGHPDAVILDLEKVINIDTTGLDALQTLHRTLQKRGAQLILCDLNDQPASLVFRSGFQASLGDDNIAANMTEALIRAQQLRGYEPELSYA

SEQ ID NO: 37839 - protein, 232 aa, Neisseria animalis
DQGAGVTYLEPTGSQIGHKESIKDTARVLGRMYDGIEYRGFGQEIVEELAQYAGVPVFNGLTNEFHPTQMLADALTMREHSSKPLNEIAFAYVGDARFNMGNSLLLLGAKMGMDVRIGAPKALWPSENIIAQARALAEETGAKVTLTENAEEAVQGVDFIHTDVWVSMGEPKETWEERIALLKSFRVTPELMAASGNPNVKFMHCLPAFHNRETKVGEWIYETFGLNGVEVT

SEQ ID NO: 37840 - protein, 232 aa, Neisseria flava
DQGAGVTYLEPSASQIGHKESIKDTARVLGRMYDGIEYRGFGQDVVEELAKYAGVPVFNGLTNEFHPTQMFADALTMREHSGKPLNQTAFAYVGDARYNMANSLLVLGAKLGMDVRIGAPKTLWPSENIVARARAVAEETGGKILLTENAEEAVKGADFIHTDVWVSMGEPKEAWQERIDLLKDYRVTPELMAASGNPQVKFMHCLPAFHNRETKVGEWIYETFGLNGVEVT

SEQ ID NO: 37841 - protein, 312 aa, Cryptococcus neoformans var. neoformans JEC21
MVCLVSLLAVRQPVKMPQANLYQQGLCHSRKAHPPPHGGYGGGYNQQPMGMGMGGGPGGGGFGGPGGHHGGRPGGGGGFGGPGGGGGFGGPGGGGGYGGPGGGGGFGGPGGGGGGGGRWRNILLYTFHMSAEGAREAFINSQSTSPSPPTSPTRSPVPPSTSRTSSWPTIPRTPITRSKTTMMTPWSLVDHDHTWWHPESWTAHTHTHPHTHSHSHRADEGRSTTRDDDRLVATGDAETLIKFATTLLSGSKKSWEMGSIEFGICDLLSPHIKPIIACYVRLRRATREKRRTPCRAMTPRQFPNWGWWSLAE

SEQ ID NO: 37842 - protein, 358 aa, Picea sitchensis
MSCFEGKYRDELIANAAYIATPGKGILAADESTGTIGKRLASINVENIETNRRQLREFLFTAPNAVQYLCGAILFEETLYQKSAAGKPFVDILNEGGVLPGIKVDKGTVDLAGTKGETTTQGLDGLAQRCQQYYNAGARFAKWRAVLKIGTTEPSPLAIQENANGLARYAIICQENGLVPIVEPEILVDGPHDIKTCAAITERVLAACYKALNDHHVLLEGTLLKPNMVTPGSDAPKVTPEVIAEYTVRALQRTVPPAVPGIMFLSGGQSEEEATLNLNAMNKLQTKKPWTLSFSFGRALQASTLKTWAGKTENIPVAQAAFLSRCKANSEATLGKYAGDSSKGNGVSESLHVKDYKY

SEQ ID NO: 37843 - protein, 422 aa, Saccharomyces cerevisiae
MNQCAKDITHEASSIPIDLQERYSHWKKNTKLLYDYLNTNSTKWPSLTCQFFPDLDTTSDEHRILLSSFTSSQKPEDETIYISKISTLGHIKWSSLNNFDMDEMEFKPENSTRFPSKHLVNDISIFFPNGECNRARYLPQNPDIIAGASSDGAIYIFDRTKHGSTRIRQSKISHPFETKLFGSHGVIQDVEAMDTSSADINEATSLAWNLQQEALLLSSHSNGQVQVWDIKQYSHENPIIDLPLVSINSDGTAVNDVTWMPTHDSLFAACTEGNAVSLLDLRTKKEKLQSNREKHDGGVNSCRFNYKNSLILASADSNGRLNLWDIRNMNKSPIATMEHGTSVSTLEWSPNFDTVLATAGQEDGLVKLWDTSCEETIFTHGGHMLGVNDISWDAHDPWLMCSVANDNSVHIWKPAGNLVGHS

SEQ ID NO: 37844 - protein, 337 aa, Sulfolobus solfataricus P2
MKLYEYEGKSLFKRVGIPVPNGVVTSEPIRWQGKAVVKSQLLEGARGKRGLVRVTEDIYNTILELKKLGVEKFLVEEFVPHEKEIYASVLLDRETAEPMLVLSREGGIDVEQAKDVKKMIIPLERGVRSYDIVEAEKYLGVKGLGQIIQGLYKLFVDYDAELVEINPLALTNDGRILALDSKVILEDNALYRHEDLLKELGRQEVRDSYVELEGDIGIIGNGAGLTMASMDLVKLNGGNPANFLDVGGGANREHVKESVLKVGSNPRVKKIVINIYGGITRCDEVALGIIDALKEVKKPIFVRLLGTNEELGKKILRENGVNVYDDVLKMIGDAVRS

SEQ ID NO: 37845 - protein, 554 aa, Saccharomyces cerevisiae
MSNNSFTNFKLATELPAWSKLQKIYESQGKTLSVKQEFQKDAKRFEKLNKTFTNYDGSKILFDYSKNLVNDEIIAALIELAKEANVTGLRDAMFKGEHINSTEDRAVYHVALRNRANKPMYVDGVNVAPEVDSVLKHMKEFSEQVRSGEWKGYTGKKITDVVNIGIGGSDLGPVMVTEALKHYAGVLDVHFVSNIDGTHIAETLKVVDPETTLFLIASKTFTTAETITNANTAKNWFLSKTGNDPSHIAKHFAALSTNETEVAKFGIDTKNMFGFESWVGGRYSVWSAIGLSVALYIGYDNFEAFLKGAEAVDNHFTQTPLEDNIPLLGGLLSVWYNNFFGAQTHLVAPFDQYLHRFPAYLQQLSMESNGKSVTRGNVFTDYSTGSILFGEPATNAQHSFFQLVHQGTKLIPSDFILAAQSHNPIENKLHQKMLASNFFAQAEALMVGKDEEQVKAEGATGGLVPHKVFSGNRPTTSILAQKITPATLGALIAYYEHVTFTEGAIWNINSFDQWGVELGKVLAKVIGKELDNSSTISTHDASTNGLINQFKEWM

SEQ ID NO: 37846 - protein, 282 aa, Bacillus thuringiensis
MFKKIGIVGAGTMGIGMAVDLVLHGLETVLIDVTEEQLEIAEEKILETVRFAPLINKAFPRMHKEEVLSLISSSTNLDEVAECDYIVENVPENWQIKEPIYRRLDEICKKDTIFGVNTSCISITKVGGVTKRPDKIIGMHFMNPVYMKPSIEVIRGYLTSDETVEKAHSFLNQLDKDAIVVNDQTGFVSNRISHLFMNESAWVVMDGVATPKQVDDIFKKCFGHTMGPLETADLIGLDTVLHSLNVLYEEYQDPKFRCCPLLKKMVDAGECGRKSGKGFYAY

SEQ ID NO: 37847 - protein, 707 aa, Burkholderia thailandensis E264
MIDYTLDDDGIAALSWNLPGRSQNVLNGESCAAFFAAASRALQDAAVKGILVTSAKPDFIAGGDLEWLQASDDAETLFARTCELHRALRALETGGKPVAIAMPGSALGGGLEIALAGHYRVAADNPKARFGLPEVTLGLLPGGGGTQRLPRLVGIQASLPLLLEGKRLKAADALAAGILHAVVPAGEEIAAARAWLLDASRRTATQPWDVKGFRIPGGALTHPSVQQVFMAANALARQKTYGNYPAVASILSCVYEGLLTDLDTGLKTEARYFVKAVLSPQAKAMIRTLFFGMNEANKLAARPAGVPTQRYRKIGVLGAGMMGAGIAYVSAKAGLDVVLIDTSEEAAARGKDYSRKLVDKQVQRGRLTREKADALLAKIVPTTDYARLDGAELVIEAVFEDRAIKADVTRRSETVLAPDALFASNTSTLPITGLAQASARPANFIGLHFFSPVDKMPLVEVIVGRDTSEATLARALDYVKTIGMTPIVVNDSRGFYTSRVFSTYVLEGLAMLAEGVAPALIENAGLLAGMPVGPLALTDEVSSELIHKITKQTRADLGDAYVARPGEDVAARMVELGRLGRKAGLGYYDYPANGGKKALWPGLAQAFPVAAEQPDVAALIERLVTVQAVETARCLEERVLTTARDADVGAILGWGFPAFRGGPVSYIHGVGVDAFVATCDRLAARYGARFAAPGLLREMAAQGRSFY

SEQ ID NO: 37848 - protein, 798 aa, Saccharomyces cerevisiae [sequence omitted]

SEQ ID NO: 37849 - protein, 195 aa, Synechococcus sp. WH 8102
MANLDQAPSRSMPNLLHVLPAFADEAELRLNTIVELNSNTINKYELITETGHLKLDRVGYSSLAYPFAYGCIPRTWDEDGDPLDIEIVNVTEPLVPGSIVEARIIGVMTFDDGGEVDDKVIAVLADDKRMDHIKSFEDLGEHWKKETTYYWEHYKDLKKPGTCSVNGFFGTEKAVEIIKGCEARYMAEIDPKLVD

SEQ ID NO: 37850 - protein, 344 aa, marine gamma proteobacterium HTCC2080
MKALVKKRAEEGLWLEDVPIPAIGGNDVLIKVHKTAICGTDVHIYNWDAWAQKTIPVPMVSGHEFAGEIVELGSNVTGLQVGDIVSGEGHVVCGRCRNCLAGRLHLCPNTMGVGVNRDGAFAEYLAIPATNVFRPNVYIPTDLLSIFDPYGNAVHTALSFNMVGEDVIITGAGPIGIMAAMVAGHCGARNVILTDVNEYRLDLAKRIVPKVQPINVSKQEISRNFMESLGILEGFDVCLEMSGSPVAFQDVLSKMINGGSIAMLGLMPDDTGIAWTDVVFKGLNIKGIYGREMYETWYKMVMMVQSGLPIDRIITHRLHYTEFQEGFDIMRSGQSGKIILNWKD

SEQ ID NO: 37851 - protein, 219 aa, Saccharomyces cerevisiae
KIQDPKQLLFAVYGLLLHEHKNAVVNFSLQRWEQYDKPVPSQEPIVVQYGVRRYTIQPLFSQGSNSPNNVHKYERFLHPDTVSVATCIAPVDFTQSPAIFFKPSPTDAKNIELIGHGTFLNADHSRILAKRAILTGHPFRFHKTVVTVRYMFFRPEDVEWFKSIPLFTKSGRSGFIKESLGTHGYFKATFDGKLSAQDVVAMSLYKRMWPMPSLPWNGM

SEQ ID NO: 37852 - protein, 727 aa, Zea mays
MAAGSIRVTMEVGADGVALITIANPPVNALHPIIIAGLKDKYAEALRRDDVKAIVLTGAGGKFCGGFDINVFTKVHQTGDVSLMPDVSVELVSNMMEEGKKPSVAAIQGLALGGGLELTMGCHARISTPEAQLGLPELTLGIIPGFGGTQRLPRLVGLPKAIEMMLQSKFIAAKEGKERGLIDALCSPDELIKTSRLWALEIANCRKPWMRSLGRTDRLGPLSEARAVLNAARQQAMKIAPNMPQNQACLDVMEEGILCGGQAGVLKEARVFKELVVAPTSKALVHVFFAQRSTTKVPGVTDVQLKPRPIRKVAVIGGGLMGSGIATSLLVSNISVVLKEVNPQFLQRGEKMIAGNLEGLIKKGSLTKDRMHKAMSLFKGALDYSDFKDVDMVIEAVIEKIPLKQSIFADIEKICPKHCILATNTSTIDLNVVGEKTNSQDRIIGAHFFSPAHIMPLLEIVRTEKTSPQAILDLITVGKIIKKVPVVVGNCTGFAVNRTFFPYTQASHLLVSLGIDVFRIDRVISSFGMPMGPFQLQDVAGYGVALAVKDIYADAFGERNLDSDLVGLMVKDGRQGKVNGKGYYIYEKGGKPKPDPSVKHVIEEYRKHANTMPGGKPVTLMDQDILEMIFFPVVNEACRVMDENVVIRASDLDIASVLGMGFPKYRGGLVFWADTVGAPYIHSKLSKWAEMYGPFFKPSSYLEQRAKSGVPLSAPGTSQQGSARSRM

SEQ ID NO: 37853 - protein, 305 aa, Bacteroides thetaiotaomicron VPI-5482
MVFSGTNSRYLAEKICASLNCPLGNMNITHFADGEFAVSYEESIRGAHVFLVQSTFPNSDNLMELLLMIDAAKRASAKSVVAVIPYFGWARQDRKDKPRVSIGAKLVADLLSVAGIDRLITMDLHADQIQGFFNIPVDHLYASAVFLPYIQSLKLEDLVIATPDVGGSKRASTFSKYLGVPLVLCNKSREKANEVASMQIIGDVKDKNVVLIDDIVDTAGTITKAANIMMEAGAKSVRAIASHCVMSDPASFRVQESGLTEMVFTDSIPYAKKCAKVKQLSIADMFAETIKRVMNNESISSQYII

SEQ ID NO: 37854 - protein, 427 aa, Ralstonia eutropha JMP134
MFAAADAAVFASADIAVKPIQKSNKLNNVCYDIRGPVLEKAKQMEEEGHKIIKLNIGNLAVFGFDAPEEIQQDMMRNLPNSAGYSDSKGIFAARKAIMHYTQQKNIQGVGLEDIYVGNGASELIVMAVNALLNSGDEVLVPAPDYPLWTAAVSLSGGTPVHYICDESNEWMPDPADIRARITPHTKAIVIINPNNPTGALYSDELLLEIVAIAREHGLIIFADEIYDKVLYDGNVHTSIASLSTDVLTVTFNGLSKNYRSCGYRAGWMVVSGDKRPALDYIEGLNMLSSMRLCANVPGQWAIQTALGGYQSINDLVAEGGRLRRQRDLAYELITAIPGVSCVKPKAALYLFPKLDLSMYPVQDDQEFIYELLQESKVLLVQGSGFNWDKPDHFRIVFLPHEEDLREAINRIARFLEAYRKRHGKVAA

SEQ ID NO: 37855 - protein, 232 aa, Neisseria perflava
DQGAGATYLEPSASQIGHKESIKDTARVLGRMYDAIEYRGFGQEIIEELAKYAGVPVFNGLTNEFHPTQMLADALTMREHSSKPLNQTAFAYVGDARYNMGNSLLILGAKLGMDVRIGAPESLWPSEGIIAAAHAVAKETGAKITLTENAHEAVNGVGFIHTDVWVSMGEPKEVWQERIDLLKDYRVTPELMAASGNPQVKFMHCLPAFHNRETKVGEWIYETFGLNGVEVT

SEQ ID NO: 37856 - protein, 379 aa, Gossypium hirsutum
MSTAGQVIRCRAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFEQAKKFGVTEFVNPKDYNKPVQEAIVEMTGGGVDRSVECTGSIQAMISAFECVHDGWGVAVLVGVPNKDDAFKTHPVNLLNEKTVKGTFFGNYKPRSDIPAVVEKYMNKELELDKFITHTVPFSEINKAFELMLAGEGLRCVIRMDE

SEQ ID NO: 37857 - protein, 170 aa, Enterococcus faecalis V583
MDLRDYIASIPDYPEKGIVFRDISPLMANGDAYREATKQIVDYAKEKRIDMVVGPEARGFIVGCPVAYELGVGFAPVRKKGKLPRETIEVTYDLEYGSDTLTLHKDAITPGQRVLICDDLLATGGTIKATIELVEQLGGIVVGCAFLIELMDLHGRDKIDGYDIVTLMEY

SEQ ID NO: 37858 - protein, 221 aa, Triticum aestivum
  misc_feature (17)..(17): Xaa can be any naturally occurring amino acid
AAVDVAEPEDEALEAVXAEEVPAVAEEEEVEEVGEYVEPPEEAKVYVGNLPYDVDSERLAQLFEQAGVVEVSEVIYNRETDQSRGFGFVTMSTIEEAEKAVEMFHRYDVNGRLLTVNKAAPRGARVERPPRDSGSSFRIYVGNLPWQVDDSRLVELFSEHGKVVDARVVYDRDTGRSRGFGFVTMASQEELDDAIAALDGQSLEGRALRVNVAEERPPRRF

SEQ ID NO: 37859 - protein, 232 aa, Neisseria pharyngis
DQGAGVTYLEPSASQIGHKESIKDTARVLGRMYDGIEYRGFGQDVVEELAKYAGVPVFNGLTNEFHPTQMLADALTMREHSGKPLSQTAFAYVGDARYNMANSLLVLGAKLGMDVRIGAPKTLWPSEHIVARARAVAKETGGRILLTENAEEAVKGVDFIHTDVWVSMGEPKEAWQERIDLLKDYRVTPELMAASGNPQVKFMHCLPAFHNRETKVGEWIYETFGLNGVEVT

SEQ ID NO: 37860 - protein, 232 aa, Neisseria sicca
DQGAGVTYLEPSASQIGHKESIKDTARVLGRMYDGIEYRGFGQEVVEELAKYAGVPVFNGLTNEFHPTQMLADALTMREHSGKPLNQTAFAYVGDARYNMANSLLVLGAKLGMDVRIGAPKTLWPSENIVARARAVAEETGGKILLTENAEEAVKGVDFIHTDVWVSMGEPKEAWQERIDLLKDYRVTPELMEASGNPQVKFMHCLPAFHNRETKVGEWIYETFGLNGVEVT

SEQ ID NO: 37861 - protein, 232 aa, Neisseria subflava
DQGAGVTYLEPSASQIGHKESIKDTARVLGRMFDGIEYRGFGQDVVEELAKYAGVPVFNGLTNEFHPTQMLADALTMREHSDKPLNQIAFAYVGDARYNMANSLLVLAAKLGMDVRIGAPKSLWPSENIIETVQAVAKETGGRILLTENVKEAVKGVDFIHTDVWVSMGEPKEAWQERIDLLKGYRVTPELMVAAENPQVKFMHCLPAFHNRETKVGEWIYETFGLNGVEVT

SEQ ID NO: 37862 - protein, 306 aa, Nostoc punctiforme
MAALLGRDLLSLADISSTELQELLQLATQLKSQQLKLQCNKVLGLLFSKASTRTRVSFTVAMYQLGGQVIDLNPNVTQVSRGEPLQDTARVLDRYLDILAIRTFAQQDLETFAHYAKIPVINALTDAEHPCQVLADLLTIQESFNTLAGLTLTYVGDGNNMANSLMLGCALVGMNVRIATPDGYEPDSQIVEQARAIANNKTEVLLTHDPELAAKGSTVLYTDVWASMGQETEADNSMPIFQPYQISEQLLSLAAPEAIVLHCLPAHRGEEITEAVIEGSQSRVWEQAENRLHAQKALLASILGAE

SEQ ID NO: 37863 - protein, 172 aa, Wolbachia endosymbiont of Drosophila mojavensis
RFIADTKPVMYVCNVEDTNVITGNELSKKVERMAEENKSKFYCISAKLEADIANLDSEEEKQSFLSEFGLQESGLDGVARIMYEVLSMITFFTVGPKEARAWPVKIGSTADKAAGVIHTDFEKGFIKAETISFADYIKYGSESACKDAGKIRFEGRDYIMQDGDIMHFRFNV

SEQ ID NO: 37864 - protein, 621 aa, Azoarcus sp. EbN1
MPPYPLLHRIDSPFDLRKLDRRELPALAAELRAFLIESVSKTGGHLSSNLGTVELSIALHYIFDTPEDRIVWDVGHQTYGHKILTGRREAMSRLRQFGGISGFPRRSESSYDTFGTAHSSTSISAALGMAVAARNRGEQRRSIAVIGDGAMSAGMAFEALNNAGDMRDINLLVILNDNEMSISPPVGALTKILARMFSGRTYNAARRAGEKVLGVSPPMLDFARKVEEHVKGLITPGTLFEEFGFHYYGPIDGHDLDALIPTLQNLRKLNGPHFLHVITRKGQGYKLAEADPVLYHGVSTFDHTAGIQTAKGAAKLTYTQVFGDWLCDIAAQDEKVIGITPAMREGSGMVRFAQEFPNRYYDVGIAEQHALTFAAGLACEGFKPVVAIYSTFLQRAYDQLIHDIALQNLPVMFAIDRAGLVGADGATHHGAFDLSYLGCIPNLVVMAPADENECRQMLYTAYRHNGPAAVRYPRGGGMQVGPETAMSALPIGKGEIRRSGHRIALLVFGSLLFNALQAAEQLDATVANMRFVKPLDVTLIEELAASHDLLVTLEENIVIGGAGSEVARVLESLSDRPQLLRLGLPDTFIDHGDQSQLLESVGLDAPGIVAAIRRRFSPDNN

SEQ ID NO: 37865 - protein, 298 aa, Azoarcus sp. EbN1
MSHMNFLAWMEAIQRRSETALENLLPDANIAPARLHEAMRYAVLGGGKRIRPLLVHAAGGLVGAAPERLDKVACAVELIHAYSLVHDDLPCMDNDVLRRGKPTVHVEYDDATALLVGDSLQALAFQSLSEHPLTEDPSEQLSMITQLARASGSRGMAGGQAIDLAAVGKQLSREELEYMHIHKTGALIRASVLLGAACGARLDSDRLERLDHYGKLVGLLFQVVDDILDTQSDTATLGKTAGKDADNNKPTYVTLLGMTEARALAESLLADAREALTPFGPQAARLDELATFIVHRRF

SEQ ID NO: 37866 - protein, 1217 aa, Chlamydomonas reinhardtii
MPEAPSLGVDGSGVLTPPLPPPGYDEARVMPSADSSGALPNDVSLTGLVQGRPLPGARAQGPSGLAMGSLGSAVVSSGAEENWASFGSEVHAAPHLTRQMTHATAAVAEVPLPRPPPTATFGPGGAALMHSGGVHLSHAVPPPPPPMAPPPLPKQVTIEVRLAPLKPKEAALPVRLVAGMGNVFAAPGGEGVSALQWMLWPLQPPAGAGGSGPHGPVVDGALPLAYQMPAGGKQARDDGGSARAGDKQAVEDWDSAPAAMLFVPPSCEAAVTCMLLDEQSGSLWTGTCVWEGDEPGADAVGRAVDGFVIRLATRPPIRMFECRRERLARGSTLRNAAPRPHSKVRLMALGPGGRVVWTAGRSGMALWGAYDGEFLGSLSPGTERETGAPGGTAGTASAGATGAVYPSGGGLARPGTMSNYAAAYAGETGAGGVLGREGRDAQQQMDINSRTGLEPVLIERKFERAPPPEDNDDGDGGTEADLGTQVFKGLAGAAKFAAKWGKKIAKNVGELQAAASGGGKDSAADDWAEGGKGAGYGAAGGGGGSSAGLAGRGKVVAMVPGLDGSMFVAFKNGVVDKYTEWGKLLWSRDFGREPQLCCAALAGTQLWLGGTDGCIRAVTAAAGELSRAWKAFDFPVVALAHDANPFRGLGLVYGLSEHGSVRAWPAALPDEATLVQWRDGLEPCLTRHQLRVLAGTWNVNETRPAPSSLTTWLRSGAATADIVAIALQEVEVGTSSVAMDAARNLLYKTMLERGNQNAQWWASELAVALTTASGGASWDRVGLRQMSGMLALVFCRAQLRPHVGEVATASVPCGVMGVGGNKGAVAVSMSVYRRRIMFVCSHFAAHQERVDERNDNYNKIVRQLHFENTSKAAARMASHQQQQQQQQQQPGAEPVLIRDDSDLDAAAAAVVQSSAEGGGADAGAAVAQAIAEAAADDGHGPGMADAAMLVWAGDFNYRINGPYLAVVEAARAGRFAELYTMDQCREQMEKGNVFRGLREPLPLGHPLFVPTYKFDKGEPVRPGRDGRLELPYDTSDKQRVPAWTDRIFYRGSRPGSLDMAGEEVQVGVAQPLDYNCCLELNDSDHKPVYAILQVLLPGYKQEAKRLHSLAIAAVLHRAAVTSAIKSAAAVDASAVVGGPRPPPLPPPVHASTHSLQVRAGIETPSFVDVRNSSTAALLVHVSVQRPGPGAGTPGPLPTWLETLAGVPGPVVSVSVIG

SEQ ID NO: 37867 - protein, 146 aa, Zea mays
PLGQAKKEAEAPKMPLKGKIDQAPPFVFRGGSFPPKFFLDPSAPGDFKAPKRKKIHAFKSKSRLGQLEFPQTKRQNPGPHFQPKGKPKKGGFFSVPKKESFFNSPAAPRGKGGVPGSAKALPAFQRGEKLFPLKGGSGDPADDAGE

SEQ ID NO: 37868 - protein, 187 aa, Novosphingobium aromaticivorans DSM 12444
MHPDVSIIPLNGKTPRIHESAFIAPGCRIIGDVEIGPDVSIWYNCVLRGDVNFIRIGARTNIQDGSVIHVDSPAPGKPEGFPTIIGEDVLVGHLAMVHGCVIEDRGFVGLGAIVMSGAHIESDGMLAAGAMLTGGKRIGARQLWGGRPATYMRDLTEPALVEMQRGVQHYVRNGQAHKAAVLGASEG

SEQ ID NO: 37869 - protein, 286 aa, Zea mays
  misc_feature (272)..(273): Xaa can be any naturally occurring amino acid
MAWARLASRSRLRPAASAAGRSRHASTPAPPPPPSPPTTRTVPAATSAPPLRRLLLLPRHRFADATPSASTAWLLGARWRQGHGRRCFASAAYPAQATPGEASELVDVPLAQTGEGIAECELLRWFVAEGDQVDEFQPLCEVQSDKATIEITSRFKGKVHKIHFVPGDIVKVGETLLKMVVGDSQIVSPDNIVPSAGKSLGVESAVFSSEGNVPGGNLSTPAVRHLAKQYGISINEIVGTGKDGRVLKEDVLNYAVSKGVCKQQSLASEGNXXQVELLGGRGSITR

SEQ ID NO: 37870 - protein, 127 aa, Picea sitchensis
MAEAVNPKAYPLADSQLSITIMDLVQQAANYKQLKKGANEATKTLNRGIAEFVVMAADAEPLEILLHLPLLAEDKNVPYVFIPSKQALGRACGVTRPVIACSVTTNEGSQLKSQIQQLKDAIEKLLI

SEQ ID NO: 37871 - protein, 363 aa, Nostoc sp. PCC 7120
MLRAGIVGLPNVGKSTLFNAVVANAKAEAANFPFCTIEPNVGVVAVPDERLNVLSQISGSAQIIPARVEFVDIAGLVKGASQGEGLGNQFLSHIREVDAIVHVVRCFENDDIIHVAGSVDPARDIEIISIELGLSDLAQIERRIERTRKQARTSKDAQFEVTVLEKLAAALNEGKSVRQISLTEEEAEIIKGLGLLTNKPIIYAANVSEEELATGNEFVERVRQVAAQENAQVVVVSAQVEAELVELPEEDKADFLESLGVKEGGLKSLIRATYELLGLRTYFTSGPKETRAWTINAGMSAPQAAGVIHSDFERGFIRAETVAYNDLVANGSLSAAKEKGLVRSEGKEYIVQEGDVMLFRFNV

SEQ ID NO: 37872 - protein, 463 aa, Rhodococcus sp. RHA1
MPPGGPMPKVLAAPPPQSTLQPISGNAGFPVIGHSLDYFRDPMGLLQSRWDRYGPVSWLSMAGKRWVTVLGPDGCQTVLQNKDRAFVNSDGWSVLIGPFFHRGLMLLDGDEHLAHRRIMQQAFTRDRLSRYTEALHPAVEKGLDGWQPTAGFAAYPALKELTLDLATSIFMGGAEGSTPREMAEINRAFIDCVQAATSVIRYPLLGTRWKRGIDGRARLEEFFRRYLPARRAGAGEDLFSALCHIESEEGQRFSDDDVVNHMIFLLMAAHDTSTITLSTMMQYLGQHPDWQERCRRQSAALGTSTPTYDQLDELTDLDLVMKECLRLVPPVPVVARRAVEDTEVLGHYIPRGTYMSVVVHFTHHMPEYWPDPERFDPERFAPERREDKVHRFAWEPFGGGVHKCLGMHFAGAEIKTVMHHLLRRFHWHVSPGYVAPLNYTSLPFPSDGQPVDLYHRVGGADTP

SEQ ID NO: 37873 - protein, 275 aa, Xylella fastidiosa 9a5c
MQKPAVNIMVKAARSAGNVLLRHINKLETLHVIQKSRMDYASDVDEMAEKVIVKELKRAYPEYGILGEEGGLQGNHRIMWVIDPLDGTSNYLRGFPHYCISIALVENGEPTDAVIFDPLRNELFTASRGAGAILNERKIRVANRKDLNGTMLNTGFSPRERSRAHAQLKCVDALLMQAEDIRRSGSAALDLAYVACGRADAYFEAGIKVWDVAAGMLLVREAGGYVCDFKGADAPRMDDKGPESCQLVAGNIKVAHALQQVIVSSGYGREFDPKR

SEQ ID NO: 37874 - protein, 913 aa, Ostreococcus tauri
  misc_feature (154)..(160): Xaa can be any naturally occurring amino acid
MDGNTAFGASSPAKPALTIPEPLSHTSAETSPSSAMISLTFSATRARDATLVSLHRPRPPTAIVHADHPRARVSPLDRAAARAARDLPRARPPARPHPPPSPPIVHARVFTPFPSRPPIRDAAPTTRETTMRSRARAIVIHPHPSSRSRRGVVXXXXXXXRARGRGAPWRTSASGRMGRDDRSRTRARCDRIRCSWIIPWMGRTRSLARTVSALTNYGLDVVSSFTRTTDDGRTVDDVFYVTMTTRSLDASFDDAAADAGQVPESSFQDLERFIVQALTVTGMGERYTSRMPKIYGVAAETEILAMQHRLGEIIGDGSQAIGESESMALQLELVAAELASATARLVQIDRVYSKVESCGIDALWELDGSDEVTLSEECIRLEAERADASAMFGRKLAAMEAALASRERARAKIVRKNQNDESSMKRAQGDAVSTLAKSRLPLDERNTVAAPKLKKITEMAPQTPFASPLSRPLPSTPCGNGRELILQGFNWESCQHAEKMGASWYAHLTEMTPQIAEAGFTSVWLPPPTKSVSKQGYLPTDLYNLNSFYGSEDELRSCVARLREYNITPVADIVINHRCAEAKDDAGRWNKYTGKLDWDERAITCENPAFGGRGAHKTGEDYLPAPNIDHTQEFVRRDLTQWLEWLRSDVGFRGWRFDFVKGYSGAFTGEYVEATRPFLAFGEFWDECGYRDGVLDYNQDAHRQRTCNWVDSTTGNTAAFDFTTKGILQEAVSRTEYWRLIDNKGRPPGFLGIWPSRAVTFIENHDTGSTLQHWPFPWDKVLQGYCYILTHPGTPTVFFDHWVDPVFKPSIDAMLEVRKRNRLSSKDAAIHIERATAGVYAAHVGHAKEAYTEGLCTDVDVTQPSICMKIGHEAWSPNAQKVGNLSWQCTASGDGWAVWEDKAHLVDAEKMTR

SEQ ID NO: 37875 - protein, 306 aa, Magnetospirillum magnetotacticum MS-1
MVAITAAMPGGTGIDLFGKAHPDRTFDVGIAEQHAVTFAGGLATEGYKPFVAIYSTFLQRAYDQVVHDVALQNLPVRFCLDRAGLVGADGATHAGAFDLAYLCCLPNMTVMAAADEAELVHMVATAHAHDSGPIALRYPRGEGVGIELPEKGEVLALGRGRVVRRPEGARVALLSLGTRLSEALKAADALEAEGVATSVADARFAKPLDAELIVDLAMSHEVLVTVEEGSVGGFGAMVLHLLSERGVLDAGRVRVRTLTLPDLYQDHDKPEKMYAEAGLDAEGILKAVRAALPEKKGSRTGRLRLA

SEQ ID NO: 37876 - protein, 151 aa, Zea mays
MATVLSSLRAPASTFPSSLRVAAAPAAPATVALLPAAGNKVPGMAARGARLRAQATYNVKLVTPEGEVELQCPDDVYILDQAQEEGIDLPYSCRAGSCSSCAGKVVAGSVDQSDQSFLDDDQIAAGWVLTCHAYPTSDVVIATHLEDELTG

SEQ ID NO: 37877 - protein, 378 aa, Gibberella zeae PH-1
MGSYSPTSRFKDLDTIPLDPHYALKETFQADPDPRKVILGSGLYRDDDSKPWVLPVVKKVLFGPQSLNESRLVSIQTISGTGANFLGARFLAETLKPSAVWLSDPSWVNHANIWGLVNVNVKRYPYWNAKTKSLDFNNMIEKLQTDAIAGDVILLHACAHNPTGVDPNKEQWRKIADVCERKQLFPLFDCAYQGFATGNLDDDAWAIRHFIDRGTMELAVCQSFSKNMGLYGERVGALHMFCATSTDAEKVRGHLCRLQRGQISQPPTNGARIAATILSDSKLFQDWVTDLGEMSSRIKEMRKSLYDNLMILDTPGKWDHIVSQIGMFSYTGLTPEQVASIQQDSHVYILKSGRISVAGLNSKNVDKSVVEFAIVGMK

SEQ ID NO: 37878 - protein, 501 aa, Hordeum vulgare subsp. vulgare
MMAMATAMAATYGAPIPAPAPSASSPRRAAPDGGRRLRAVAGRPRPLFSPRAVSDSRNSQTCLDPDASTSVLGIILGGGAGTRLYPLTKKRAKPAVPLGANYRLIDIPVSNCLNSNVSKIYVLTQFNSASLNRHLSRAYGNNIGGYKNDGFVEVLAAQQSPENPNWFQGTADAVRQYLWLFEEHNVMEFLILAGDHLYRMDYQKFIQAHRETDADITVAALPMDEERATAFGLMKIDDEGRIVEFSEKPKGEKLKAMMVVTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSRVLDADVTDSVIGEGCVINHCKINHSVVGLRSCISEGAVIEDSLLMGADYYETENDKKVLSETGGIPIGIGKNTHIKKAIIDKNARIGENVKIINVDDIQEASRESDGYFIKSGIVTVIKDALIPSGTVI

SEQ ID NO: 37879 - protein, 573 aa, Oryza sativa Indica Group
MNARRLHKWAATARLVLLLLAAAAAAAAAAGRREVVTSPHGAVAADDGRCSRIGRDALRDGGNAVDAAVAASLCLGVVSPASSGVGGGAFMLVRFADGTALAYDSRETAPLAASQDMYGGNETLKARGALSIAVPGEIAGLYEAWKRHGKLPWKRLVMPAAKLARAFRVSPYLRKQMEATRDGILQNKGISGVYTSNGDILNVGDVCRNIRLARTLVAVAEKGPDVFYKGAVGDQLVKDIQEVGGIITMEDLKKYQVKIRRPLLEKVLGLTVLSMPPPSAGGAGLMLVLNILTQYGLPAGFSGSLGIHRLIESLKHYFAIRMNLGDPEFVNVNEVVSDMMSPKFAADLKKTIYDNMTFDPKHYGGRWNILQDHGTSHLSIVDSERNAVSMTTTVNAYFGSLILSPSTGILLNNEMDDFSMPANTSANSPPPAPANFVRPLKRPLSSMTPTIILKDGNLKAAVGASGGSMIPAGTMEVLLNHFVKNMDPLSSVMAPRVYHQLIPNVVQYENWTTVTGDHFELDAATRADLRRKGHVLEPLAGGTISQLVVDDVERHGGLTAVSDPRKGGFPAGY

SEQ ID NO: 37880 - protein, 378 aa, Ralstonia eutropha JMP134
MPVILYSIGTSASRISEPSARLRVCRHAAGRIGEPLLPRALPMSRSMSQLPRVVILATGGTIAGASANPASSARYQAATVPVTTLLAAVPALQSVARVEAEQVAQVDSKDMVFSLWSTLAARVQHWSGQPDVAGIVITHGTDTLEETAMFLHLTQACPVPVVLTAAMRPSTSLSADGPLNLLDAVRVAAHPDACGKGVLVVLNQQIHAARDVVKAHTSAVDAFVSVPCGPLGFVQDELVRIARAPVRSGVGVLPVPQHWPDVEIIASYAQPGRMVVDALVGAGVRGIVVAAAGNGSVHETLVAALRDAVAAGVAVVRSSRTAAGHVAIPPVVDPLGGAFLSAADLNPYKARVLLLLALAQDPGLASDPERLQGQFASS

SEQ ID NO: 37881 - protein, 532 aa, Petunia x hybrida
MDFYTLAFGSIFACGLLYILAKIISKGNKKLPPGPTPWPIIGNLHLLGAKPHISLAQLAQIYGPIMSLKLGQVTTVVISSSAMAKQVLKYQDLAFSTRFVPDALQTHNHNKFSVVWLPVSPQWRTLRRILNTNILSSNRLDSNQHLRSQKLKELLAYCATCSQEAKVVDVGQAVFKTNLNLLSNTLFSKDLADPFSDSKVELKDVIWGVIAEIGKPNLVDYFPILEKIDPQGIRRRTTIHFGKLMRLFDSLINERVEEKRRSHSEKSDVLEVLLNINKENPEEINQNHIKAMFLDLFGAATDTTTSTLEWAMAEILRQPEIMKKAQAELAEVIGKGKPIEEADVSRLPYLQCIIKETFRMHPATPFLLPRKVEQDVEVCGYIVPKGSQVLVNVWAIGRDSTYWEDPLMFKPERFWNLDLDVQGQDFELIPFGAGRRICPGLPLALRMVPVVLGSLLNSFNWKLETGIEPEELDMEEKFGLALAKASSVASYPISYLMFLYDALSKSTSYLQVILISLASFVIWFRSKSYCDK

SEQ ID NO: 37882 - protein, 528 aa, Thermobifida fusca YX
MTGQVLDGRYRLVERLGSGGMGEVWRGHDERLGRTVAIKLIHPGASVDDEAVALFRREAQVTARLAGHPNIVILYDYGTDGDTVYTVMELVTGCSLSALLRERGRLPVELAVRWGAHVCAGLAAAHAVGVVHRDIKPSNLMVVDADAPDGGTVKLVDFGIAGFHEAALHQRTLPPTGEPFGTPLYVSPEQIQMLPVGAFSDLYSFGAVLFHMLTGQPPFHAAEPMPVLRMHLTEPPPNPAELRPDVPAELAELVLMLLAKDPGQRPDNALWVRDRLLSLSGTSPPASAASPTESASREAQMRRLEQSWVEAERLAAAGQAAAAAQRIGALLGELAAIYGADHPATLEARRRHASLTSRAGDPERAAALFDTLVADLDRIYGHAHPETYAARHHLAAATEQAGRRAEAAVLRSELVDALTAQYGPQAARLLHPRLFYAVDLAEAGDFTGAEKLLRDLAAALEQQLGAHTPALQIVHHYLDAAAAFASETAGAEPPHPNRFRESTRLDGRPPPHPLRQRLTRWLRSTTEL

SEQ ID NO: 37883 - protein, 392 aa, Enterococcus faecalis V583
MDLTNRFNRQVNKIAVSLIRQFDEQVSGIEGILKLTLGEPDFNTPEHVKKAAKEAIDANFSHYTGMSGLLDVREAAAYFMKEKYHLTYQPATEILVTVGATEAISASLLAILEQGDKVLLPAPIYPGYEPIITLAGAEPVYLDTRDNDFVLTPEMIEAAMAEHGEQVKAIILNYPSNPTGVTYNRQELQAIADVLKKYDIFVISDEIYSELTYDESHVSIAEMLRDQTILINGLSKSHAMTGWRIGFIFAPAILTAEIIKVHQYLVTAAATVSQKAAVRALIEGMHDAEIMKEEYRKRRDFVYEQMTQLGFEVARPNGAFYIFAKIPTGYEQDSMKFCIDLAQKEAVALIPGISFGPEAEGYVRISYASDMDKLTTAMERIAHYMATQRVTH

SEQ ID NO: 37884 - protein, 228 aa, Malus x domestica
MAPPIETVQKVQPPPNAIEPHVTYHHDHSSHPPLNERILSSMTRRSIAAHPWHDLEIGPGAPKIFNCVIEIPKGSKVKYELDKKTGLIKGDRILDSSVVYPHNYGFIPRTLCEDNDPLGCLDIMQEPVVPGCFLRAKAIGLMPMIDQGEKDDQIIAVCADDPEYRHYNDIKELPPHRLAEIRRFFEDYKKNENKEVAVDDFLPASTAFDAIQHSMNLYADYIVESLRR

SEQ ID NO: 37885 - protein, 149 aa, Pisum sativum
MAEQTFIMIKPDGVQRGLVGEIISRFEKKGFYLKGLKFVNVERAFAEKHYADLSAKPFFSGLVDYIISGPVVAMIWEGKNVVTTGRKIIGATNPAQSEPGTIRGDFAIDIGRNVIHGSDAVESANKEIALWFPEGAANWESSLHSWIYE

SEQ ID NO: 37886 - protein, 348 aa, Sulfolobus solfataricus P2
MKAAVYKGYGLPLEIEEVPNPAPKEGEVLVKVASTGICHSDLHLLSGELVGPLPNGFIIGHEIAGWVEKIGENVKNPYGLKEGDPVLVSWIVPCGICRYCANGKENYCKDNAKRLVGLIGINGGHAEYLTVPEIAVIPLAKNLDPYYSSPIACAYGTAYNALKSANATSGKSVVIVGAGGVGSAAIQLANSIGLNPIVAVDIDENKLKSAKLLGATHIINANENDARAKVLEALEDGADIVYETKPYPDFKLSLEVVKSGGTIVVTGLGGFSTLAQIPVTLFVSRGITLIGSLGYRPRIDLPDLVSLASSGKIDIKKLVSHIYTPDMINEAYENLKKGLHIRAIIRWN

SEQ ID NO: 37887 - protein, 230 aa, Pisum sativum
MEAMAVFSGSNLFATSSLLLTTNSKTRYSQLRTTQNLSAFSSKSHLFSPSSTSSSYPKTFRTRSSTESGIFLPRLITSLEQVDQAYIMVKPDGVQRGLVGEIISRFEKKGFKLTGLKLFQCSKELAEEHYKHLNQKSFFPKLIEYITSGPVVSMAWEGVGVVPSARKLIGATDPLQAEPGTIRGDFAVQTGRNIIHGSDSPENGEREIALWFKEGELCEWTPVQEPWLRE

SEQ ID NO: 37888 - protein, 338 aa, Physcomitrella patens subsp. patens
MWCALFGGVLFLLNALSARAFGESEFWFSSIKVSAIILFIILGGAAMFGLIDLKNGQPAPMFSNFATSSLLPHGITGLLMTMITVNFSFQGTELIGIAAGESKEPEKTIPKSIRNTVWRTLVFFVLAIFILAGMIPYEQAGVVESPFVVVFDSIGIPFAADIMNFVVLTALLSVANSGLYAATRMLFALSKEGMASEKLAAVNKKGIPMNALLITFVIALLSLLSGFFAEDTVFMVLLSIAGLGAQVGWISISASQLAFRRHYLKNGGKLGDLKFRTPLYPIVPLLSLILNLTVLVSLAFDPEQRIALYCGVPFMIIAIIVYQLHFKKKLEPLQKNAA

SEQ ID NO: 37889 - protein, 148 aa, Flaveria bidentis
MEQTFIMIKPDGVQSGLVGEIIGRFEKKGFSLKGLKLLTVDRAFAEKHYADLSSKPFFNGLVEYIVSGPVVAMVWEGKNVVTTGREIIGATNPAESAPGTIRGDFAIDIGRNVIHGSDAVESARKVIGLWFPEGVANWSSSLHPWIYE

SEQ ID NO: 37890 - protein, 468 aa, Vibrio cholerae O1 biovar eltor str. N16961
MDKKLGLGSLTALVIGSMIGAGVFSLPQNMAAVASPLAVMIGWSITGIGMIFLALSFQYLAVNKPHVNSGVFGFAREGFGDFAGFCSAWGYWFSAMVANVSYLVIVFSTLGLLFDTPDQIIFGSGNTWWSIGGASLLLWAVHSLVLRGVQTAALINLITTMTKMVPLLLFIVSAIAAFNWSTFSLDFAGLHHISGADLLGQVKATMLITVWVFVGIEGAVVVSSRARQRKDIGRATILGLLTALSIYVLVTLLSMGVIQVNQLAQYPNPSMAQVLTTIIGPWGKYIIAVGLLISVCGAFLSWTVLASEAPFLAAKDKMFPRHFAKQNQAGSPVNALFLTTLCIQVSLILVRYTSSTYDSLLIFASEMILVPYFLVGAFTLKLALEQRDRGKLLLIGFGATAYGLWLLYASGLHYLMLSTLLYVPGFAFYLKAKREQGVKAFCGREMVGASTLLLFAVGAAGMLWQGAW

SEQ ID NO: 37891 - protein, 148 aa, Flaveria bidentis
MEHTFIMIKPDGVQRGLVGEIIGRFEKKGFSLKGLKLLTVDQAFAEKHYADLSAKPFFNGLVEYIISGPVVAMVWEGKNVVTTGRKIIGATNPAESAPGTIRGDFAIDIGRNVIHGSDAVESAKKEIALWFPEGVANWSSSLHPWIYE

SEQ ID NO: 37892 - protein, 379 aa, Prochlorococcus marinus str. MIT 9301
MINPYKKNAKLVLSNGIVFPGFYFGASGTAFGEIVFNTGMTGYQEVITDPSYYGQILTFTYPEIGNTGINFEDSESNTNVKGIIVRNFSSNNSNWRSKKDFNQWLVEKNIVGLHGIDTRALVKILRSNGSMNGVITSEDKTLESCLKIIHDTPNMEGLNLSKVVSTKQKYLWTTHTQTNFDLRIRNAESSKKLKIVAIDFGIKNSILNRLVSHGCEVLVLPSRSSLKDVLSNKPDGIFFSNGPGDPSSVSEGIDLAKSLIEYGDIPMFGICLGHQIFGLALGGSTYKLPFGHRGLNHPCGENNKIEITSQNHGFAIDPNSLSKEIVRITHYNLNDKTVAGIEVNNKPIFSVQYHPEAGPGPHDSDYLFKKFVSLMLERC

SEQ ID NO: 37893 - protein, 144 aa, Solanum lycopersicum
FIMIKPDGVQRGLVGEIISRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSCIYE

SEQ ID NO: 37894 - protein, 511 aa, Glycine max
MAQPSTGIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGLGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQHVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQSKKLDYCISANQDFPNKCNIFCSDCMLS

SEQ ID NO: 37895 - protein, 124 aa, Photobacterium profundum SS9
MYSRNILLFAALSGVVMVALGAFAAHGLKSQLPPYLLDVFNTGVQYQAWHTLALFGCGLWARIMPTKAVLYAALFFAGGILLFSGSLYALALTGIKWFGPITPLGGICFIIGWAALAMAAWRSA

SEQ ID NO: 37896 - protein, 468 aa, Ostreococcus tauri
MLRAGMSIARFNFSHGSHEYHQETLDNLRRACANTGIHCGVLLDTKGPEIRTGMLACGGPVMLEAGNEITLTTDYDFKGSAEKIAVSYPDLAKDVKPGSKILCADGSVTFTVLECDVAKGEVRCKLENSAKLGERKNMNLPGVVVNLPTITEKDRHDLIEWGVKNQVDFIAASFVRKGSDVEYIRSVLGDFASKVSIISKVENMEGLDNFEDIVEASDGVMVARGDLGMEIRMEQIFLAQKRMIKRCNIAGKPVVTATQMLESMTGAPRPTRAEATDVANAILDGTDAVMLSGETAAGSYPLDAVKCMASICREAEAYVDNLATYFTILEQQPMPMSTVESLASSAVRTAQKVDAAAIITLSKSGDTARLIAKYRPAAPIVAVAYASVENPGQIARKFLMSRGIVPVIQPQEWAEGSDIVPQAVMRNTILYARDSLKIVKPGDKIVGVHRLLGEAILKVVEVPDGDSF

SEQ ID NO: 37897 - protein, 406 aa, Photobacterium profundum SS9
MTAQFDINQVYQQFPALQQNCNGQPLVYLDSAATAQKPLVVIETIQQYYSGHNANVHRGSHSLTASATAKFEQARQTVQQFIHAQHSCEIIWTRGATEALNLIAQTYARQTLQPGDEILVSELEHHANIVPWQIVAEQTGANVVKIPMLPDCTLDMDAFHQLLTNKTKIVAIAHITNVTGTRNPIEAITTAAHHYNAVVVVDGAQGIVHEAVDVQKLDADFYVFSGHKLYAPAGIGVLYGKKALLEAMPPWHGGGKMVEKVSFSGTTFSALPGKFEAGTPNVAGSLALATAIEWLESLDRHGAEKHIAQLRQKAIEGISEIDDLRIIGLQEHASIFSFVVDGVHHQDIATLLDQQGIALRAGHHCAHPMLDALGLTGTLRVSLALYNTEQDVERFIAALHKACSLL

SEQ ID NO: 37898 - protein, 526 aa, Oryza sativa
  misc_feature (139)..(139): Xaa can be any naturally occurring amino acid
MAVDAMFGSVAVALLAVVVAAAALRRWRRRRRRGGGRPLPGPVALPVVGHLHLFRRPLHRTLARLAARHGAAVMGLRFGSRRVAVVSSAPAAEECLGPHDLAFANRPRLPSGEILAYEWSTMGTASYGPYWRHIRRIAXVTELLSAHRVQHFADVNVPQGCAALARRLYRRAAAAAAAGARTRVELKSRLFELLMNTMMSMICERTFYGADDDEVSEEARWFRSVVKETMELSGASTVWDFLPAPARWLDAGRMTRRMRELSDSRTRFLQRLIDDQRKDMDADSDDHAPAKRRTMIGVLLSLQRKDPDSCPDQLIRSLCIGSLQAGTDTSAATVEWAMSLLLNNPGAMARARGEIDACVGQPAARLLEAADLPKLHYLRCVVMETLRLYPPVPLLAPHESSADCVVAGFHVPQGTMLLVNTFAIHRDPQVWDEPEAFIPDRFADGKNEGKMVIPFGMGRRRCPGENLGMQMVGLALGTLIQCFDWERVGEELVDMRECSGLTMPKELPLEALYQPRASMVDLLTKI

SEQ ID NO: 37899 - protein, 270 aa, Photobacterium profundum SS9
MRELETPASENYNQRFGGTRRLYGNSEVEILRAAHVCVIGIGGVGSWAAEALARSGVGELTLIDMDDICVTNINRQIHAMTGTIGQSKIEVMAARIKLINPECKVNLIDDFITPENIAEYIDARYDYILDAIDSMKPKAALLAYCKSNKLKVITTGGAGGQTDPTQIQITDLTKTIQDPLAKKLRDTLRRFHNFSKNPKRKFGIDCVFSTEQLKYPQADGSVCNVKASAEGPKKMDCASGFGAATMVTATFGFVAVSRIIQKIVEKHLQK

SEQ ID NO: 37900 - protein, 399 aa, Debaryomyces hansenii CBS767
MKLHYLLLLAVPIAASEGDRLPGFQDCLLQCEKLMDCNHAAILEHIEAQQQQAEEDIEPVAQPMKPPHKRDVNSINEREELPQYLLKDFKGNYRLSWITRTVFQWDCMLDCDYKCQQFVTNQRELSGLPMVQFYGKWPFTRILGMTEVMLTLFSIGNYYTNFNSLTKILTQYNKNYKSGNDAFIMYKQYIYLIVGSLAGWAFSTLFHMRDTSLTETLDYFGAAMIMLLNFNAISVRFFRLFTSTKRKQRLVLQLSLAVIFVFHCIKLHNKWDYQYNTYFNLFFGVMAMVLWIAHAMRVRSIYSKDFRMYNNSMQLLPFETKLLSKLNYLSLSETKFIPILPVLLNLWLLIGMSFELLDFSPWLRLLDAHAIWHLFTIIPPIFWYDWNIWDIELMKLTGV

SEQ ID NO: 37901 - protein, 459 aa, Burkholderia thailandensis E264
MTQEQRTFDSIVEREKGLRRGLSSGQMAMIAIGGAIGTGLFLGSGFAIGLAGPGVLVSYAIGALIALLLMGALAEMTVAHPTSGSFGAYAEHYVGPLAGFLVRYAYWSAVVFAVGTEVSAIAVFMKYWYPGVPGWYWVVGFSAALIAVNMTSVTLYGVVEYVFSMLKIAAIVVFIALGAYFVATAPASSGIGFANYSAHGGFLPKGFSGVWVAVIVAIFSYMSIETVAIAAGEARDPQRAVSRAFRSTVFRLVLFYLLTLALMLAIVPWTQAGTDESPFVKVMAATHVPYAAGVINFVVLVAALSAMNSQLYVTTRMMFSLSRARLAPAMFGRVGANGVPLAALVVSSSGVAVAAVLVALYPEAAFTLLMAIAMFGALFTWLMIFVTHLCFRARYRGPTPAFRMWLHPAGSLTGAALVGAVLVTTAFTREFRMTMMVGVAFVVLLTLAYRLHYRARHAR

SEQ ID NO: 37902 - protein, 564 aa, Plasmid R100
MSTLKITGMTCDSCAVHVKDALEKVPGVQSADVSYAKGSAKLAIEVGTSPDALTAAVAGLGYRATLADAPSVSTPGGLLDKMRDLLGRNDKTGSSGALHIAVIGSGGAAMAAALKAVEQGARVTLIERGTIGGTCVNVGCVPSKIMIRAAHIAHLRRESPFDGGIAATTPTIQRTALLAQQQARVDELRHAKYEGILEGNPAITVLHGSARFKDNRNLIVQLNDGGERVVAFDRCLIATGASPAVPPIPGLKDTPYWTSTEALVSETIPKRLAVIGSSVVALELAQAFARLGAKVTILARSTLFFREDPAIGEAVTAAFRMEGIEVREHTQASQVAYINGEGDGEFVLTTAHGELRADKLLVATGRAPNTRKLALDATGVTLTPQGAIVIDPGMRTSVEHIYAAGDCTDQPQFVYVAAAAGTRAAINMTGGDAALNLTAMPAVVFTDPQVATVGYSEAEAHHDGIKTDSRTLTLDNVPRALANFDTRGFIKLVVEEGSGRLIGVQAVAPEAGELIQTAALAIRNRMTVQELADQLFPYLTMVEGLKLAAQTFNKDVKQLSCCAG

SEQ ID NO: 37903 - protein, 517 aa, Coriolopsis gallica
MARFQSLLTFITLSLVASVYAAIGPVADLTISNGAVSPYGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAARVGPAIPTADATLINGLGRSINTLNADLAVITVTKGKRYRFRLVSLSCDPNHTFSIDGHSLTVIEADSVNLKPHTVDSIQIFAAQRYSFVLNADQDVDNYWIRALPNSGNTNFDGGVNSAILRYDGAAPVEPTTSQAPSTNPLVESALTTLEGTAAPGSPTPGGVDLALNMAFGFAGGRFSINGASFTPPTVPVLLQILSGAQSAQDLLPTGSVYSLPANADIEISLPATTAAPGFPHPFHLHGHAFAVVRSAGSSTYNYENPVYRDVVSTGSPGDNVTIRFRTDNPGPWFLHCHIDFHLEAGFAVVMAEDIPDVAATNPVPQAWSDLCPTYDALSPDDQ

SEQ ID NO: 37904 - protein, 502 aa, Oryza sativa Japonica Group
MAAANGGDSKGFEVPKLEIKFTKLFINGRFVDAVSGKTFETRDPRTGEVIAKIAEGDKADIDLAVKAAREAFDHGPWPRMSGFARGRILHKFADLVEQHVEELAALDTVDAGKLFAMGKLVDIPGGANLLRYYAGAADKVHGETLKMARPCHGYTLKEPVGVVGHIVPWNYPTTMFFFKASPALAAGCTMVVKPAEQTPLSALFYAHLAKLAGVPDGVLNVVPGFGPTAGAAISSHMDIDKVSFTGSTEVGRLVMEAAAKSNLKPVSLELGGKSPVIVFDDADLDTAVNLVHMASYTNKGEICVAGSRIYVQEGIYDAFVKKATEMAKKSVVGDPFNPRVHQGPQIDKEQYEKILKYIDIGKREGATLVTGGKPCGENGYYIEPTIFTDVKEEMSIAQEEIFGPVMALMKFKTVEEAIQKANSTRYGLAAGIVTKNIDVANTVSRSIRAGAIWINCYLGFDPDVPFGGYKMSGFGKDMGMDALEKYLHTKAVVTPLYNTPWL

SEQ ID NO: 37905 - protein, 290 aa, Triticum aestivum
  misc_feature (176)..(176): Xaa can be any naturally occurring amino acid
  misc_feature (180)..(180): Xaa can be any naturally occurring amino acid
LGDSPEQVCTKKQAATGPEFPGYRRPTRPASRYVRASLPRFRMPENSIPKEAAYQIINDELMLDGNPRLNLASVVTTWMEPECNKLMMVSINKNYVDMDEYPVTTELQNRCVNMIAHLFNAPLGETETAVGVGTVGSSEAIMLAGLAFKRRWQNKMKAAGKPCEKPNIVTGANVQXCWEXLARYFEVELKEVKLSEGYYVMDPEKAVEMADENTFCVGAILGSTLQGGVPRTARWSNDSLPKKNQETGWEHAPSHEVCCEPGGVPPGPFPGPRELGRGNFPGCPLGGKKH

SEQ ID NO: 37906 - protein, 213 aa, Oryza sativa
  misc_feature (13)..(13): Xaa can be any naturally occurring amino acid
EIILVHKFIRDQXSVRFPELETLIQNPLDYAKAVAIIGNGPMENIREISESKDNMLGQTLRGVLDGPSVMVVTVEATNTRGEPLSENELATVKRACEMVLKLDKAKKLLTDYVRSRMNLFAPNLTTLIGSLTAAQLLNYAGGVTGLAKTPACNLAPLGSKKNTTAIGLASNTGVRHQGFLYSNEIIRAVPSDLKKQAMRILSAKVVLAARIDQ

SEQ ID NO: 37907 - protein, 232 aa, Enterococcus faecalis V583
MKKIKNMDVEWSYTGNDGPEHWHTLCDWFAEGAKFAYQSPIALEKESAETVNSQITFHYKKEEFTEKEFKNTFHFVPPNTESYVMFENVAYHLTDIHFHMPSEHLLSGKQYPLEFHLVHMNDAGENLVVGCLFTITEEENRFSEANHPMDWENGTHQQWFNPSIFLPEERLHYHYVGSLTTPPTKGPVKWFVFDTIQKMDQAFLNKIKEGMLAFNNRPLQPLNGRKIYFSND

SEQ ID NO: 37908 - protein, 132 aa, Glycine max
CTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 37909 - protein, 278 aa, Thermobifida fusca YX
MRLLPVLIDAAVVVFSVSSMLSVGLGNPARELVQRLRATSRVVRAVAANFVLVPLLAVAVTRLMPLAPPLATGLLLVATAAGAPFLIKLTEVAEGEMGSSTALLVVLLPVTVLTMPIVVPLLVSGTTVSAGAIAVPLLVTMLLPLAVGMVLREWRPTWEQMLRPVLTKTSTVALLLLVAATVLANSTAITDLVVQGALLPALLVIGGAFGIGYLLGGSDARFREVLGLGTSQRNIAAATVVATQSFADPRIVVMVVVTSLVGFAVLFPVAALFRKRRS

SEQ ID NO: 37910 - protein, 542 aa, Azoarcus sp. EbN1
MSAGGEEGSVQETSLHAHARSAAAERRLARTVLLDRLRKSQRWDVVVIGGGATGLGCAVDAAARGYSTLLVEACDFAKGTSSRATKLIHGGVRYLARGELGLVREALAERSRLLANAPHLVHPLRFVVPAYHWHDRARFGLGLGFYDLLAGIHGIERSRMLDAAATAAALPGLNPSGLRGGIAYWDAQFDDARLAIALMRTVFDLGGLALNYLPVDGLILEAGRVQGVIARDAESGEVFRIAARVVINATGVWADAVRRLERPAASALVRPSQGVHVVVDRSFLPGDTALLVPETPDGRVLFVIPWQGKVLIGTTDTPRSDVPLEPEALPGEVDFILATAARYLAPAPTRADVRSIFVGLRPLVGEDDRTATHRLSREHCIEVSPGGLVTITGGKWTTYRRMAEETVDQACALGMLPRRPAATAALRLHGATTGFSGDCYGCDRAVVDLLPGAARRIQDGLTLTEAEVRHAARFELARGVEDVLARRHRALVLDAARAAAAAPAVAALLAQELGHDAQWCVDEVARFRALAIRYGAPAGECS

SEQ ID NO: 37911 - protein, 495 aa, Mycobacterium tuberculosis H37Rv
MAGRRRMKSVEQSIADTDEPTTRLRKDLTWWDLVVFGVSVVIGAGIFTVTASTAGDITGPAIWISFLIAAATCALAALCYAEFASTLPVAGSAYTFSYATFGEFLAWVIGWNLVLELAMGAAVVAKGWSSYLGTVFGFGNGTGHLGSLQLDWGALVIVTLVATLIALGTKLSSRFSAVVTAIKVSVVVLVVVVGAFYIRAANYSPFIPEPEVQHHGGGLDQSVFSLLTGAQGSHYGWYGVLAGASIVFFAFIGFDIVATMAEETKRPQRDVPRGILASLGVVTLLYVAVSVVLSGMVPYTQLRTVPGRGPANLATAFQANGVYWASGIISVGALAGLTTVVMVLMLGQCRVLFAMARDGLVPRQLAKTGSRGTPVRVTVLVAVLVATTASVFPITKLEEMVNVGTLFAFILVSAGVVVLRRTRPDLQRGFTAPWVPLLPIAAVCACLWLMLNLTALTWIRFGIWLVAGTAIYVGYGRRHSAQGLRQARESATRRC

SEQ ID NO: 37912 - protein, 359 aa, Enterococcus faecalis V583
MKRLLILEDGTVFEGKAFGAEGNVVGEVVFTTGMTGYQEAITDQSFNGQMITFTYPLVGNYGVNRDDYESIAPTCKGVIVKEHARVASNWRQQMTLDEFLKRKGIPGISGIDTRALTRKLRSAGTMKGSIIDAVDDLPHAFDQLKATVMPKNQVAQVSTTKPYPSPGIGRNVVVVDFGLKHSILRELSKRQCNLTVLPYNTTAEEILELSPDGVMLTNGPGDPKDVPEAIEMIQAIQGKVPIFGICLGHQLFSLANGADTYKMKFGHRGLNHPVREIATGRIDFTSQNHGYAVDEATIDPEKLLVTHVEVNDGTVEGVRHRDYPAFTVQYHPDAAPGPHDGLHLFDEFMELMDAWKEQN

SEQ ID NO: 37913 - protein, 251 aa, Sulfolobus solfataricus P2
METEIPIRIYYPDNKRDHPIILHFHGGAWILGSIETEDSVSRILANSCNCIVISVNYRLAPEHKFPAAVTDCFDSIKWTYENAESIGGHPNRIAVFGISAGGNLAAATSILSRDQGIKLRAQALVVPFVYLDLASTSMTEYRKGYFLDINVPIDYGIMMYIRDEKDLLNPMFVPLIAEDLSNLPQAIIVTAEYDPLRDQGEAYAKRLMEAGVLTLSFRVNGMVHGFLGSPNISRLVSVMVGSALKDILMRG

SEQ ID NO: 37914 - protein, 633 aa, Triticum aestivum
  misc_feature (599)..(599): Xaa can be any naturally occurring amino acid
  misc_feature (620)..(620): Xaa can be any naturally occurring amino acid
  misc_feature (622)..(622): Xaa can be any naturally occurring amino acid
  misc_feature (629)..(629): Xaa can be any naturally occurring amino acid
MVAAAILPELATQLVVPVAAAVGIAFAVLQWVLVSKVKVAPEPRGEGGSAAGGGAGAGAKDGASEYLIEEEEGLNDHNVVLKCAEIQTAISEGATSFLFTEYKYAGGFMTVFAVLIFVFLGSIEGFSTKSQPCHYSVGKTCKPALANAAFSTIAFVLGAVTSLVSGFLGMKIATYANARTTLEARKGVGKAFIVAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINREFTPMMYPLLISSVGIIACLITTLFATDFFEVKEVDQIEPALKKQLIISTAVMTVGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFXRMTMKRVGTPAPKWGGEVRRXFXTIPGPRXGTPT

SEQ ID NO: 37915 - protein, 342 aa, Ralstonia metallidurans CH34
MKLTILGAGAWGTALASHAATAAADHDVVLWGRDPAQLAGIAATGVNATYLPGVSLSPRLVCEPDFDRAVDHALTDPEGLLIIGTPVSGLREMTRRLAARRKGPLAMLWLCKGFEAETHAMPHQMVHDELNALGVAPGEIEYGVLTGPSFAKEVAQGLPCALTVAGTAHVLIDRAQAAFHHHAMRIYGSDDLIGVEVGGAVKNVLAIATGASDGLGLGLNARAALITRGLAEMTRLGLALGGRVETFMGLAGMGDLILTATGDLSRNRKVGQQLAGGKTLDQILADLGHVAEGVRCAQAVAALAARVGVEMPITRAVCAVLFEGLPVADAVSQLLQRDARDE

SEQ ID NO: 37916 - protein, 699 aa, Ostreococcus tauri
MSGLSSNTALSALLGSRGHGTAQHILENGHVRALSESAEGMFRERDSHRIGFKSKIICTLGPVSRTVEILEKMLRAGMSIARFNFSHGSHEYHQETLDNLRLACANTGVDCAILLDTKGPEIRTGMLDGGGPIMLEVGNEITLTTDYDFKGSAEKIAVSYPDLAKDVKPGSKILCADGSVTFTVLECDVAKGEVRCKLENSAKLGERKNMNLPGVVVNLPTITEKDRHDLIEWGVKNQVDFIAASFVRKGSDVEYIRSVLGDFASKVSIISKVENMEGLDNFEDIVEASDGVMVARGDLGMEIRMEQIFLAQKRMIKRCNLAGKPVVTATQMLESMTGAPRPTRAEATDVANAILDGTDAVMLSGETAAGSYPLDAVKCMASICREAEAYVNDVADYFQILEQQMVPLGVTEAMASSAVRTAQKVNASLIITLSRTGHTAQMIAKYRPAMRIINVCMDDAGFPGRALEVSRRSLITRGLVPLLEHPAWRGESGHPQEVMRNAIIYCRDVLGLVKAGDAVIGVHRIMGEAVLKVVIHSRLEGHNSHSHPRARSPPERPKIPKISNRQGKTRLAKYYVPLDDDEKRRVESDVHRLVVNRDPKHTNICEFRGNSKIVYRRYAGLFFSLCVDLNDNELTHLESIHLFVEMLDHFFANVCELDLVFNFQKVYLLVDEFILGGEVQDTSKRAIMERLAELERLKD

SEQ ID NO: 37917 - protein, 311 aa, Sulfolobus solfataricus P2
MPLDPQVKELLTKINLLLPTTPLTPQEFRKVRNELFIKMFNNEKVGLYNIRDMTIPVRNGDIKVRVYFPNQRENLPAVVYYHGGGFVYGNLDTHDSVCRLISKLSNTIIVSVDYRLAPEHKFPTQVYDAYDVVKWLANNGGKLSIDTSKIAVAGDSAGGNLSTVVSILDRDNGENVVKYQIMIYPVVNMLDSSPSMYNYGDGYFLTYERILWYNKQYVKEDSDYYNPLASPILAESHNLPPALIITAEYDPLRDQGEMYAHKLKVSGVKTISLRYNGMIHGFVSFYEYLDTGKEAIHHIASSIRKMFNVFY

SEQ ID NO: 37918 - protein, 438 aa, Gibberella zeae PH-1
MDSARPVCGSDGPGEEYPLGMHIGGLFAVLSVSCLGAGFPVAAKRIKWLKMPPKVFFACKHFGTGVLVATAFVHLLPTAFGSLTNPCLPELFTDIYPAMPGVIMMTSMFLLFMVELYLNAKTGGHSHGGPTGTTITAPPPPRPQRPQRPFPQDENHGHARNDSFNSDYSDDEVTYEKAMAREMYEKEQRPHAYSKDDSNSTMPAWFVVFYEQYVRQRSEMIEMIKESQYSQAAIDSKPHAEVSESYFDEENNSIDQETFKRMSMNITLLEGGILFHSVFVGMTIAMTTDGLLVFLIAIMFHQMFEGLGLGSRIAAVPYPKGSVRPWLLVFAFGCTAPIGQAIGIASRNSYDPESEMGLIMVGVFNSISSGLLIYAALINLLAEDFLSEEAQHLMKKKDQIFALCWIFLGAFDNDDDCNIAVFFWLRNALADEDGIATV

SEQ ID NO: 37919 - protein, 252 aa, Zea mays
MGKDDVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 37920 - protein, 582 aa, marine gamma proteobacterium HTCC2080
MEQLSGGEMIVRALEDEGVEYVFGYPGGAALHIYDAIFKLDAVPHILVRHEQAATHAADGYARATGKPGVVLVTSGPGATNAITGIATAYMDSIPMVVLAGQVQTHLIGEDAFQETDMVGVSRPIVKHSFMVKRTEDIPSIIKKAFYIATTGRPGPVVIDIPKDLTHPEHKFDYHYPESVTLRSYQPSSRGHTGQIRKAARLLLSAKRPIIYAGGGVIQGEGCELLTTLAQKLNYPVTNTLMGLGAYPGSDRQFLGMLGMHGFYEANMAMHHSDVILAVGARFDDRVTNTVGKFCPGAKIIHIDVDPASIAKIVPVDIPIVGPVQTVLTELLAQIDAHLQGSDREMPEPAALAQWWQQIESWREAHGLWHGRRYGESELAMPQDVIKCLYEVTEGDAYVTSDVGQHQMFAAQYYKFDKPRRWINSGGLGTMGFGLPAAMGIKLALPDAEVACVTGEGSIQMNIQELSTCAQYGTPIKIVSLRNNYLGMVKQWQDMQYEGRYSESHYAASLPDFVKLAESFGHVGIKVEKRDDLEAAMREAFALKDRLVFLDVFVEPHEHVYPMHVAPSGAMKDMWLSKTERT

SEQ ID NO: 37921 - protein, 163 aa, marine gamma proteobacterium HTCC2080
MRRILSVLLENEPGALSRVVGLFSQRGYNIESLNVAPTDDHSLSRLTLTTSGDDLKIEQINKQLNKLIDVVKVVDLTEGAHVERDLLLVKVRAVGQQRDEVKRTTDIFRGQIIDVGPATYVIQLTGPTEKLDSFVAALGDAEIMEVVRSGVAGMARGEKVLAP

SEQ ID NO: 37922 - protein, 200 aa, Ehrlichia canis str. Jake
MTLVPMVVEQTSRGERAYDIYSRLLKERIIFITGPIEDQMASLVVAQLVFLEAENPEKEICMYINSPGGVVTAGLSIYDTMQYIKPKVSTLCLGQAASMGSLLLAAGEPGMRYALPNSRIMIHQPSGGFQGQATDIEIHAKEILDIKSRLNDIYVKHTGRDLPEVVANMERDNFMRAEKAKDFGIIDKVIEKRLDIEESN

SEQ ID NO: 37923 - protein, 664 aa, marine gamma proteobacterium HTCC2080
MAFDLIMPPIVGLVGLLVAFVIYNVMSKHDAGPDNVKHIADQIHVGAMVFMHREYKMLAVFAAVLVLGIFLSPLGQDTAIAFIVGALSSATAGYLGMYAATRANVRTAVAANDHGPAKALNIAFYGGSIMGLCVASLGLIGLGGLFYYFGTDAESVHSIHGFGMGASVVALFSRVGGGIFTKSADVGADLVGKIEAGIPEDDPRNPGVIADNVGDNVGDIAGMGSDIFESYCGSMIACIAIAATMAVAAEQQTSLMMLPLGLATVGLLASFIGIILVRARSAAAPEDALRSGTLAAPVVFAAMAWFLVEALGLDAKVWWAVVSGAVGGVAIGLITEYYTGGSPVRKIAKSGETGPATVMITGLAVGMESVVVPILALAAIIYASTELAGLYGVGIAAVGMLSTVGITMAIDAYGPVADNAGGIAEMAGMGEDTRKITDGLDEVGNTTAAIGKGFAIGAAALAALAIIAAYVSTVSVLNPGFTLELSEPQVLIGMFIGGSIPFLIASITMTAVGEAAFDMINEIRRQFREIPGLLEGTADPDTERCVDIATTAALKRMILPGAIAVLAPVVVGFGLGPESLGGMLAGGLLGCVLMALMMANAGGAWDNAKKYVEKGNLGGKGSDTHSAVVVGDTVGDPFKDTSGPSMNILINVMAIVSLVIAPLL

SEQ ID NO: 37924 - protein, 279 aa, Synechococcus sp. WH 8102
MNLFADLLATTQAPSATATGPRIQKRRGVEIKSAREIKIMREASRIVATVLREVMSMVEPGQTTGELDAFAEKRIREMGATPSFKGYHGFPASICASINNEVVHGIPNAKRVIHKGDLLKVDTGAYFEGYHGDSCITVCVGESSAEAQTLSRVAQESLMAGLSQVKAGNTLLDIAGAVEDHVKANGFSVVEDYTGHGVGRNLHEEPSVFNFRTDELPNVTLRPGMTLAIEPILNAGSKTCRTLKDRWTVVTRDGSLSAQWEHTVLVTSDGCEILTDRGD

SEQ ID NO: 37925 - protein, 384 aa, Zea mays
MLAARSFASPARQCLRQANRSRWAPALSQVSARTYASEVAKFHGTKGSDGKYCVTLIEGDGIGPEIAQSVKDIYSAANVPIKWESVDVTPRLNEEGKTVISDESIASVKKNLVALKGPLATPIGKGHVSLNLTLRRTFNLFANVRPCRSIAGYKTPYDDVDTVLIRENTEGEYSGIEHIVVDGVVQSIKLITREASERVLRYAFQHARDIGRKKVRAVHKATIMKMSDGLFLSTAREIAKDFPDIEFDAELLDNTCLKMVTDPVPYNDKVLVMPNLYGDILSDMCAGLIGGLGLTPSGNIGDNCSIFEAVHGSAPDIAGKQLANPTALLLSSIMMLRHMGLNSEAANIEQAIFKVLAEGKTITGDLGGKAKTFEYADAVIKALK

SEQ ID NO: 37926 - protein, 421 aa, Synechococcus sp. WH 8102
MTPERLGLLWGVTVFAGASARLLAAVSGLPGVVLLLLSGLLIGRSGLGLVEPLDLGPGLGTVVGLLVSLVLFDGGLNLRLPGDTIRATVKRIAVLRLLISLGAGLLAAHWLAGLSWSVAAVFSAIVLATGPTVVTPLVRQIRLAAPLGDVLEAEGLVLEPIGAVLALLLLELVLGNLHGWRELVLGLLERLGGGVLIGASVGWLLSELLQRLKPDQSSGLPLQLTLGMLFLMYGLSEWLLPESALPASVAAGIVVGRRQTVHTADLDGLIQELAQLAITMLFPLLAADVSWAELSPLGWGGISCVLVLMLVVRPIAVGVATVGLPLNLPQKLLLGWLAPRGIVTASVASLFAIRLEQAGILGAGRLQGLVFLTILMTVGLQGLTAQPLARALGLIEASGDETTTSGEATLQPGEVLPDPGQ

SEQ ID NO: 37927 - protein, 133 aa, Arabidopsis thaliana
  misc_feature (40)..(40): Xaa can be any naturally occurring amino acid
  misc_feature (53)..(53): Xaa can be any naturally occurring amino acid
  misc_feature (56)..(56): Xaa can be any naturally occurring amino acid
  misc_feature (59)..(59): Xaa can be any naturally occurring amino acid
  misc_feature (83)..(83): Xaa can be any naturally occurring amino acid
  misc_feature (99)..(99): Xaa can be any naturally occurring amino acid
  misc_feature (109)..(109): Xaa can be any naturally occurring amino acid
VSKTKSKEEKRASSMLLFGLLMGWPLGLRATRVAPLKGLXKSSAAFPATGKGXKNXITXSIKSKGGRVTACRVWPPMGKKESXRPLSLPSLTLTDSELXREVDYLIGNXWILVLNSSWSTDLCTVSPVTHPDT

SEQ ID NO: 37928 - protein, 265 aa, Mycobacterium tuberculosis
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRGGVPRGAAALEHHHHHH

SEQ ID NO: 37929 - protein, 224 aa, Cryptococcus neoformans var. neoformans B-3501A
MSLRIATTTARAIPARAVATRSIMTLRRVAVPQASPKGYRQSSILQDTAKTAHSAFANLASAAPIKKGDKMPDVEIKIDGPEGKVNLGKEKGKNVVVLVPGAFSGVCSNQVPPYITSFSDFKAKGINNVYVVAVNDIFVVNAWKDKMIGEFSSKEGEGVKFAADDTAALASALGLTFDAQPVFGGPRLKRGVLVVNDGMVEYVGVEDSPGDITISAADKVIKQL

SEQ ID NO: 37930 - protein, 345 aa, Oryza sativa Indica Group
MVSMEVTDEMFKCMEVGLAFRDYNGRISSMDFHSKATNYLVTACDDESIRLYDIQNAVCLKTINSKKYGVELVCFTENPTYVLHSSKNGWDDSLRLLSLVNNCFLRYFKGHLDSQYQQRILSVLIRVVSISLCSENGNILSGSLDRTVLLWDSRVEKAQGLLRVQGRPAVSYDDQGLVFAIAYGGYIRMFDARNFEKGPFDIFSVGNDDSEANVIKFSSDGRRLLLTTKAGRVHVLDSFHGNNIATYNVKPVVSNSTLEASFSPDGNHIISGSGDGSVYAWNVRSGKVARWGSTDSEPPLIRWAPGSLMFLTASSELSCWVPDLSKLGSFTVSLCSSCLQNDNVR

SEQ ID NO: 37931 - protein, 510 aa, Pseudomonas syringae pv. syringae B728a
MTATPKPLVLIILDGFGHSESHKGNAILAAKMPVMDRLYQTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVKRGAEKIYLHAFLDGRDTPPRSAKKSLELMDATFARLGKGRTATIVGRYFAMDRDNRWDRVSSAYNLIVDSTADFHADSAVAGLEAAYARDENDEFVKATRIGEAARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIVVNYANGDMVGHSGIMEAAIKAVECLDVCVGRIAEALEKVGGEALITADHGNVEQMTDDSTGQAHTAHTSEPVPFVYVGKRQLKVRQGGVLADVAPTMLHLLGMEKPQEMTGHSILVAE

SEQ ID NO: 37932 - protein, 192 aa, Zea mays
  misc_feature (42)..(42): Xaa can be any naturally occurring amino acid
  misc_feature (54)..(54): Xaa can be any naturally occurring amino acid
  misc_feature (133)..(133): Xaa can be any naturally occurring amino acid
  misc_feature (169)..(169): Xaa can be any naturally occurring amino acid
  misc_feature (183)..(183): Xaa can be any naturally occurring amino acid
MASVASSTTLISSTRILLPATKSPLLPSPSLSSPSPSASLRXSLIPLPSPQSAXTSRRSFAVKAQTDDLPLVGNKAPDFEAEAVFDQEFIKVKLSEYIGKKYVILFFYPLDFTFVCPTEITAFSDRYAKFEKXNKKVLGALVDSVFSHLAWIQQTENLEGLGDLNYPLXISDGTKSSQKSFGXVLIHDPGKS

SEQ ID NO: 37933 - protein, 377 aa, Mycobacterium avium 104
MQTQAAVLFERNTPWSIESIELDAPKATEVLIELHASGMCHSDDHLVTGDMPIRLPCIGGHEGAGVVKAVGEHVSWLSPGDHVVFSFIPSCGRCPSCSTGHQSLCDLGAKIYSGMQIHDGTARHHLGGDDLALACGIGSFAHHTVVHEASCVKIPDHYRLDLACLLGCGFITGWGSSVYAANVRPGDTVAIAGVGGIGAAAVQGARLAGARTITVIDPSEYKRAEAVKMGATHTAADWNEAKAVVAEATWNRGVDKFICAMGVGDGQLVGQALAMTAKRGRLVVTNIHPMLEREIRANLMDLTLTEKQIVGTLYGSGNPRADIPKILELYSAGQVDLESMVTRTYPLEKVNDGYADMHAGANIRGVLIYPPAEGSLG

SEQ ID NO: 37934 - protein, 445 aa, Sulfolobus solfataricus P2
MSTFLMLNPLHIIMEIKSTVTVIGGGVSGLFTALDLALRGIDVTLVDRGDIGYGTSGKFHGLLHSGARYAVTDPDSARECIQENKIISKIAPHTVKDTGGVFLGITDDDLQFSETFIKALNKVGIESKVIDVKEVLQKEPFINRDTKMAIWVPDKVVYGYDLLASVAITASLNGAKILTYNEVVEIIRENNNVKGVKVLDKINNNTNVIKSDIIVNTAGPWSFNIIKMAGLEEIPIMPTAGIIVVFDKRVNNMVINRLRPPSDGDIIVPYADSSILGTTATIIEDPDNFTISDEDIAMLVNEGAYLIPKLKNMRVVRSYASVRPLIKSEVSAREASRDFRIIDHEKENGLSGLVSVIGGKFTTGRLAGERVADLVSSKLGIKSASKTATTKLLSPNDINLLNYAEKIRLPKVIVRSILDRKGSLDEERYLSSLYILLSLISRGTM

SEQ ID NO: 37935 - protein, 316 aa, Vibrio cholerae O1 biovar eltor str. N16961
MRQTNNKESTMKPTADILASIIEEVRPLTSKGIVADYIPALAKVPSDKLGIAVFTNQGEVITAGDAQEGFSIQSISKVLSLTLAMGLYQPDELWSRVGKEPSGQAFNSLIQLEMEQGIPRNPFINAGAIVVCDMLQSRLSAPRQRLLEFVRQLSGEPQIAYDKVVAASEMMHSDRNAAIAYLMRSFGNFHNEVIPVLHNYFHACALKMSCVELAKTFSYLANKGVSVVTGETVITPTQSKQTNALLATCGLYDGAGEFAYRVGMPGKSGVGGGIIAVVPGEMTIAVWSPALDQSGNSLAGTRALELLAQRIGRSIF

SEQ ID NO: 37936 - protein, 1546 aa, Ostreococcus tauri
MRADVGERARERAPGPSRVHVHGETSLDDYVITRPCGEGSFGRVFQARRRYTGRACAMKFIPKSNKSERELASLRQEIDIMRTLDHPNVIKMLDAFETERDFVVVMEFAQGVLSDVLANDATLPESEVRRIAEQLISALHYLHSNRVIHRDLKPQNILIGGDGKVKLCDFGFARSMSESSLVMTSVKGTPLYMAPELVQEQPYDHTVDLWSIGIILYELFAGEPPFYTKSMYTLLQRIAREDVKYPETMSNTFRSFLQGLLIKRPRDRLNWPNVLDHPFVRRVDGTATEDARDDRVPEEPTNRAPTNRGREAGSAHDGRSSGGSSSLFSSMEDVNDVLREIEITARKSADAACGLRFDKDALTKIMETLQPQSSLRSKFFPSVISNRTLGKKSEPKLAKTADVMSALRSTLLILSVPREKLIRSGVGLSVIGKELPAAVINACSMAANASDPPQPELLALAIRVVAAMAEPTGSSPWCGLGLLGYLMFLGKLLGYQHRDLGEAVLSTTCTAIADAVEAAMSRGQSVELTATRAALGPASSRGGGLTDALCQTLAKSTTQATASETCRALYAATEIGTLTKYVAVTLSKKNDGTQKLIRSATMKVHSAKLLKTVAEANEDIRTEANNADGVRILAAILVDETSKKRVTSQNARLTAAVMNAVGPLLTSRTQHPVVTMLDVGMAEPLCSALTAFRSVAEQAEGGTLNDVTLVPACELMRLALMPLRTPDMEEQPTERANRQFRAMLFERNVVKTLIESVTTSPSDQWSAPIALLSSLVMSSGIQSSQIAAIFIASGGLDPTLCGKVLQHSSAQVVVDWLIIIMQLSRIDKENSRVIDEANIIKTITRLLDHPDASVRARACNAIGSVCRHDDYFYEEFLEVKTVEKLIERCGDRDRSTRKWATFAIGNAAFHSDALYGPLTAAVDPLMYLLDANEEAKTRSNACAALGNLARNSNVLCGLMVNSGALDAIINLITAPSEGKEPAAFDPELIKVCFYSLGNLCRHRACRERLAARNIDPILDDLAQRGTGDVRRYVDRIKSKLAAANVRASQSPSKALSQKLKSIALAERKSVLIIGGGLAGLSCGKYLSDAGARPIVVERNKMLGGKVSAWRDAEGDWIETGLHIFFGAYPNMMNLFAELGIEDRLQWKEHSMTFAMKDYPGEFTKFKFPENVPAPFNMAYAILSNDKMLTWTEKLRTGAPLVPMLAGGQGYIDAQDELSVEEWMKKNFMPKRVSDELFIAMGKALDFIDVDKLSMTVILTAMNRFINETHGSKTAFLDGNQPDRLCAPMKEHIERVGGGEVMVDTPMQEILTDVEGNVEGVKLRNGEILTADHYVSAMPVDALKLKLPDAWKPMPFFKQLDELEGIPVINVHLWFDRKLRPYDGLVFSRSPLLSVYADMSECCKEYTDSERSMLELVFAPCDKRAGSDINWIGASDEEIVAATLKELEKLFPDELGSNGGAKLRKSAVVKTPRSVYAAIPGRNKFRPSQQTPIKNFTLAGDFTSQKFLGSMEGAVLSGKLAAEVVAETLAGCEPTRGIKPVHESVRV

SEQ ID NO: 37937 - protein, 474 aa, Oryza sativa
MGRGCGRWWWVAVALVVVAAAAAAEGAREEAAVAVAVAPRRHAYAAMMYMGTPRDYEFYVATRVMMRSLGRLGSDADRVVIASLDVPPRWVQALKDDGVKVVSVENLKNPYEKQENFNMRFKLTLNKLYAWSLVSYDRVVMLDSDNIFLQNTDELFQCGQFCAVFINPCIFHTGLFVLQPSMDVFKNMLHELAVGRDNPDGADQGFLASYFPDLLDRPMFHPPVNGTKLEGTYRLPLGYQMDASYYYLKLRWSIPCGPNSVITFPSAPWFKPWYWWSWPVLPLGLSWHEQRRENLGYSSELPVVLIQALFYIGVIAVTRLARPSLSKMCYNRRMEKSTIVLLTTLRVVAAWSILAAYTIPFFLIPRTVHPLLGWPLYLLGAFSFSSIVINVFLLHPLAVLTTWLGIIGALFVMAFPWYLNGVVRALAVFAYAFCCAPLIWGSLVKTMSSLQILIERDAFRLGEPNQTAEFTKLY

SEQ ID NO: 37938 - protein, 559 aa, Bartonella quintana str. Toulouse
MRYKFMGDSLSIRNEKAFEAALQALRRHATKDGVYDIRRHFVEDEQRFSHFSLRLDDLLFDFSKCGITFKTLQLLDDLAVAADVLGRREAMFSGKAINTTEKRSVLHIALRMPTDEVFMLDGHDLVRDIQDVLAHMERFSEMVRDGSYKGNTGEKIINIVNIGIGGSDLGPAMVTHALKPYHDGPHCHFVSNADTAHISDTLSVLNPATTLFIIASKTFTTAETIANAQVARQWIISHLGEEAVCRHFVAVSSALDKVAEFGIDSSRIFKFWDWVGGRYSIWSAIGLVVMLAIGGQNFRQFLNGAQQMDRHFKIAPLHKNIPIRFALLGFWHRVVCGYASRAIIPYAQRLARFPAYLQQLDMESNGKQVSLDGKTLNFSSGPVVWGDSGTNGQHAFFQLLHQGTDVIPVEFILFIKGHEQNLHPMYDILVANCLAQSKALMKGRSVEDVRRILVKSGIDVHETEKLALHKSFEGNRPSIMLVQDLLTPFTLGRLIALYEHRIFVEGILMNINSFDQWGVEFGKELANELLPILRGENKANNRDSSTLGLLAYIQARREE

SEQ ID NO: 37939 - protein, 433 aa, Spinacia oleracea
GASFSLHVLSKINSYKSQSTKPIRGVASMAKKSVGDLTSADLKGKKVFVRADLNVPLDDSQNITDDTRIRAAIPTIKHLINNGAKVILSSHLGRPKGVTPKFSLAPLVPRLSELLGLQVVKADDCIGPDVEKLVAELPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGMSVGSSLVEEDKLDLATSLLAKAKEKGVSLLLPTDVVIADKFAADADSKIVPASGIPDGWMGLDIGPDSIKTFSEALDTTQTVIWNGPMGVFEFEKFAAGTEAIAKKLEEISKKGATTIIGGGDSVAAVEKVGVAEAMSHISTGGGASLELLEGKQLPGVLALNEADPVPV

SEQ ID NO: 37940 - protein, 272 aa, Vibrio cholerae O1 biovar eltor str. N16961
MEQRSIAFIGAGNMARAIIAGLIASGYAADKIIATAPSLTRREPLEAQYGIRTTSDNLAAAQQADVVVLAVKPQLMAEVCKPLQAVDFSGKLVISIAAGVSVKRLNEMLATQLNLVRVMPNTPSLVNLGMSGLYAPDSVSEADKAFTTQLMQSVGEVCWVDNESGINSVIAAAGSAPAYFFLFMQAMQQEAMAQGFDEATARLLVQQSALGAAAMVKANPELSLATLREQVTSKGGTTAQAIQTFNDHQLSDIVAKAMQAAVTRAQEMEQLF

SEQ ID NO: 37941 - protein, 306 aa, Synechococcus sp. WH 7803
MGWTTEDMPDQQGRIALVTGANSGLGLETTRALISRGCTVLMACRSARKGEAARSQLLGSGAAGLDLLELDLSDLTSVARCAREVAERYGRLDLLINNAGLMAPPRMLSRQGYELQFAVNHLGHFALTKALLPLMDDRPQARVVTVTSGAQYFGVMAWDDLQGEQRYDRWKAYSQSKLANVMFALELNQRLQASGSAVRSLAAHPGLARTNLQPVSVAATGAWQEALAYRLMDPLFQSAAQGALPQLYAATASEAQGGEHYGPSQLGGLRGAPKQQPVARAAKDQNLRQRLWTVSESLTEHHSAAV

SEQ ID NO: 37942 - protein, 837 aa, Bartonella quintana str. Toulouse
MNTGFNEIEILSIRSVKLAAAFDHKNDAIHAAAELLVQIGAVDKCYLASMLKREAVTNTWLGNGIAIPHGMVENRDLIIRDAVAVVQIPAGVEWRDGNKARLVIAIAACPDRYIEICKKLMRLLFDKEQLEALSTTADRQQIVTTLFGQDQDTESGRTFIGDLSVCQEWTLDYPSGLHARPASLWVDFAKKAQSSIRVRRGQYAVEMKNLVGLLQLGAKNGDVLIFSTDALEGAQLLEEAISVVKKVSISEKCVIREMEAQTKTFHSWYPRSGQRGLSGIGVSPGLALGKIFVLRQNDISITDQPTGFVAGTVCLENALTKTKHKMASIIDDITARMGADSAAIFSAQMVLLEDENLIAQACRFMAEGHGVAWSWDRAVRQFADTLSKVDNPLLAARAVNLVDVGRRVLGEINPSYRSFFLNDIPPEVILVTDDLSPSDVAQLDCTKVHGLATAWGGPLSHTAILARTLGIPMVVAAGVDVLAIERDIQAIIDGDNGFIYLDPTLEDMEEAQKQMSIVAQKRDSGVCACRLPVQTTDGQRIRIMANVNYANQVPVALDLGAEGVGLMRTEFLFIDSPNIPDEDAQLDVYRAMIAAVGGDKPLIIRALDIGGDKQVTHLHLSKENNPFLGVRGTRLLLRRRDLLVPQLRALYRAAKEGGDLWILFPMVMSVSEIFAMKKIAEEIQNDIGAPKLKFGIMIEVPAAAIMADILSAHVDFFSIGTNDLTQYTMAVDRQNPHLVSEADSLDPAVLRMINYTIQGAAKHKCWVSVCGGMAGDPFAAMILTGLGIHELSMISCDISSVKACLQAHSFEDMKILAKKALQCETAGAVRALRNDIR

SEQ ID NO: 37943 - protein, 500 aa, Bacteroides thetaiotaomicron VPI-5482
MNQELLMNPNCLVAALEKPAAEFTKADIISFIQKNNIRMVNFMYPAADGRLKTLNFVINNAAYLDAILTCGERVDGSSLFPFIEAGSSDLYVVPRFRTAFVDPFAEIPTLSMLCSFFNKDGEPLESSPEHTLHKACKAFTDVTGMEFQAMGELEYYVISPDTGMFQATDQRGYHESAPYAKFNDFRTQCMSYIAQTGGQIKYGHSEVGNFTLDGMIYEQNEIEFLPVHAEDAADQLMIAKWVIRNLGYRYGYNVTFAPKITAGKAGSGLHVHMRIVKDGQNQMLKDGVLSETARKAIAGMMELAPSITAFGNTNPTSYFRLVPHQEAPTNVCWGDRNRSVLVRVPLGWAAKTDMCTLANPLESESHFDTSQKQTVEMRSPDGSADLYQLLAGLAVACRHGFEIEQALDIAKRTYVNVNIHQKENEDKLKALAQLPDSCAASAECLQKQRAVFEQYNVFSPAMIDGIIRKLRSYEDKTLRADMEGKPEEMLELVHKYFHCG

SEQ ID NO: 37944 - protein, 236 aa, Vibrio cholerae O1 biovar eltor str. N16961
MRSIQQNIEHITAQIESAQQKCGRARSSVQLLAVSKTKPVEAILEATQAGQRYFGENYVQEGVDKIRYFAEHHPQLALEWHFIGPLQSNKTRLVAEHFDWVHTIDREKIALRLSEQRPVNMPPLQVLIQVNTSGEASKSGIEPQQLFTLAELISRLPNLTLRGLMSIPENVPDYPAQLAAFTQLAELQQQLAQKYPQIDTLSMGMSGDMQAAIEAGSTIVRIGTAIFGERDYSRNA

SEQ ID NO: 37945 - protein, 1501 aa, Candida dubliniensis
MSDSKMSSQDESKLERATSQDSSSENHSINEYHGFDAHTSENIQNLARTFTHDSFKDDSSAGLLKYLTHMSEVPGVNPYEQEEINNEQLDPDSENFNAKFWVKNLRKLFESDPEYYKPSKLGIGYKNLRAYGVANDSDYQPTVTNALWKLATEGLRHFQKDDESRYFDILKSVDAIMRPGELTVVLGRPGAGCSTLLKTIAVNTYGFHIGKESQITYDGLSPKDIEHHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTPQEFEAYWKNSPEYAELIQEIDEYFVECEKSNTRETYRESHVAKQSNNTRPASPYTVSFFMQVRYGVARNFLRMKGDPSIPIFSVFGQLVMGLILSSVFYNLNQTTGSFYYRGASMFFAVLFNAFSSLLEIMSLFEARPIVEKHKKYALYRPSADALASIISELPVKLAMSMSFNFVFYFMVNFRRNPGRFFFYWLMCVWCTFVMSHLFRSIGAVSTSIAGAMTPATVLLLAMVIYTGFVIPTPSMLGWSRWINYINPVGYVFEALMVNEFHGREFQCAQYVPSGPGFENVSRSNQVCTAVGSIPGNEMVSGTNYLAGAYQYYNSHKWRNLGITIGFAVFFLAIYIALTEFNKGAMQKGEIVLFLKGSLKKHKRKTAAAKKGDIEAGPVSGKLDYQDEAEAVSNEKFTEKGSTGSVDFPENREIFFWKDLTYQVKIKKEDRVILDHVDGWVKPGQITALMGASGAGKTTLLNCLSERVTTGVITDGERLVNGHALDSSFQRSIGYVQQQDVHLPTSTVREALQFSAYLRQSNKIPKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVRDEISRMEVELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVVVGTIAFFCWYYPLGLYSNATPTDSVNPRGVLMWMLVTSFYVYTSTMGQLCMSFSELADNAANLATLLFTMCLNFCGVLAGPSVLPGFWIFMYRCNPFTYLIQAMLSTGLANTFVRCADREYVSVQPPNGQTCSSYLDPYIKMAGGYFETNNDGSCSFCQMSSTNTFLKSINSLYSERWRNFGIFIAFIAINIILTVLFYWLARVPKGNREKKNKK

SEQ ID NO: 37946 - protein, 376 aa, Bacteroides thetaiotaomicron VPI-5482
MKIHEYQAKEIFSKYGIPVERHTLCRTAAGAVAAYKRMGSDRVVIKAQVLTGGRGKAGGVKLVDNTEDTYQEAKNILGMSIKGLPVNQILVSEAVDIAAEYYVSFTIDRNTRSVILMMSASGGMDIEEVARQSPEKIIRYAIDPFIGLPDYLARRFAFSLFPHIEQAGRMAAILQALYKIFMENDASLVEVNPLALTAKGILMAIDAKIVFDDNALYRHPDVLSLFDPTEEEKVEADAKNKGFSYVHMDGNIGCMVNGAGLAMATMDMIKLHGGNPANFLDIGGSSNPVKVVEAMKLLLQDEKVKVVLINIFGGITRCDDVAIGLIQAFDQIKSDIPVIVRLTGTNEHLGRDLLRNHSRFQIATTMQEAALMAIKS

SEQ ID NO: 37947 - protein, 1500 aa, Candida dubliniensis
MSTTSNTSLSQQLDEKPWVDVSDDSSVQEYQGFDATASHNIQDLARKLTHDSTKGDHHAANNLARYLSHMSDIPGVSPFNGNINHEQLDPDSENFNAKYWVKNLKKLFDSDSEYYKPSKLGVAYRNLRAFGVANDSDYQPTVTNALWKFTTEAINKLKKPDDSKYSDILKSMDAIMRPGELTVVLGRPGAGCSTLSKTISANTYGFNIGKESHITYDGLTPKDIESNYRGDVIYSAETDYHFPHLSVGDTLEFAARLRTPQNRGEGIDRETYAKHMANVYMATYGLSHTRNTKVGNDFVRGVSGGERKRVSIAEASLSGANIQCWDNATRGLDSATALEFIRALKTSAVILDTTPLIAIYQCSQDAYDLFDNVVVLYEGHQIFFGRASKAKEYFEKMGWKCPQRQTTADFLTSLTNPAEREPLPGYEDKAPRTAQEFEVYWKNSPEYAALVGEIDNHLIECEKSNTKSYYHETHVAKQSNNTRPSSPYTVSFFMQVRYVMARNFLRMKGDPSIPLVSILTQLVMGLILASVFFNLRKSTDTFYFRGGALFFSVLFNAFSSLLEILSLYEARPIVEKHRKYALYRPSADALASIISELPVKLLMTMSFNIVYYFMVNLRRTPGNFFFYWLMCALCTLVMSHLFRSIGAVTTTIATAMSISTVFLLAMIIYAGFVLPIPYILGWSKWIRYINPVTYIFESLMVNEFHGREFKCGQYIPSGPGYESLSVENKVCTTVGSTPGSTVVQGTEYIKLAYQFYSSHKWRNFGITVAFAVFFLGVYVALTEFNKGAMQKGEIVLFLRGSLKKHKRKTAASNKGDIEAGPVSGKLDYQDEAEAVSNEKFTEKGSTGSVDFPENREIFFWKDLTYQVKIKKEDRVILDHVDGWVKPGQITALMGASGAGKTTLLNCLSERVTTGVITDGERLVNGHALDSSFQRSIGYVQQQDVHLETTTVREALQFSAYLRQSKKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPEEANPAEWMLQVVGAAPGSHSKQDYFEVWRNSSEYQAVKDEISRMEVELSKLPRDNDPEALLKYAAPLWKQYLLVSWRTIVQDWRSPGYIYSKIFLVVSSSLFIGFSFFKSKNNLQGLQSQMLAVFMFFIPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISFNELIDNAASLATTLFTLCLMFCGVLAGPDVIPGFWIFMYRCNPFTYLIQAILSTGLANAKVTCAPRELVTLKPPMGETCSSFIGPYTKAAGGYFSTNSDGTCSVCRIDSTNQFLESINAMFSQRWRNFGIFVAFIAINIILTIFFYWLAKVPKGNREKKMKK

SEQ ID NO: 37948 - protein, 391 aa, Ehrlichia canis str. Jake
MSNSPLLPVYSPSSVTFSHGKGVYLYGYDGRKYLDFHAGIATSSLGHAHPVLVNALKTQGEKLWHLSNLHTIPEAIKLAQKLVDISFADKVFFNNSGAESVDCCIKIARSYQCGKGNNQRYRFITMKGSFHGRTYAACSANEPSKFSPLLKPYVEWFDSVNPDITSIKNAINEHTGAILLEPIQGEGGINVLDSSFLKELRAICDQNDILLIFDCVQCGAGRTGKFFAYEHVGVTPDICCIAKGLGGGFPISASLSTNNAAQFMSVGMHGSTFGGNPLATTIGMVVVEEILKDGFLENVTKNGHYLYKKLKDLANKFPIIEQVKGKGLMIGMKFNTNVNARELMYELIDYGLLTSTASGNVIRVIPPLIINQQELDEGVAILEGYLKSKYS

SEQ ID NO: 37949 - protein, 256 aa, Marinobacter sp. ELB17
MQVTIKTPEDIAKMRVAGRLAAEVLEMIDEHVKPGVTTEHLNQLCHDYIVNVQQAIPAPLNYRGFPKSICTSVNHVVCHGIPTEQKVLKDGDIINIDVTVIKDGYHGDTSKMWAVGTPKPGTERLIQITQECMYKGIELVKPGARLGDIGHVIQQHAEKHRFSVVRDYCGHGIGQVFHEEPQVMHYGKPGTGLELKEGMIFTIEPMINQGKYHTKLLPDEWTAVTKDRKLSAQWEHTILVTAGGHEVLTKRKEESF

SEQ ID NO: 37950 - protein, 401 aa, Marinobacter sp. ELB17
MNPDLDRLHPYPFEKLAKLKAGVTGPAHLESISLGIGEPKHPAPEFIKQVVADNLARLGNYPTTKGTDELREAISQWATKRFALAPGSLTAAHHIVPVNGTREGIFSLVQAVVDRSKPATVVSPNPFYQVYEGAAFLAGATPVYLACDGSNSFIPDFDAIDPQVWQQCQVLFLCSPGNPSGSVIPRATLVRVLELADEHDFIVASDECYTELYPDEANPPEGLLQTCAVIGRNDFARCVVFHSLSKRSNLPGLRSGFVAGDARILEGFLKYRTYHGCAMPIHNQLASIAAWGDEEHVKENRRAYRAKFEAVVPILRQVMDVDFPDAGFYLWPQTPAGMNDEVFARELSAQQNVHVLPGRYLSRTVNSYNPGENRIRMALVAPLQECVEAAERIVAFIRANS

SEQ ID NO: 37951 - protein, 570 aa, Azoarcus sp. EbN1
MTSRPPLIDRLLPFLAWRRQWSAASLRGDLIAGVTVALMMIPQSLAYAQLASLPPHVGLYAALLPAIVAALFGSCAQLSTGPVALTSILTGASLLPFADPASPTFLTLAILLALLSGLIQLALGALRAGWLLNLLSRPVMTGFINAAALIIGLSQLPALLGIVMPQSTHFLVDFWTALGALDTAHPLSAAFGAGSLLALLLLKRFAPGAPAVLIVVACATAISAAVGYGSRGGAVVGAIPAGLPVLGVPEFDWNAAVALIPTAFVIALVSFMEATSSAKLISGKSGQDWNQNQELIGQGLAKIAAAISGALPVSASFSRSALNYVSGARSGLSSLIAAACVLVTLLYLTPLLWHLPKPVLAAIILHVITGLIDLRALARAWQAGRDDGLASSLTFIGTLVFAPNIQNGVVAGLLLSLALMLYREMRPRTALLGLHPDGTYRDLARFGLEHPDPAIVILRFDSPLTFVTAAAFEHAVLAAAATHNGVRTVLISAAGINTIDATGLHTLSLLIERLRGTNRNLAFCGLKKQVIDVMQKTGLWLRLGKHADYRTEHQALEALRQDAPEVTPKR

SEQ ID NO: 37952 - protein, 236 aa, Escherichia coli O157:H7 EDL933
MGYRSFDTAAAYKNEEGVGKALKNASVNREELFITTKLWNDDHNRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 37953 - protein, 452 aa, Thermobifida fusca YX
MSANLDEKLSPIYEEILRRNPGEVEFHQAVREVLECLGPVVAKNPDISHAKIIERLCEPERQLIFRVPWMDDSGEIHVNRGFRVEFSSSLGPYKGGLRFHPSVNLSIIKFLGFEQIFKNSLTGLPIGGAKGGSDFDPKGRSDAEIMRFCQSFMTELYRHLGEHTDVPAGDIGVGQREIGYLFGQYKRITNRYESGVFTGKGLSWGGSQVRREATGYGCVLFTAEMLRARGDSLEGKRVSVSGSGNVAIYAIEKAQQLGAHVVTCSDSNGYVVDEKGIDLELLKQVKEVERGRVSDYAKRRGSHVRYIDSSSSSVWEVPCDIALPCATQNELTGRDAITLVRNGVGAVAEGANMPTTPEGIRVFAEAGVAFAPGKAANAGGVATSALEMQQNASRDSWSFEYTEKRLAEIMRHIHDTCYETAERYGRPGDYVAGANIAAFEIVAEAMLAQGLI

SEQ ID NO: 37954 - protein, 159 aa, Oryza sativa
MQDPRGMPRDEFATPKTHKRKVVSRPLPPSQIKAEPELLRREVPLTSGKTKKAPKITFKNEPRHSAPQSDWGTPDSVPEFGPADEYRALRKKYLLLEDENGELDKQLSQAEEEASVLEDENVALMDKVVCGRLVGSTQMRHRKGWKSMRVVPVIVNSTV

SEQ ID NO: 37955 - protein, 253 aa, Triticum aestivum
  misc_feature (33)..(33): Xaa can be any naturally occurring amino acid
SWWKAFTRTPQSGLRTIWNPTGLQDPDTPDVNXVTIRENSEGEFRGLLCLNMRGVVESLKIITRQASLRVAEYAFHYAKANGRERVSAIHKANIMRKTDGLFLKCCREVAEKYPEITYEEVIIDNCCMTLVKNPGTFDVLVMPNLYGDIISDLCAGLIGGLGLTPSCNIGEGGICLAEAVHGSAPDISGKNLANPTALMLSAVMMLRHLRFNDQADRIHNAILRTIADGKYRTADLGGKSSTSDYTKAVCGHI

SEQ ID NO: 37956 - protein, 422 aa, Photobacterium profundum SS9
MSFQALGLNTQLVDTVTELGFKTPTPIQEQAIPQVLAGDDIMAGAQTGTGKTAAFGLPMIQRLLASQQSEHDEGYIKKPEAIRALVLTPTRELAQQVHDSILAYSKNTSIKVAVAYGGTSMGVQVKALKSGVDILIATPGRLLDHAFTGTVDLSKIECLVLDEADRMLDMGFVVDIKRIMQRMPRKRQTLLFSATFSNQVKKLAYDILADPKLIEVTPENITAESVTQMVYPVDKHRKRELLSYLIGSRNWNQVLIFTKTKQGSDELAKELILDGIKAVSINGDKSQGARQRALSDFKEGKVRAMVATDVAARGLDIEQLGYVVNFDLPFQAEDYVHRIGRTGRAGLTGSAISLMSIDEEWALRAIEELLDTRLPQEWLEGYEPDPTIKAQDNRRSSSTSEKRRIKAKSKIHKNRGRNQTKR

SEQ ID NO: 37957 - protein, 291 aa, Pisum sativum
MSVTSTTPLFKSLTIAALFHNKTKPTSFSLPSKPFKFHISLNSSPSLTLSLKTNRATPLFAAQEGETLTTEEGVVETEGLIDWEPEAAENETGGEDYAGGDFAEPSEDAKLFVGNLPYDVDSEKLAMLFEPAGTVEIAEVIYNRETDQSRGFGFVTMSTVEEAEAGAAKFNRYDYNGRPLTVNKAAPRGSRPEREERPPRTFEPVLRVYVGNLSWELDDSRLEQVFSEHGKVVSARVVYDRETGRSRGFGFVTMSDEKEMNDAIAALDGQILEGRTIKVSVAEDRPRRGSF

SEQ ID NO: 37958 - protein, 463 aa, Listeria monocytogenes str. 4b F2365
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPFYPVLPIVSFLLCAFLISRLSVHTWILCGIWFVIGLIVYFAYGRKHSELLKK

SEQ ID NO: 37959 - protein, 473 aa, Prochlorococcus marinus str. MIT 9301
MSKSPQDVLSQIKDEGIELIDLKFTDIHGKWQHLTLTSDMIEEDSFTEGLAFDGSSIRGWKAINASDMSMVPDASTAWIDPFYKHKTLSMICSIQEPRSGEPYDRCPRALAQKALKYLDSTGIADTAFFGPEPEFFLFDDVRYDSKEGGCFYSVDTIEAPWNTGRIEEGGNLGYKIQYKEGYFPVAPNDTAQDIRSEMLLLMGELGIPTEKHHHEVAGAGQHELGMKFDSLINAADNVMTYKYVVRNVAKKYGKTATFMPKPVFNDNGTGMHAHQSLWKSGQPLFFGEGSYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPADELAKIDTVPSSLNDSLNALKADKDYLLAGGVFTEDFIDNFIDIKYEEVQQLRQRPHPHEFFMYYDA

SEQ ID NO: 37960 - protein, 394 aa, Prochlorococcus marinus str. MIT 9301
MTEAKIISALNEENFSHFSKTYVPSRLLLGPGPSNAHPEVLSALSLNPIGHLDEAYISLMSDVQQLLRYTWQCNNRLTLPMSGTGSAAMEASIANFIEEGEKILIAKKGYFGDRLVDMATRYKADVSVMEKPWGESFSYEEIKYEIETKKPAIFAIVHAETSSGVLQPLNGIGEVCRKNNCLFLVDAVTSLGALELLIDEWKIDLAYSCSQKGLSCPPGLSPFTMNKRAEDKLSSRKTKVPNWYLDLSLLNKYWGSDRVYHHTAPVNMNFAIREGLRLIANGGLDNVWYRHNTNAKKLWKGLESLGMELHVSEDYRLPTLTTVKIPPAVDGDGFRNHLLRKFGIEIGNGLGELSGKVWRIGLMGFNSSEENVDRLLNLFDTELKKYSIFESSTF

SEQ ID NO: 37961 - protein, 415 aa, Candida albicans SC5314
MVEKRIAIVGGGPSGIITLRSLLDEGFTSVTLFERKNKLGGCWNLTPPEQINFEQLSKKQWDVDPIPETIPTTVPHTTVQRFMDTATYPYLETNVEDIAMEFDKPFPKDTISKHGKDSPFRHFTEINQYLHDLADLKYVTFDTSVELIEKKNEQWRLVLRKFGQTQDYIYEEFFDNVVVASGHFDVPFVPEIPGLQQFSELDDTLVIHSKQFRSRDDFKDKQVVVVGASVSAMDSIRDILPVAKRAITSQKPTTEPHVYFGTEAFDHDGIEKRGQIVKIEDHTIHFHDGTSTFADAIILGTGFLYHYPFLPKFPELKELIFDANDPSLAFVGHNTPGLTFKLFQWQAILVARVFAGKGNVPTTIRNDPTIHPDFNQYYETLREASCGALPKWNPVWEEAFYRGHLRRRQYWLDNP

SEQ ID NO: 37962 - protein, 391 aa, Photobacterium profundum SS9
MTEQHYSLDDIRKNVSHIDNEILKLLSERRLLSLEVAKSKIGTAKPVRDQAREQELLLRLIKTGKTQQLDALYVTQIFHTIIEDSVLFQQAYLQKLANPDSLQPVARVSFLGAKGSYSHLASRNYFSRKQTKLVEMSCSTFRDVLNIVETGNADYGVLPIENTSSGSINEVYDLLQHTSLSIVGEITQPIEHCLLTVGDVDVKGINTLYSHPQPHQQCSEYLHSMGDITQEYCSSTAEAMQKVAELNLPNVAAIGNASSGKLYGLTPVKGNIANQQENFTRFIVVARKPVDVTSLIPAKSTLIMSTAQKAGSLVECLMVLRNLNINMTKLESRPVIGNPWEEMFYLDVEENLKSDVMQQALEELTRLTRFIKVLGCYPSENIKPTEVEIEE

SEQ ID NO: 37963 - protein, 346 aa, Zea mays
  misc_feature (221)..(221): Xaa can be any naturally occurring amino acid
TSLYKKAGWYRSGIPGTRLLLNATCGNATELIIALFALMEGQIEVVKCSLLGSVLSNLLLVLGTSLFCGGVVNLGSDQPYDRTQADVSTGLLILGVLCQSLPLMLRYAVGAGEHSVAAATTVLDLSRACSVVMLLAYVAYLFFQLKTHAQLFEPQEVDDGCEAEEDEQAVIGFASGLFWLAFNTVLIAILSEYVVGTIEPTSKSWGLSVSFISIILLPIVXGNAAEHAGAIIFALKNKLDITLGVALGSATQISMFVVPLSVIVAWIAGIQMDLDFKLIETGSLFVSVIVTAFTLQDGSSHYLKGILLLLCYIVIGACFFVTRQPASNNNGAGLSLPTGTLSAQAA

SEQ ID NO: 37964 - protein, 339 aa, Triticum aestivum
  misc_feature (41)..(41): Xaa can be any naturally occurring amino acid
  misc_feature (74)..(74): Xaa can be any naturally occurring amino acid
  misc_feature (99)..(99): Xaa can be any naturally occurring amino acid
  misc_feature (120)..(120): Xaa can be any naturally occurring amino acid
  misc_feature (154)..(154): Xaa can be any naturally occurring amino acid
MAPLGDAVAPAAAAAAPGLVVSFGEMLIDFVPDVAGVSLPXGGCLTPPAEPRVVRVPGGRTPKLVGHFKGGGTXALIEKLARKKLATILWSPRKNGLNXQGCPFKQKRGPGLALVTLSAXGGEFMFSPTRGQMFLTEARVKLGRIPGTHFHYGXISLITEPAVGARRRHGAAKSAGILSSYDPNVRLPLCPRAQAARDGIMSIWKEADFIKVSDDEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELIPKGSN

SEQ ID NO: 37965 - protein, 504 aa, Ralstonia metallidurans CH34
MNHCADVSGAGVAKFPRRILSSLILASLIGPLAGTAWSQTPGEAPTTATSASPRQGPPPTQPTATVGQAQAGTTEFRLSNGLRVIVKEDHRAPTVAHMIFYRVGGFDEVSGTTGVAHMLEHMMFKGTPKVPVGEFSRQIALLGGRENALTNRDFTLYYQQISKQYLPKMMELEADRMANLIFKKEEFEREMKVVMEERRLRTDDSPRGTVYEQLLATVYTAMPYRHPVIGWMDDLVNMRVEDVHDWYKTWYVPNNAMVIVTGDVKPDEVRALAERYYGKLKPHPLPLRKTQIEAPQKGIKRIWVKAPAENPYMVMAYKVPRLRDVEKDVDPYALEVLSAVLNGYDNARLTRELVRERRLADDVNVGYDSINRADSLFVLDGTPANGHTTEEIEAALREEIQRIAKNGVSEEELKRVKAQVVAGQIYKRDSVFGQGMEIGVSEISEISWRQIDRMLDKIKEVTPAQVQAVAAKYFSDDNLTVATLLPQPIDPNKPKTPVPEGLRH

SEQ ID NO: 37966 - protein, 199 aa, Haloarcula marismortui ATCC 43049
MTGGMPGPAPDERMRPKGRRNTQGIRVDPEAEVTHEPRQAVLSALVKHRPGVLSEVSALFSRRQFNIESLTVGPTVDDDTARMTILIEEPEPGIDQAKKQLQKLVPVISVRELEGEAVRRELALVKVSGEKPDDVNAVADMYNGQAVDASTDSVTVEITGSKQKIDAAIEAFKQFDVQEIVRTGAAALERGPKTLEKDV

SEQ ID NO: 37967 - protein, 267 aa, Shewanella sp. ANA-3
MHTDINALFAALWQDYIQMTPSAAKVHELLGHGKPIINDHIALRTFNIAKVNLAVLAEHFTSLGYVACGDYKFEQKKLVAKHFEHPDATQPKVFISELLVEEFSPSLQSTIQGLIAQVDEEATKADNFIYSGRHWSLDAKTYETLLEESEYAAWVAAFGYRANHFTVSINHLEGFETLESVNDALKQAGFVLNSAGGEIKGSPEVLLEQSSTMADKIAVAFSDATVEIPSCFYEFALRYPKANGELYTGFVAASADKIFESTNAKKG

SEQ ID NO: 37968 - protein, 152 aa, Brassica napus
  misc_feature (143)..(143): Xaa can be any naturally occurring amino acid
IPSTSQDMDRHEVSSFLASQVANSPPGNWPIGSPLKGSPTHAFPRPPGLGIIRPFNRDNMPGLASVLPGQTSSFHGFSPVSNDQGLLNHPNQTILNNALMHNVSYGQPHSLPEHIGGGISNSMRFVAPPQSSGFGTSSDNSYXRWGSPPQDM

SEQ ID NO: 37969 - protein, 93 aa, uncultured Geobacter sp.
DNNVDIQEFMIIPAGAGTCTDAIRIGAEVFHSLKSVLKKKGYNTAVGDEGGFAPNLRSNEEACQVILEAIQKAGYKAGKDVFLGLDVASSEFY

SEQ ID NO: 37970 - protein, 734 aa, Ashbya gossypii ATCC 10895
MVGRRKMGAEARRSGDSGGSGGSGEPQTATSGEKRELGGVGLLDWGADTILRRFAAEPEYIKVLARKKGARCFRRLFVAQELQPPVDSPLHANHSSQSLGQAAPAGDKARSVWLLRFSKDGKYLASGGKGRQLCVWKVIASPMERWNLLPVYGGDKHHSNTLSLLNQQLLKYSGKRTEAVPAPGPERKEIPFDLEQQYAPVFHPDPHRVFGEHLQDILDCDWSKNSFLLTASMDKTVKLWHINRTTSLKTFVHPDFVTCVRFHPHDDRFFFSGCLDHTVRTWSILEGEVAEAFNCGDLIMALDVSPDGNWLLIGTFNGYVHVLHTNGLKLLHSFHLLQKPNETENRPRHGPKITGVEFIRHKAYPWLGLLITSNDSRVRLFDMSTTRLLEIFRGFSNESSRISAHHLEMEDGESVVLSASENHWLYTWMLHHEEYMYSHSDLDNARTVPSPIDGKDPKKHSIRNIFRRSISFNSDILSESNPVARHHFPLFHHKAQHKGGCVKNSEYITFHAHHNPVTAATIAPKETTHVLSLSDDIICELNMKFGGEALEHLRTKSIREPGSPAGRSDHKRNHSAEKNYSQSTAKQNVGTIIVSAAATGQIRVFRTDVSSSVRAKALEAIRAAHGLPGSPERPLKPVLSALAHPLSAGVAKGKHICGDNRSAPSTTCPRCAPSAVNGQQDESASTAEQSTSSPKPTCDVCGGQKLSVVGKKTALQKTKSLYCLECGNHINRFK

SEQ ID NO: 37971 - protein, 509 aa, Bradyrhizobium sp. BTAi1
MTHFIDSRLRDAALPFWPDVASVGSHVGGDLVIGRGATISVNDPATGQLLFSYADAGADVAAKAAAAAVAGQAEWARLTAAGRGRMMQAIARAILAAAEPLAQLEALSAGKPIRDTRGEVAKVAEMFEYYAGWADKFHGEVIPVPSSHLNYTRREPMGVVLQITPWNAPIFTAGWQIAPAISMGNAVILKPSELTPLTSLALALIAERAGLPKGVVNVLAGFGHSTGQAALAQPAVKKVVFVGSVPTGRLIGEAAARRLLPSVLELGGKSANIVFADADLERAAIGAQAAIFGGAGQSCVAGSRLLVQSAVYDRFVDLVAQGAAKIKCGDPLSAETEIGPINNAKQYDHVLSLIREGADEGAEIVAGSNGESTPGGYYVRPTVLKNVTNTMGIARKEVFGPVVAAIRFETEEEAIAIANDSEFGLAGAVWTTDVARAHRVAAQVKAGTFWINSYKTINVASPFGGYNHSGHGRSSGVEALYEYTQVKSVWVETAAEPAVAFGYAPGLRE

SEQ ID NO: 37972 - protein, 309 aa, Ashbya gossypii ATCC 10895
MSPSTDTPVSKLGSFAAAGAAACVAVTFTNPIETVKTRLQLQGELVAGVSRLYSGPAQAVSLIYRTEGLRGLQQGLACAYAYQILLNGSRLGLYDPLRAALGGCVLSDRRTYGTAALAVNATAGAAAGMIGAALGSPLQLVKTRMQALAPRRVPPLPGRMGRRLVALFKDRGVRGLYQGVDAALLRTGVGSAVQLAVYSHAKEALSRHVPDGMALYTLASALSSVAVCIAMNPFDVAMTRMYHHRGGLYRGPLDCLCKTVRQEGFSALYKGHLAQLLRIAPHTILCLTLMEQALRVVRLVENRLPQIRP

SEQ ID NO: 37973 - protein, 93 aa, uncultured Geobacter sp.
DNNVDIQEFMIMPAGAKCFKEALRMGAEIFHALKGVLKGKGYNTAVGDEGGFAPNLKSNEEALEVIMEAIVKAGYKPGEDVLLALDVASSELF

SEQ ID NO: 37974 - protein, 93 aa, uncultured Geobacter sp.
DNNVDIQEFMIIPAGAKNCAEAIRMGAEVFHNLKAVLKKKSYNTAVGDEGGFAPNLRSNEEACQVILEAITKAGYKPGKDVFLGLDVASSEFF

SEQ ID NO: 37975 - protein, 491 aa, Azoarcus sp. EbN1
MSFADLGLIPELLRAVAESGYTTPTPIQQQAIPVVLSGRDVMGGAQTGTGKTAGFTLPLLQRLARHASTSTSPARHPVRALILAPTRELAMQVFESVKTYSKYVPLRSTCIYGGVDMKPQIQDLRNGIEIVVATPGRLLDHVQQKTIQLGQVEMLVLDEADRMLDMGFIPDIRRILDLLPAARQSLLFSATFSDEIKKLADQMLKEPQLIEVARRNMVSETITHRVHPVSAGLKRNLLAHLLRHEPDTQALVFVATKLACSRLAHFLERHGIAADAIHGDKGQAQRTDTLEAFKSGKLRVLVATDVAARGLDIDDLPSVINFELPHTAEDYVHRIGRTGRAGRQGNAVSLVSAEERHHLAEIEKLIKLQIPQEIVPGFDPEPDFFETGSRSRHGRRTAAASAPEPAKETGQKTTPASRPARPASAARSGEARRRPGRSTIAADGFDYTKPYEPAASPADPNRLADQAAGKIGSSRRTQRPIAVLLGGLGRK

SEQ ID NO: 37976 - protein, 298 aa, Enterococcus faecalis V583
MKVKKAVIPAAGLGTRFLPATKAMAKEMLPIVDKPTIQFIVEEALASGIEDILIVTGKAKRPIEDHFDSNVELENNLKEKNKTDLLKLVEETTDVNLHFIRQSHPKGLGHAVLQAKAFVGNEPFVVMLGDDLMEDKVPLTKQLMDDYEQTHASTIAVMKVPHEDTSKYGIINPEKEIEKGLYNVENFVEKPKPEEAPSDLAIIGRYLLTPEIFDVLENQKPGAGNEIQLTDAIDTLNKTQRVFAREFKGERYDVGDKFGFMKTSIEYGLTHPEVKDNLREYIINLGAQLAKKEQPKEK

SEQ ID NO: 37977 - protein, 787 aa, Photobacterium profundum SS9
MQQNVVWYDALSMNDVDKVGGKNASLGEMVANLANAGVKVPNGYATTSHAFNQFLEAGGLNKRIYQLLEELDVDDVNALKVAGETIRNWVLDAELPADLEQDIRVCYAELGNGDDMLSVAVRSSATAEDLPDASFAGQQETFLNVRGIDAVIEATKHVFASLFNDRAISYRVHQGFDHEGVALSAGIQRMVRSDKASSGVMFTLDTESGFDQVVFITSSWGLGEMVVQGAVNPDEFYVHKPTLEAGNHAVVRRTIGSKQIKMVYAEGKELGTQVDVIDTTEEERQQFSLTDDEITSLAKQALIIEKHYGRPMDIEWAKDGITGELLIVQARPETVRSRDNQQVMERFHLNAQASAIIEGRAIGQRIGVGAVRVVADLSEMDQVQPGDVLVADMTDPDWEPVMKKASAIVTNRGGRTCHAAIIARELGIPAVVGCGNATSILSSGQHVTVSCAQGETGFVYEGELDFEIRRSSVTDLPDLPLKVMMNVGNPDRAFDFACIPNEGVGLARLEFIINKMIGIHPKALLNYDEQSDELKAEIDKRIVGYDNPVEFYIEKLTEGISTLAAAFWPKRVIVRMSDFKSNEYRNLVGGINYEPTEENPMLGFRGASRYISPQFQDCFALECEAMKRVREKMGLKNVEIMIPFVRTVSEAASVIDLLAKFDLRRGENGLKVIMMCELPSNAILADDFLKYFDGFSIGSNDMTQLTLGLDRDSGEIAHMFDERNPAVKAMLSMAIKAANKAGKYVGICGQGPSDHDDLADWLMEQGIDSVSLNPDTVLETWVHLGKK

SEQ ID NO: 37978 - protein, 509 aa, Mycobacterium avium 104
MLVVDFGAQYAQLIARRVREARVFSEVIPHTATIEEIKARQPRALVLSGGPSSVYEPGAPQLDPAVFDLGVPVFGICYGFQAMAQALGGTVAHTGTSEYGRTELKVLGGELHSGLPGVQPVWMSHGDAVTAAPDGFEVVASSPGAVVAAFENRARRLAGVQYHPEVMHTPHGQQVLSRFLHDFAGLGADWTAANIAGVLVEQVRAQIGDGHAICGLSGGVDSAVAAALVQRAIGDRLTCVFVDHGLLRAGERAQVQRDFVAATGANLVTVDAADTFLQALAGVTNPEGKRKIIGRQFIRAFEGAVRDVLGDKPVEFLVQGTLYPDVVESGRGSGTANIKSHHNVGGLPGDLKFTLVEPLRLLFKDEVRAVGRELGLPEEIVARQPFPGPGLGIRIVGEVTATRLDTLRRADSIAREELTAAGLDSLIWQCPVVLLGEVRSVGVQGDNRTYGHPIVLRPVTSEDAMTADWTRVPYEVLERISTRITNEVPEVNRVVLDITSKPPGTIEWE

SEQ ID NO: 37979 - protein, 340 aa, Enterococcus faecalis V583
MKQKVAVLGPGSWGTALAQVLAENGHEVCIWGNKPEQIDEINTKHTNKHYLPELILPTSIQATTDLATALVDVDAVLFVVPTKAIRSVAQEVAQHLKTKPIIIHASKGLEQGTHKRISEVIAEEIPAEKRQGIVVLSGPSHAEEVAVHDITTITAASENLADAVYVQELFMNDYFRIYTNDDVIGVETGAALKNIIALGAGAIHGLGFGDNAKAAIMTRGLAEISRLGVAMGANPLTFIGLSGVGDLIVTCTSVHSRNWRAGNLLGKGHKLDEVLENMGMIVEGVSTTKAAYELAQQLEVEMPITETIYNVLYNDEDVQQAAKEIMLRDGKTENEFTLDF

SEQ ID NO: 37980 - protein, 341 aa, Mycobacterium avium 104
MRTVVVDGPRSIRVDTRPDPVLPGPDGAIVEVSAAGICGSDLHFYEADFPMPDPIALGHEAIGTVVEAGPQVRNVKVGDQVMVSSVAGCGSCAGCATRDPVLCHSGFQIFGGGVLGGAQADLLAVPAADFQLLKIPEGISTEQALLLTDNLATGWAAAQRADIPFGGTVAVIGLGAVGLCALRSALFQGAATVFAVDQVDGRLARAARWGATPLKAPALEAILAATGGRGADAVIDAVATDASLTEALNAVRPGGTVSVVGVHDMNPFPLNALGCLIRSITLRMTTAPVQRTWPELIPLLQSGRLDVDGIFTTTMPLDEAAIGYATAGSRSGDDVKILLKP

SEQ ID NO: 37981 - protein, 61 aa, Zea mays
MVRVATYFAMTFGAFLFWQSMDRVHVWIALHQDEKKERMERELEIKRMQAELLAQAKENES

SEQ ID NO: 37982 - protein, 464 aa, Oryza sativa Japonica Group
MAAARSVGMEAEVAALRGRFAAGGTRGAEWRAAQLRGILRMAAEAEAEIALVKSSCKFALKNLKKWMKPQKVTAPLMTFPSTARVAAEPLGVVLVISAWNYPFLLSIDPIIGAIAAGNAVVLKPSEVAPATSSLLAELLPRYVDGSCIKVVEGGVAETTTLLEQKWDKIFYTGNGKVGRIVMASAAKHLTPVVLELGGKCPVVVDSNVNLHVTAKRIAAGKWGCNNGQACISPDFIITTKSFAPKLLEALEKVLEKFYGRDPLRSSDLSRIVNSNHFNRLKKLMDDENVSDKIVFGGQRDEHQLKIAPTIFMDVPLDSGIMKEEIFGPLLPIITVDKIHESFALINSMTKALAAYLFTKDSKLQEQYEAAISAGGMLVNDTAVHLTNQYLPFGGVGESGMGAYHGRFSFEAFSHKKAVLVRRFAGEAAARYPPYSPAKLKILRGVLKGNLGAMIKAILGFPRGK

SEQ ID NO: 37983 - protein, 561 aa, Thermoplasma volcanium GSS1
MDSRVSDRKLRRELTTWDLLMLSLGGIIGSGWLFAAFGAATTAGPGSIFAWIIGGVIIIFIALVYAELGAMIPRSGAIVRYGHLSHGSFAGFVLGWAYFLSAVSVPAIEAEGVITYAASYSSKYGIVLLTNTGVMSVLGTFLAMLLMLGFFFLNYAGIKIMGKTNTGLTWWKFVIPTLTVILLLVVSFRPSNIIVGGIVPYGWAPVFSAVATSGIVFSYLGFRQGIDYGGEAKTPQRSIPLATVFSVLIGILLYTALQIVFIGGIDWGKLGLVPGSWAQIYSLATSNSNPEAVALYDAPFAHIAQAAGLVFLTYILFADAYISPSGTLNVYLGTSTRTLYGMAANGHMPKKLLEIMDKNRIPFIPLLATLLIGYIFFLPFPSWYKMVGFITSATAFTYIVGGAALMSLRRTAPELKRPFKLPYARVLSPIAFIGAGEVVYWSGWPLVLYLAIAIFLGFAVYFVLLLLGAIENSFTKENIKAGLWVPIFIIVLTVLSYIGDTSLGGIGVIKFPFDLVTVAVISFIFYMWSVRSGIRTEDITEMIESGSQYVFEESAREAVGK

SEQ ID NO: 37984 - protein, 596 aa, Prochlorococcus marinus str. MIT 9301
MSNIDLKRRTKIVATIGPATQSEEIITNLIKAGVTTFRLNFSHGDHKDHADRIKTIREVSKKLDIDIGILQDLQGPKIRLGRFKDGPVKVKKGDKFTLTSNEVECTNTIANVTYEKLSQEVSEGKRILLDDGKIEMIVEKVDTKANNLECMVTVGGVLSNNKGVNFPDVQLSVKALTEKDKKDLKFGLSEGVDWIALSFVRNPSDINEIKDLINKNGHSTPVVAKIEKFEAIDQIDTVLPLCDGVMVARGDLGVEMPAEEVPLLQKELIRKANSLGIPIITATQMLDSMASNPRPTRAEVSDVANAILDGTDAVMLSNETAVGDYPVEAVETMATIARRIERDYPLKAIESHLPSTIPNAISAAVSNIARQLEAGAIIPLTKSGSTARNVSKFRPPTPILATTTERSVARRLQLVWGVTPIVVKNDERTAKTFSLAMQIAQEMGILNQGDLVVQTAGTLTGISGSTDLIKVGLVRRIVSRGISIGEIGVTGKARIIKNNLDISLICPGEILFVPKELMKNIPLSKNIAGIVTNQNVNDVYAFFNKNNKKISTICNLENMDSHQISNGDLITLQLNEGVIYMGQIEDDDAIDKYKYV

SEQ ID NO: 37985 - protein, 370 aa, Vibrio sp. Ex25
MHQPFLVLCKNNYSQIKHLYVLMHSINSITRTKGRAMAFNLRNRNFLKLLDFSTKEIQFLLELSAELKKAKYAGTEQKTLQGKNIALIFEKSSTRTRCAFEVAAFDQGAQVSYIGPSGSQIGHKESMKDTARVLGRMYDGIEYRGFGQSIVEELGTYAGVPVWNGLTDEFHPTQILADFLTMQEHGRGKQLHEMTFAYLGDARNNMGNSLMVGAAKMGMDIRLVAPKAFWPEEDLVATCQTIAQQTGAKITLTESVEEGVKGCDFLYTDVWVSMGESAEAWDERVALMTPYQINMDVIKQTGNPHVKFMHCLPAFHNDETTVGKEVAEKYGMKGLEVTEEVFESEYSIVFDEAENRMHTIKAVMVATLGS

SEQ ID NO: 37986 - protein, 265 aa, Shewanella oneidensis MR-1
MSIVIKTAEEIEKMRAAGKLAAQVLEMIAPYVKVGVSTNELNDICAKYTEEQGAISAPLNYHGFPKSICTSLNNVICHGIPSDRVLKDGDILNIDITVIKDGYHGDTSKMFLIGEVSPKDKRLCRIAQESLYLAIRKVRPGLKLGEIGNTIEKFIKASKTGLEKYSIVQDYCGHGIGAGFHEEPQVMHYRNGDNTILRPGMCFTIEPMINAGRHTTVLDRNDNWTVTTSDGKNSAQWEHTLLVTQTGVEVLTLRDEEDFPRVINY

SEQ ID NO: 37987 - protein, 176 aa, Bartonella quintana str. Toulouse
MNVKEIPVGKNPPEDINVIVEVSLGAQPIKYEMDKKSGALFVDRFLHTSMVYPGNYGFVPHTLSDDGDPIDVLICNTRPLIPGCVINVCPIGVLIMEDDGGKDEKIIAIPTPKLTQRYINIYDYTDLPEITLKQIEHFFKHYKDLEPGKWAKIEGWRDKSFAHQLIKQAIERNREI

SEQ ID NO: 37988 - protein, 513 aa, Prochlorococcus marinus str. MIT 9301
MDDYFEKILQAEVYEVAKKTPLEKAHNLSNTLNNEVFLKREDLQDVFSFKIRGAYNKMSKLTNSQLAQGVITSSAGNHAQGVALSALKLNCQATILMPITTPLVKVNAVKNLKAKVILYGDNYDETYREAIRISQERNLCFIHPFDDPEVIAGQGTIAIELEQQLNEKPYAIYIAVGGGGLISGISLYVKKIWPEVKIIGVEPEDADAMTKSLEEEKIVELSSVGQFADGVAVKKIGKNTFDIGRKYIDKMIRVNTDEICAAIKDVFEDTRSILEPAGALSIAGMKKDIFNSNHSNRKMVAIACGANMNFERLRFVAERAELGECKEVMLAVEIPERAGSLIDFCKLLDSRNLTEFSYRMSNSKNAQIFVGVQVYGLNDKKNLLNVFRNSEYSFIDISDDELSKNHLRHMVGGRLPRDFKEMEYRNFIELLYRFEFPERPGALINFLNNMKSNWSISVFHYRNYGADVGKIVIGVLIDKNEILEWNNFVKILGYKFWDETQNDTYRLFLGASD

SEQ ID NO: 37989 - protein, 283 aa, Arabidopsis thaliana
MMISRRPVSSPGRVEKYPPPFMGFLRSKSNGGSTSRSRSRSRGRSRASPLFVRRNKSAAAVAQEPSSPKVTCMGQVRVNRSKPKIKPESRDNPTRRRCEWLRNASFYNKFAGKIKTMTFWPKWRLCSFSCACRNLKEKDSPRSQLDHPTTESVREIKEEIEGEENFEIPKLFVSPATTPPINALLLTRSRSAPYRSSSLAFRFWEENNQREVESQQNVRSEKTDSEVPIEKINGFHEPEYVDRDEEEFTKLRFVRQPVLTRSKSEPARIGEKMMVLLPDEEEG

SEQ ID NO: 37990 - protein, 429 aa, Sulfolobus solfataricus P2
MNVEKELREKGVEILRFTWVGLDGYIRSKGAYIDHVDELLKTGIGLTMAMMSFTPMDYISPYGTFGPQDEDVFLTPDLNTLSVFPPSAIVICNLYKHGNPWNYDPRSILIKTIEKAKEQYDFDFKSAFEIEFYLTKDKKPLDDARCFDPSAFYNNQIIPEIAKTLRQINIEPIRIIKEYGPGQYEFDIMHKDALRSADEVVIFKEVARQVASKHGVEANFMPKPFNKLAGSGLHLNISLWKDNQNLFYSHNDKYGLSDLAYNFIAGLLEHAKALTAIASPTINSYKRLVPGSWAPTKITYGYNNKSAMIRIPTPYPGMSQLDRRIEYRVPDPSTNPYLLLTAVIEAGLDGIERGLKPPEAVNENAYYRKDIDDIPRNLREALNELRKDTKLVERIGKEIIGEFIKVKLAEVEEYESLVTDWEYEVYRRL

SEQ ID NO: 37991 - protein, 317 aa, Ralstonia metallidurans CH34
MSVEGLMVFTGNANPKLAEAVVQHLGIPLGKALVGRFSDGEVQVEIQENVRGKHVIVLQSTCAPTNDNLMELMVMVDALKRASARSITAAMPYFGYARQDRRPRSARVAISAKIVANMLEVAGVERVLTMDLHADQIQGFFDIPVDNIYASPVLLGDLREKNYGNLLVVSPDVGGVVRARALAKQLDCDLAIIDKRRPKANVSEVMNIIGEVAGRNCVIMDDMIDTGGTLCKAAQVLKERGAQKVFAYCTHPVLSGGAVARIAASALDEVVVCDTIPLSDEARQTGKIRQVTTAPLLAETFTRIVRGDSIMSLFADA

SEQ ID NO: 37992 - protein, 112 aa, Triticum aestivum
MPTAKGMSARVLRTLTGTRHAGAARGLATEKAVGAAAVGGSHTAKWMQDTSKKSPMELINEVPPIKVEGRIAACEGDKNPALGHPIEYICLDLDAPAVCKYCGLRYVQDHHH

SEQ ID NO: 37993 - protein, 311 aa, Physcomitrella patens subsp. patens
MLPGLWHWPPRWEEASQPTISDLALVPFFALLFPTLRFVLDKFVFERMGRKSIAGLSPEALLKLSDVEREENEKKLIKYKESAWKCVYYSTAELLALAVTYNEPWFTQTKMFYLGPGDQVWPYLNAKLKLKMLYAFSSGFYTYSIFALCFWETRRKDFGVSMTHHVGALGLLIVSYIVNLQRAGSVILAVHDASDVFLEVGKLTKYSGLDYVPEIAFGLFAVSWILLRLLYFPVVLVRSTTYEVLVVLDKDKYPNGPYLYYILNTLLICLLVLHVYWWILIWRMIKKQIQNSGKVSDDVRSGACLLPVKLY

SEQ ID NO: 37994 - protein, 327 aa, Haloarcula marismortui ATCC 43049
MTHEIAVIPGDGIGQEVTPAAVEVLEAIDGVDFDFVEGEAGDAVKEETGDALPEETRELAADADATLFGAAGETAADVILPLRQVVGSFANVRPARSYPGLDAVQPDTDIVFIRENTEGVYKGIESEISEGVTTCTRVITEDASEKIAEYGFSYAKQNSYDDVTIAHKANVMRTTDGLFLDAASAVGEDRDASYDTALMDALAMHLVMNPQDYGVVICPNLAGDMLSDLAAGLVGGLGLLPSANIGEENALFEPVHGSAPDIAGEGIANPSAMILSAAMLLDHLGYDEQGDAVRTAVESVLDSGPRTPDLGGDASTEDVTAAVIDEL

SEQ ID NO: 37995 - protein, 205 aa, Microcystis aeruginosa PCC 7806
MLQAQEIMTQNVVTIRGSATVADAVKLMKEKKLRGLIVEPRHEQDPYGIVTETDIVYKVAAFGHDPKTMRVYEIMAKPCVVVNPELGVEYVARLFAQTRIRRAPVIQGKTLLGIISVSDILFKSDFVEKPKRLFIEDEIEAAREDARAICAAKGETSPDCAAAWDVVEELQAEASHQRAKKQGSNSFQAYCEANPDALECRIYDD

SEQ ID NO: 37996 - protein, 250 aa, Synechococcus sp. WH 8102
MLSSASLDGQTALVTGGGRGIGKAIALALAEAGAEVVVNYANSAGAADEVVASINAAGGKAYALKANVSIEEEVDGLIKAVLERSGRLDVLVNNAGITRDGLLMRMKTSDWQAVIDLNLSGVFLCSRAVARPMLKQKSGRIINITSVVGLMGNAGQANYAAAKAGVIGLTKSTAKELASRGITVNAVAPGFIATDMTKDLDADAILKDIPLGQFGTQEQVAGAVRFLAADPAAAYITGQVLQVDGGMVMA

SEQ ID NO: 37997 - protein, 186 aa, Oryza sativa Japonica Group
MHMLDSSTSSSPWLPPDLMPPPPPPPPAAATLHHHFRAAAAAPGRRRIAKRRPRPSRRLPTTYISADPANFRRMVHQVTGADDLPPPPPSLSLQQTTELLLPAVHAAPAGSPGAAGALMLPTLDTSAFLLGRRAEPAAAAPPCDESVALVRGGAGNYGSNNNSISSSSSSGNCGGGFPTLDSWDLL

SEQ ID NO: 37998 - protein, 220 aa, Ashbya gossypii ATCC 10895
MYAPHFFGSFKHLLTPLPKAILSVSDPDEISAKRIRKALQELFAVDLDGDKKDIKALILERFDLLRDRQSKVLSQEELVQRDSEMAAALVRGDAGRAKRPRKRDADKPRKKRANQSDNPNSFHMRPVQLSEPLQRLLGEEQLPRTQVVKAVWDYIKQHQLQNPDDRREILCDAAMEPVFGKKMTMFSMNKILSQHLTNPKDVSGSDQDANTEEHSDQLSA

SEQ ID NO: 37999 - protein, 205 aa, Ashbya gossypii ATCC 10895
MSSSSAEKSELPVTVEKPIPVTYDLGNLAVFDSNALDRNDLDSSNANREEHLRALTRDNVQLLINQILSLPIKSTTDSTGSGQSSSIALVRLPEPTTDLPREKPLPKPKAPTKWELFAAKKNIKPKEKSGKMVYDEAAGEWVPKWGYKGANKKLDDQWLVEVDDKVKGTEEELIDPRTLSRAERKKLIKKNELQHKRNLKNAVSK

SEQ ID NO: 38000 - protein, 177 aa, Xerophyta viscosa
MMADSSSWGRALVQISPYTFAAIGIAISIGVSVLGAAWGIFITGSSLIGAAIKAPRITSKNLISVIFCEAVAIYGVIVAIILQTKLESVPAAQIYTAESLRAGYAIFASGIIVGFANLVCGLCVGIIGSSCALSDAQNSSLFVKILVIEIFGSALGLFGVIVGIIMSSQATWPARGA

SEQ ID NO: 38001 - protein, 701 aa, Ashbya gossypii ATCC 10895
MATVGASAEQLLQDINCEGYLGAFRKYEISSVDQLQHLDHEILEQVGIRSIGDRIRILNKSRTLQAGRDKGLLEELQQVIGKINALSAGPMAISEELVTDRHSVIFILNDGSAKKVNVNGCFNADSIKKKLIKRLPPEFVAVAQNGEETSSQDYDVFVVDYAKNVLHLLYDVELVTICHSSDRVEKNRLIFVSKDQTPSDKAILTSKKLYLKTMSAIHQLGSLPTMLQTQGATTVGNYATPGAEAPAGDEDSLRIDNSKESLRRIFNQRPPSELISTNLPEYFPHTDFKRLQKTLRSSFRQSVRMSMLRPGAPLPEGNNVGNILVNQNQAVDRALLQSLDGTKTSSRSSGRSSVDGDASSMGSERRTNASKSTTLDGRDSDAGGRIELLNSESESECDDDNIVSLPTKVVTPKSWLKGARIGSGSFGSVYLGMNAHTGELMAVKQVELEPTTVMASSDDKKSHPSSNAVVKKLTDPPQDGGRASSTKMNLLKELHHENIVTYYGSSQEGGNLNIFLEYVPGGSVSSMLNSYGPFEEPLVKNFTRQTLVGLTYLHRKNIIHRDIKGANLLIDIKGSVKITDFGISKKLSPLNKKQNKRASLQGSVYWMAPEVVKQVVTTEKADIWSVGCVVVEMFTGKHPFPDFSQMQAIFKIGTNTIPELPSWASDGAKAFLYQTFELDYKKRPSSVELLQHKWLDTTTML

SEQ ID NO: 38002 - protein, 301 aa, Moritella abyssi
MENLLSVKDLSKQQILDLLALAKAVKANPAEYSQALAGKSIVTIYEKPSLRTRVTFDIGIHKLGGHAVYLDAQNGAIGERETVKDFAANISRWADAIVARVVSHKTLEGLVEHGSVPVVNSLCDLYHPCQALADFLTISEHYEDVSKVKLAYVGEGNNVTHSLMLTGAILGAEVTAVCPRGSSPDAQIVKQAMALAEISGGKINVTDNLDDIVDYDVIYGDTWVSMGDDTPLAQVKEKYMPYQINKALLMRTGIKHVLHCQPAHRELEITSEVMDGEHSLIFDQAENRMHAQNAVLLTLLK

SEQ ID NO: 38003 - protein, 251 aa, Symbiobacterium thermophilum IAM 14863
MAPGYQPPSPEEKEQYVRELFDKIAENYDAMNQVMSAGQWEKWHREFVAQTHFRPGDHILDVACGTGDLTLLDAAQVAPDGKVIGVDISEGMLEVGRRRVAASPYKDLITLQLGNAMDLPFPDNTFDGVTMGWAMRNVASIPRTLSEIYRVLKPGGRFICLEASKPFSRFIRFGFFVYWKTFLPLIDWFVVKAGRQAKVRPYTYLSRSLDNYPFPDQLEELFREAGFVETDYQLLMLGTVAIHVGTKRREG

SEQ ID NO: 38004 - protein, 301 aa, Moritella profunda
MENLLSVKDLSKQQILDLLALAKAVKANPAEYSQALAGKSIVTIYEKQSLRTRVTFDIGIHKLGGHAVYLDAQNGAIGERETVKDFAANISRWADAIVARVMSHKTLEGLVEHGSVPVVNSLCDLYHPCQALADFLTISEHYEDVSKVKLAYIGEGNNVTHSLMLTGAILGAEVTAVCPRGSSPDAQIVKQAMALAEISGGKINVTDNLDDIVDYDVIYGDTWVSMGDDTPLAQVKEKYMPYQINKELLIRTGIKHVLHCQPAHRELEITSEVMDGEHSLIFDQAENRMHAQNAVLLTLLK

SEQ ID NO: 38005 - protein, 784 aa, Prevotella intermedia
MNKIISKEQFSEKVFCIVVEAPLIARSCRAGNFIIVRVDKNSERVPYTIAKADPEKGTLTMVIQEVGLSSTKLCQLEPGDEVLDIVGPLGQASHIENYGTVVCAGGGIGIAAILPILTAFKKAGNRVISVLAGRTKELVIMVDDVAKYSDEVIIMTDDGSMGKKGVITVGVEEVLQREKVDKVLAIGPPIMMKFTSLLAKKYGIPNDVSLNTIMVDGTGMCGACRLTIGGKTKFVCIDGPEFNGDLVDWDEMFKRMGTFKGVEREEMERKQDQIGHHHIEVETAESTVKTELTPAEETKQAFSELVDRNAEWRTELRKSMKPKERTAIERVQMPELDPVYRATTRLEEVNKGLTKEMAMREAQRCLDCAKPTCVEGCPVNINIPSFIKNIERGQFLNAARVLKDTSALPAVCGRVCPQEKQCESRCIHLKMNEPAVAIGYLERFAADYERESGNITLPELAPSNGIKVAVIGSGPAGLSFAGDMVKRGFEVYVFEALHEIGGVLKYGIPEFRLPNKIVEVEVESLRKQGVHFQTDTIVGKTISVEELKQNDFKGIFVGSGAGLPNFMGIPGENSINILSSNEYLTRVNLMDAANPETDTPIIIGKKVVVVGGGNTAMDSCRTAKRLGAEVTLVYRRSLEEMPARVEEVKHAQEEDINFLTLHNPKEYLADENGRVCGAVLDVMELGEPDESGRRRPQTTGKTITIECDQVVVAVGVSPNPLVPNSIEGLELGRKNTIAVNDGMQSSIPEIYAGGDIVRGGATVILAMGDGRKAALNMANALLEK

SEQ ID NO: 38006 - protein, 232 aa, Neisseria elongata
DQGAGVTYLEPSGSQIGHKESIKDTARVLGRMFDGIEYRGYGQEVVEELARYAGVPVFNGLTDEFHPTQILADLLTMREHSGKPLQQTAYTYVGDARYNMGNSLLLIGALLGMDTRIGAPKALWPSENIIAQAHSLAEKSGARLLLTEDPQEAVRGTDFIHTDVWVSMGEPKEVWHERIDLLRGYRVTADLMAAAGNPQVKFMHCLPAFHNRETKVGEWIYKTFGLDGVEVT

SEQ ID NO: 38007 - protein, 832 aa, Thermobifida fusca YX
MKAVVMAGGEGTRLRPMTANQPKPLLPVVNRPIMEHVLRLLKRHGFEDTVVTVQFLATLIRNYFGDGEELGMSLRYVAEEVPLGTAGSVKNAEEHLRGEPFIVISGDALTDIDLTDMVRFHRENGALVTIGLKRVANPLEFGIIIVDDNGRIQRFLEKPTWGQVFSDTVNTGIYIMEPEVLDHVAPGENVDWSGDVFPKLLKAGAPLYGYIADGYWEDVGTHESYLRAQADVLSGKVDVEIDGFEVSPGIWVAEGAEVDPEAVLKGPLYIGDYAKVEPGAELREFTVLGSNVVVRSEAFLHRAVVHDNVYVGTRANLRGCVVGKNTDIMAGVRIEEGTVVGEECVLESEAYLANNIKVYPFKTIEAGAVVNTNVIWESKGQRSLFGPRGVSGLINVEITPELAVRLASAYATTLKKGAVVTTARDASRAARTLKRAVISALTAAAINVQDLEATPLPLARFHTSQPGLSGGIALRTTPGDPQSVDIVFLDSSGADLSPAAQRKLERVFSRQEYRRAFPGEIAELSFPSRSVEAYTRELLQSIDLSGVAEANLKVVVDCAGGTGSLILPALLSQIDADVLTVNNRLDEASPTDTPAKRTRDLQRLGELVASARADFGVRFDPVGERIQLVDGSGTLVDDERALLVVLDLVAAERQGGRVALPVTTTRVAEQVANRHGVDVQWTPTSLDALTKAALADDIIFAADGRGGFILPEFSRTCDGIAAFVRLIGLVARTKMSLSQIDQRIPQAHLLRRSVPTPWAVKGSVMREVVEAAQGREIDTTDGVRVIEPDGSWALVLPDTAEAVTHLWAEGPDDETAQRLLEEWSAVVERAEG

SEQ ID NO: 38008 - protein, 308 aa, Deinococcus radiodurans
MLAGRDFLSNLDMTSAELRAVMDTAHSMKAGEWRAVKPLSGLSLALVFEKASLRTRTTFDVGMYQLGGHAITLSNTEIGLGTRERVSDVARNLERWVDGVMGRVYLQQTLVELAQHARIPVINGLSDMLHPAQLLADYQTIEEEFGQDLRGKRVVYIGDGNNLANSHIHMGILTGTDVTVVTPVGYEPNAGVLMDAVKAGVEVHLTNDLDAIQGADVLYTDVWISMGQEAEADIRRRAFRGYQVTPEMLETISPDGIFLHCLPAHYGEETVPEATEHPKSRVFDQAENRLHAQKALLYHVLGDMKPRW

SEQ ID NO: 38009 - protein, 311 aa, Geobacillus stearothermophilus
MNAVMSLKGRDFLTLLDFSTEEILDLLALAADLKAKQKAGVSYTPLSGKTMAMIFEKPSGTRVSFEVGMIQLGGQAMYLNGNHLQLGRGETIADTARVLSQYVRVIMIRTFAHQKVEELAEYASFRSSNGLTDDDHPCQALADLLTIYEVKKTFQGVKLAYVGDGNNVANALLVAAAKVGMDVAIACPPGYEPKKEYVEAACRVGEQTGRRVTVTHDPLVAVAGADRIYTDVWTSMGQESESSERLQVFQPYQVNEELVKAAKPDYLFLHCLPAHRGEEVTAGVMDGPNSVVFEQAGNRLHAQKAILLSVL

SEQ ID NO: 38010 - protein, 170 aa, Propionibacterium acnes KPA171202
MASTATLRTNHGDIVVNLFADQAPKTVDNFVGLAGGTKEYVDPHTGQPTTGKFYDGLTFHRVIDGFMIQGGCPLGTGTGGPGYRFADEFHPELTFSKPYLLAMANAGPGTNGSQFFITVAPTPHLNRRHTIFGEVADEESRRVVDEIAQVRTGRMDRPVEPVVIESVELA

SEQ ID NO: 38011 - protein, 819 aa, Serratia marcescens
MRVLKFGGTSVANAERFLRVADIMESNARQGQVATVLSAPAKITNHLVAMIDKTVAGQDILPNMSDAERIFADLLSGLAQALPGFEYDRLKGVVDQEFAQLKQVLHGVSLLGQCPDSVNAAIICRGEKLSIAIMEGVFRAKGYPVTVINPVEKLLAQGHYLESTVDIAESTLRIAAAAIPADHIVLMAGFTAGNDKGELVVLGRNGSDYSAAVLAACLRADCCEIWTDVDGVYTCDPRTVPDARLLKSMSYQEAMELSYFGAKVLHPRTITPIAQFQIPCLIKNTSNPQAPGTLIGKDSTDADMPVKGITNLNNMAMINVSGPGMKGMVGMAARVFAVMSRAGISVVLITQSSSEYSISFCVPQGELQRARRALEEEFYLELKDGVLDPLDVMERLAIISVVGDGMRTLRGISARFFSALARANINIVAIAQGSSERSISVVVSNDSATTGVRVSHQMLFNTDQVIEVFVIGVGGVGGALIEQIYRQQPWLKQKHIDLRVCGIANSRVMLTNVHGIALDSWRDALAGAQEPFNLGRLIRLVKEYHLLNPVIVDCTSSQAVADQYVDFLADGFHVVTPNKKANTSSMNYYQQLRAAAAGSHRKFLYDTNVGAGLPVIENLQNLLNAGDELVRFSGILSGSLSFIFGKLDEGLSLSAATLQARANGYTEPDPRDDLSGMDVARKLLILAREAGYKLELSDIEVEPVLPPSFDASGDVDTFLARLPELDKEFARNVANAAEQGKVLRYVGLIDEGRCKVRIEAVDGNDPLYKVKNGENALAFYSRYYQPLPLVLRGYGAGNDVTAAGVFADLLRTLSWKLGV

SEQ ID NO: 38012 - protein, 629 aa, Prochlorococcus marinus str. MIT 9301
MLLSELSHPNQLHGLTVSQLEEIACQIRERHLQVVSTSGGHLGPGLGVVELTLALYQTLDLDFDKVVWDVGHQGYPHKLITGRFSQFDSLRQQNGVAGYLKRSESKFDHFGAGHASTSISAALGMAIARDRKGDNYKCVAVIGDGALTGGMALEAINHAGHLPNTPLVVVLNDNDMSISPPVGALSSYLNKVRVSPPLQFLSDSVQESVKNIPLIGKDIPEELKNIKGSVRRLSVPKVGAVFEELGFTYMGPIDGHDIGNLVKTFNAAHKLKRPVLVHVVTTKGKGYPYAEADQVGYHAQSAFDLTTGKSIPSKKPKPVSYSKIFGQTLLKICEQDSKVVGITAAMATGTGLDILQKNIPDQYIDVGIAEQHAVTLAAGMSCDGLKPVVAIYSTFLQRAFDQLIHDVGIQNLPVSFVLDRAGIVGADGPTHQGQYDISYMRSIPNFVLMAPKDESELQRMLITSINHNGPTALRIPRGSGLGVAIMDEGWEPLNIGEAEIIEGGEDILIIAYGSMVASAIETAKILKNMNINACIVNARFVKPLDKNLIMPLASRIQKVVTMEEGTLIGGFGSAIVELFNDNEINIPVYRIGIPDVLVDHASPDQSKEKLGLMPDQMADNIVKKFKLVN

SEQ ID NO: 38013 - protein, 296 aa, Bartonella quintana str. Toulouse
MRKIRKAVFPVAGLGTRFLPATKTIPKEMLTVVDKPVIQYVVDEAREAGIEHFIFVTGRNKVVLEDYFDVQVELYTILAERGKREELEHLHGLQPPPGTTSFTRQQQPLGLGHALWCARELVEGEPFALLLPDMLMQAKKGCLSEMINLYEKIGGGNIIAVQECDPAQAHKYGIVGKGKQIANGFEITKMVEKPTKGTAPSNLYINGRYILQPEIFNILSNQERGAENEIQLTDAMMRLSNEQDFFGFQLEGRTFDCGSKAGFIEANVAFSLARADMHSQISASLKDLLETIKVGK

SEQ ID NO: 38014 - protein, 152 aa, Oryza sativa Japonica Group
MAISRSSSRRRRWVGSARGRCYAMSGIKTTTTDFLSSRDKTEKVIGNKWDLYLDLLQADYTEGGSGRQRGEERYWGLMAATEMVCYGGGGRRLADGDADLSVHMWDALDALGLVRYCCRRMLMTHVDLIEKLLNYNNDGSDITSGQSTSGCV

SEQ ID NO: 38015 - protein, 570 aa, Microcystis aeruginosa PCC 7806
MLSWILMEITNRIHFDNLRGDIFGGLTAAIVSLPLALAFGVASGAGAIAGLYGAVCVGFFAALFGGTPTLISEPTGPMTVVMTAIVASLTAKNPELGLPMAFTVVMLAGIFQILFGIFKMGKYITLMPYSVISGFMSGIGVILIILQIPPFLGQAAPKGGVLGTVQKIPELLSNINPPEAILGAITLAIIFLMPSKFKRFVPPQLLALVIGTLISLFFFQGAEIRRIGDIPVGLPTLQMPTFSAAQMITMLVDGAVLGMLGCIDTLLTAVIADSLTRTEHKSNKELIGQGIGNLVSGICGGLPGAGATMGTVVNIQTGATTALSGITRALILLVVVLWAAGLTKSIPMAVLAGIALKVGIDILDWSFLKRSHKISLKGTLIMYGVLLLTVFVDLIVAVGVGVFIANILTIDRLSELQAQEVKTITDNDDEILLSPEEKRLLNQANGRIILFYLSGPMIFGVSKAIAREHTAMKEADVLILDLSDVPLLGVTASLAIENAIKDAIDKSLQVFIVGATSKIQHRLERLGILAQLPPDHVLMDRTIALQQAVTFVKTHPHQEPEDFEVNQLNN

SEQ ID NO: 38016 - protein, 471 aa, Microcystis aeruginosa PCC 7806
MILSHILPPSIGEIAAPMTPIPLLATVVAEDSPIILSGVLLTLVVIYLASKLGAEAARRLDFPPVLGELVAGVIVGVSALHLVIFPEGGLSASDSLIMTVLQGLNQLAPAAVDRIFESQSEVISVLAEIGVIILLFEIGLESDLRQLKEVGIQATVVACVGVAAPFAAGTAGLMLVFHVAAIPAIFAGAALTATSIGITSKVLSELGQLKSKEGQIIVGAAVIDDVLGIIVLAVVASLAKTGEIDVVNVIYLIVSATAFLIGSILLGGIFNKSFVAIVERLKTRGNIVIPAFVFAFFMAFLGNAIHLEAILGAFAAGLVLDETDTRNELDELIKPIADLLVPIFFVTVGARADLGVLNPTVPENRAGLLIAVFLMVVAIIGKLVTGWAVFGISGINRLAIGVGMIPRGEVGLVFAGIGSASGILDKPLEVSIIIMVILTTFLAPPFLRIAFGKTEAVAETLASKERANPIP

SEQ ID NO: 38017 - protein, 188 aa, Streptococcus pyogenes str. Manfredo
MILLIDNYDSFTYNLAQYLSKFDETIVLYNQDPNLYDMAKKANALVLSPGPGRPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 38018 - protein, 235 aa, Nostoc sp. PCC 7120
MTQNRSEKPIVISPSILSADFSRLGDEIRAVDAAGADWIHVDVMDGRFVPNITIGPLVVEAIRPVTKKPLDVHLMIVEPEKYVEDFAKAGADIISVHCEHNASPHLHRTLGQIKELGKQAGVVLNPGTPLELIEYVLELCDLILIMSVNPGFGGQSFIPGVVPKIRQLRQMCDERGLDPWIEVDGGLKANNTWQVLEAGANAIVAGSAVFNAKDYAEAITNIRNSKRPTPELAKV

SEQ ID NO: 38019 - protein, 137 aa, Triticum aestivum
  misc_feature (114)..(114): Xaa can be any naturally occurring amino acid
  misc_feature (129)..(129): Xaa can be any naturally occurring amino acid
MLLRPALPVAVSSTLPLISHLAAVRRRCSIAATGMAGVSAASPAAAQIGSFLSKKPYAPPSWASHLALAPSHTFSLGHFPTPIHKWNLPNLPEGTEVWIKRDDLSGMQLSGNKXRKLEFLLSDAVAQGXDCVSLSWY

SEQ ID NO: 38020 - protein, 725 aa, Frankia sp. EAN1pec
MSSAAVTLDYPDEVVTWAHVRYVSLPGVRGPAALITLDNGHDHTRPSTFGPAGLRALLAAVAEIEAHDPPVAAIAVTGKPFIFCVGADLSYRSSLTDPAEISPKLTALGELGHDVLRRVGEGRLAGRRVPTFALVNGAALGGGLELALHCDYRAISAGATAIALPEVFLGLVPAWGGTQLLPNLIGAENAVTLVVENALIQNRTLRGEQAFSLGLGDVLLEPADFLEESLCWVGQVLRGEVDPAAGRRPVKRGAAWAAAVERGRVLADARLHGAAPAAYRALDLIALAETADRDTGYAAETAALADLGASEELAAGLYAFNLVNKRAKRPVGGPDRSLARPVTKVGVVGAGLMASQLGLLFAQRLEVPVVITDLDQDRLDAGVGRVHQEIDTLLRRGRLSPDRANRLKANVTGSLTRDAFADADLVIEAVFEDMKVKKAVFAELEAVVKPETLLLTNTSALSVTEMAADLTHPERVAGLHFFNPVAVLPLVEVVRSRHSDDATVATALDIAKKLKKNAVLVADAPAFVVNRLLTRFMGEVLAGTESGTPVEQADAALDPLGLPMSPLVLLSLVGPPVALHVAETLHGAMPERFRSPAGLSRLVAGGKSSFYTTGPNGEQIVDREAAALVRGDGTGPAGGDRAGTAGIALTAEQVREAALAALTQEIRVLLDEGVVTEAADVDLCMILGAGWPFHLGGITPYLDRTGVSERVTGRRFSPPGAATIS

SEQ ID NO: 38021 - protein, 518 aa, Bartonella quintana str. Toulouse
MSISHPDTVLIIDFGSQVTQLIARRVRAMGVYCEIVPFQLALEGVKRLRPQAVILSGSPYSVIDDGSPRAPMEIFEIGVPVLGICYGEQVMCVQLGGKVESGHRREFGRAFLEVQEKSALFDGVWEKGSCYQVWMSHGDHVAALPEGFRVIGTSKGAPYAAIADEKRCLYAVQFHPEVVHTPDGTKLLQNFVHKISGLKGNWSMASYRDQAIATIRKKVGKSRVICGLSGGVDSSVVAVLLHEAIGDQLTCILVDHGLMRKNEAEEVLKLFRDHYNIELIHVNAANIFLNALEGETDPEKKRKTIGRLFIEVFEEETKKIEGVEFLAQGTLYPDVIESVSAIGESVTIKSHHNVGGLPERMNMKLVEPLRELFKDEVRSLGRELGLPEQFLGRHPFPGPGLAIRCPGAVTREKLEIIREADAIYLDEICKAGLYDEIWQAFVVLLPVQTVGVMGDGRTYEFVCALRAVTSVDGMTADFYPYDMEFLSKTAARIINEVRGINRVVYDITSKPPGTIEWE

SEQ ID NO: 38022 - protein, 303 aa, Glycine max
MEEEKAAAYYDELARKGEGAARFKQGLGFSSSAPNDDVPKPSSSFLSKFVKASSESEKQAQLQSIHDKLKKNPSSESRVSSSDRSRSREKRRKRSRSGDRYRETRRRSRSRERHRDSERGRRRSRSVSPRKQRRSEKDANYRGKVSETKKGKNAEIDYSKLIQGYDRMSSAERVKAKMKLQLSETVAQDSEKGVGWERFEFNKDAPLDDEEVEVAEDDASLVKHIGQSFRFSAVEARREEQIQAAHEEAMFGATALLPPTSTDSEPERENEKEADKKELVASLLSETVLAKQKGSWRDRVRQA

SEQ ID NO: 38023 - protein, 149 aa, Microcystis aeruginosa PCC 7806
MERTFLMIKPDGVQRNLVGEIIQRFEAKGFTLVGLKMMQVSSELAEKHYAVHKERPFFPSLVDFITSSPVVAMVWQGEGVIASARKIIGATNPLNAEPGTIRGDFGISVGRNLIHGSDGPDTAKDEVSLWFSDAELADWTPAITPWVVE

SEQ ID NO: 38024 - protein, 561 aa, Ashbya gossypii ATCC 10895
MSQGTIFSQLKIRKKRQEVAFFESNADANDVEAGEHFITELDKGDKRLGLFSSIGLICNRMLGTGIFVVPAKIFQLTGSVYFALGLWVLGALIALAGLYVYMEFGTAIPRNGGEKNYLEFIFKKPKFFITSMYSAYVIFLGWAAGNSVMAAAMFLDAGKVEATRWRERGLGVAVIFFCFLVNSLSVKAGLYFQNILGVFKIGTIIFIAITGLVALGGHIDGAPGTENFRHSPSDLSPSAYTIVNALYQVIWSFVGYSNVNYALGEVKNPVRTLKIAGPSSLAVLGTLYLLVNVAFFAVVPMEILKDAGMNLTPKFFDIAFGDKARRASAIFIGLSALGNVCSVIFSQGRIVQQLGREGVLPFTSFFASSKPFNSPMAGLFQHMIICAITILAPPPGDAYDFVLNLISYPMNIINFILACGLIWIYWQRRQSKLEWNPPIRAGYFVTSFFLIANLYLIVAPYVPPPSGSSVYKSLPYYIHCVVTWAIFAVGSIYWLIWSRLLPKWNNYELVHSEVLGEDGFWRNKIVKKYAGEDSVSTPDGGSDSTLKEGFSGIGVKQSIVQ

SEQ ID NO: 38025 - protein, 559 aa, Physcomitrella patens subsp. patens
MAPGLPRPCGFLRRIQVFRCSANNYVFAGVFANGQALPTAQPNEIIENGNKAREELESPDGYYRWNKPQASPFLSITVLGATGELARNKIFPALFALYYSGNLYKNIAIFGYSRSELTDEEFRDMLSESATCRVDEGEKCGEAMETFLQSVYFETGGYSTCDGMTKLDSRLKEIEGMGEANRIFYLSVPNEIVPDVSRCLSRDAQSKSGWTRLIVEKPFGSDSESSAKLADSLLQYLDESQIYRIDHHLGKELIENLTVLRFSNLVFEPLWTRTYIKSVQVMLAEDWGMEGRGGYFDQHGIIRDIVQSHLMQTIALFAMEPPVSLDGEDIRNEKVKVLRSMRTPSLEDFCLGQYKASISKDGKSRIFGYLEEPGVYPNSLTPTFVAGVLYIDNARWDGVPFLIKAGYGLIKHKVEIRIQFHHVPGNLYREHIGLNMDMASNELIISVQPDEAIFLKINNKVPGLGTQLDSSELNLLYRERYDCESIPDSYERLILDVIKGDNHLFIRSDELQASWDLLMPLLKDIEEQKVAPEMYTFGGRGPVGSYYLGAKHGVRWADE

SEQ ID NO: 38026 - protein, 471 aa, Triticum aestivum
  misc_feature (62)..(62): Xaa can be any naturally occurring amino acid
QVCTKKQAGTGPEFPGYRRPKQPERDLQETNTGRQAGGRDRSWEPAERAMAAKGATEMEVGXDGVAVITICNPPVNSLSIDVLLSLKESYEEALQRKDVKAIVVTGKGGKFSGGFDISSFGDLHSGKIEQPKVGYISIDILTELLEGATKPSVAAIDGLCLGGGLEVSMACHARISTPTAQLGLPELQLGIIPGFGGTQRLPRLVGLTKSLEMMLLSKPIKGEEAHQLGLVDSLVSPNDLVNTARRWALDICELRKPWIKSLYKTDKLEPLGEAREILKFARAQARKQAANLEHPLICIDVIEEGIVSGPRAGLWKEANAFQGLLFSDTCKSLLHVFFSQRATSKVPGATDLGLMPRKITKVAILGGGLMGSGIATAMILSNYPVLLKEVNEKFLNAGIDRIKANLQSRVRKGKMTEERYEKALSLLSGALGYEKFKEVDCWYWEFEGETTNIFRWKNTSIGFFNTFFFKP

SEQ ID NO: 38027 - protein, 251 aa, Propionibacterium acnes KPA171202
MWYEFFKYALFGPGVRALWHPRVVGEENIPTEGGVILACNHIAALDPIIVASMIDRKLTYPAKKELFAVDRGFWSKVVAWFLRAVEQVPLDRSGGRTSVNAMGPVERRLAEGGLVGIFPEGTRSSDGRLYKGKTGVARMTLGSGAPVVPVGISGTTVRRKVLGIPLLDHPTLIFGKPMHFDVLADRTEETAVLRWVTDEVMGAISDLTGQSYVDVYGFRVKHGNLKGKDVSKFVKPRPGGKPLPPPRVAKA

SEQ ID NO: 38028 - protein, 630 aa, Cryptococcus neoformans var. neoformans B-3501A
MVDTQYAFRAQKTAGVADAPAWEVSNRIPAETVGSKCYAYSPNGEWLAYAMNNCVEIIPSHSSSPTPVTLQQANIVALKFSPMSSYLFTFERPVKTESGEMYKNAKAWDVKNGEIVGGWYQKTMEDWEPIITPNETHLLRAGPSDLAIFSPPFAPRPSTRLKIEGIRGIFISDPSALPATSTNSRPIPAYHEPAVAIWIGEKKGAPASLGLWSLSSLMGKNALQANGNGDIQTETRDMPPTTARKAFYKADKLTVKWNNAGTMALFLAQSDVDNSGKSYYGETNLYLVGLDGTFDGLVELDKEGPIYDFAWSPISREFTVCYGYMPARTQMFDLKAKPVYSFGENPRNTLVYQPQGKLLLSAGFGNLAGGIDIWDVSTRNKVAEFKASNASHCEWSPCGRYVLTATLSPRLRVDNGVKIWWCNGQLLHIQPVEELYQASFAPQRVTEIGSFPAIVPKAPEANPSVAAYRPKGETDGVAAKPAGAYRPPGARNRPEGENASASFGSSRGKPGVRTVPGAGGRQPPGSTPGASTGAGGDDKKKRQRKRGGKDKEEEKKDEAPTQEAVKPEVKEEAGEDAVAKKIRNLMKKLKAIDELKTKLAAGEILEKTQLKKIESEAQVKSEIKALGGNV

SEQ ID NO: 38029 - protein, 337 aa, Lactobacillus sakei
MTNSVFQGRSLLAEKDFTKSELEYLIDFSLHLKDLKKKGIPHHYLEGKNIALLFEKNSTRTRAAFTTAAIDLGAHPEFLGKNDIQLGKKESVEDTAKVLGSMFDGIEFRALAKVVEDLAKYSGVPVWNGLTDEWHPTQMIADFMTVKENFGKLKGVTLTYVGDGRNNMANSLLVTGSMLGVNIHIVAPDSLQPTQEVRDLAEGYAKETGSKNMITSDVDAGVKGSDVLYTDVWVSMGEEDKFEERVNLLKPYQINMDMVKKTGNENMIIMHCLPAFHDIETEYGKKIDEQFGIQEMEITDEAFRSKYARQFEEAENRMHSIKAIMAATLGNLFIPQA

SEQ ID NO: 38030 - protein, 478 aa, Taxus brevifolia
  misc_feature (468)..(468): Xaa can be any naturally occurring amino acid
VEKKAGRIAQIIGPVLDVSFPPGNMPKIYNSLIVKDNNTNGQPICVTCEVQQLLGNNKVRAVAMSATDGLMRGMIVIDTGAPLSVPVGETTLGRIFNVLGEPVDDLGPVNALTTSPIHRSAPAFTQLDTKFSIFETGIKVVDLLAPYRRGGKIGLFGGAGVGKTVLIMELINNIAKAHGGVSVFGGVGERTREGNDLYKEMKESGVINEQNISESKVALVYGQMNEPPGARMRVGLTALTMAEYFRDVNKQDVLLFIDNIFRFVQAGSEVSALLGRMPSAVGYQPTLSTEMGSLQERITSTKDGSITSIQAVYVPADDLTDPAPATTFAHLDATTVLSRGLSAKGIYPAVDPLDSTSTMLQPSIVGEEHYETAQGVKQTLQRYKELQDIIAILGLDELSEEDRLTVARARKIERFLSQPFFVAEVFTGSPGKYVSLVETIRGFQMILSGELDGLPEQSFYLVGNIDEXTAKAMNFKEI

SEQ ID NO: 38031 - protein, 533 aa, Mycobacterium avium 104
MDKVMAAPAKAARVSFADEHRRLVGELNAKLAAAALGGNERARERHVSRGKLLPRERVDRLLDPGSPFLELSPLAADGMYDDESPGAGIITGIGRVSERECVIVANDATVKGGTYYPMTVKKHLRAQEVALQNRLPCIYLVDSGGAFLPRQDEVFPDREHFGRIFYNQATMSAKGIPQVAAVLGSCTAGGAYVPAMSDEAVIVREQGTIFLGGPPLVKAATGEVVSAEELGGGDLHSRISGVTDHLADDDEHALRIVRSIAATFGPREPSPWQVRTPLPPKAAQNELYDVVPPDPRVPYDVHEVIVRLVDGGEFSEFKANYGKTLVTGFAHIHGHPVGIVANNGVLFSESALKGAHFIELCDKRKVPLLFLQNIAGFMVGRDYEAGGIAKHGAKMVTAVACARVPKLTVVIGGSYGAGNYSMCGRAYSPRFLWMWPNARISVMGGEQAASVLATVRGEQLTAAGKPWSAEEEEAFKAPIRAQYEDQGNPYYSTARLWDDGIIDPADTRTFVGLALSVCAQAPLEPVGYGVFRM

SEQ ID NO: 38032 - protein, 327 aa, Oryza sativa Japonica Group
MSAAPIPREWVGLQQFPAATQTKLHELLGKLKEENVSTLTILVMGKGGVGKSSTVNSIVGERVATVSAFQSEGLRPMMCSRTRAGFTLNIIDTPGLIEGGYINEQAVEIIKRFLLGKTIDVLLYVDRLDAYRMDTLDDQVIRAVTNSFGKAIWRRTLVVLTHAQLSPPDGLDYNDFFTKRSESLLRYIRAGAGVSKRELGDFPLPIALVENSGRCKTNENGEKVLPDGTPWIPNLMKEITTVVSNGSKSIHVDQKLIDGPNPNNRWKMFIPLILMVEYFLVVKGIRRAIHADISNGKLDDWEQRYRDLVGSKDPVDQKGSSSGNRKA

SEQ ID NO: 38033 - protein, 269 aa, Triticum aestivum
  misc_feature (204)..(204): Xaa can be any naturally occurring amino acid
MHPTRWELSHMVDLQAAALVISSGRPGRWAREHIIGLRPMMYSRTRAGFTLNIIDTPGLIEGGYINEQAVEIIKRFLVEKTIDVLLYVDRLDTYRMDTLDEQVIRAITNSLGKAIWRTTLVVLTHAQLSPPDGIDYNDFLARRSESLLRYIRSSAGIPKREYADCPLPIALAKNSGRCQTNDNGAKTLPDGTPCIPNLMKELTXVVSNGTRSFILIRINRTSNPTIAGAAHHLSSFHARLLLRYKNRKGIPLPFQNGTFILDSSFNIFF

SEQ ID NO: 38034 - protein, 295 aa, Bacillus subtilis
MRKKVRKAVIPAAGLGTRFLPATKAHKEMLPVVDKPAIQYIVEEAVESGIEDILIITGRKQRCIEDHFDRSAELEFNLREKGKTETLKEMQQIADLANIHYIRQKEPLGLGHAVLCAEHFIGDEPFAVLLGDDIMVSEKPALRQLMDVYAAYGTEVARRTACSPEDVSKYANIQTSGSQGHVYEVNDLVEKPSPEEAPSEIAVMGRYVLNPSIFPILKSIGRGAGNEIQLTDAFVRLRTQPIHARLLEGKRYDIADKLGCFKASTEIGLMRPEMRSQLLAYLEEVLKRETKEVLR

SEQ ID NO: 38035 - protein, 447 aa, Ulva pertusa
MFGALSKAVGSVCSRQGQAAVTGLGSVTGHQVRRAGHAENTNTFIREALAVLDLPPAMEKIVITPQREMTVELIINRDDGKPESFMGYRVQHDNARGPFKGGLRFHKDADLDDVRSLASLMSFKTALLDVPFGGAKGGITVDTKALSEHEIEKLTRKFVQEIKDIIGPFRDIPAPDVGTDGRVMAWIFDEYSKFEGYSPGVVTGKPTWLHGSHGRESATGRGTVFGIKNMLQAFGEGPPADKTFAIQGFGNVGAWAGRLLAEQGGIVKAVSDASGCVYDDGPSGIDVPKLLRHLHRGDDLSKYPHGQQLLRDEIFDVKCDVFVPAALGGVITDPVARKISCKYIVEAANGPTTPSADLILRDRGIPVLPDIYTNAGGVTVSFLEWVQNLQNFKWTTEQVNDQLKTRMDEAFQSMWDSSQEHGVPLRTGAFTVSLRRVVRATVNRGFN

SEQ ID NO: 38036 - protein, 202 aa, Triticum aestivum
  misc_feature (60)..(60): Xaa can be any naturally occurring amino acid
  misc_feature (137)..(137): Xaa can be any naturally occurring amino acid
  misc_feature (171)..(171): Xaa can be any naturally occurring amino acid
RLTTRLLGDAKAALYHALEGVDRGIFGITSAKRSEIHALVELLESRNPTPDPTHKLQDKXVDGCWRLIYSTISILGKRRTKLGLRDFISLGDFFQIIDVKEEKAVSVIKFSARALKIFSGQLAIEASYTITTKTRVXIKLESSTITPDQLMNIFQKNYDMLLAIFNPEGWXLEITYVDESLRIGRDDKANILVLEKTESSQV

SEQ ID NO: 38037 - protein, 518 aa, Thermoplasma volcanium GSS1
MSATINFLMLKRELGIIDLTMSSVTGMIGSGWLFSALYASSIAGPYSIISWIVGSLIVAVLALIYADLSGRMPTAGAAAAYPFLTNGDAAGSINAWSLFLGYASTPPLEVIASITYMNFVMPGLINSSGMLTLRGMLIAISLLFVFFIINAMGIRHTSKVNNYISYLKIGIPIITSFFFISTMFSISNFSYVSSVHPEGIFTAIPDAGIAFSFLGFRQAVELSGEAKNPQRTVPIAIMLSVAIASGIYLLVQVAFIGSLKWFSLTPGDWSGLYNSAYSSGPMLVLASALGLGALASVLLFDGVVSPLGTSNVYQTSTSRVVYRISRMGFLTKKIGTLNSNSVPFYALLLDFFVMSLFILPFPSWYDLVSVNSDLTIIAYMTGPISLVIMNQLGIAPKGFKLPLAKILAPLGFVFSILIIYWSGYPTTLYMSIIALAGLVLFIFARRSPLKSLVGASYMIFILIFVPVASFLGSYGIGLFPFPYDIAIVAVASLGAFAIGTRLYVPSADMSDRIKETVN

SEQ ID NO: 38038 - protein, 421 aa, Ulva pertusa
MFGALSKAVGSVCSRQGQAAVTGLGSVTGHQVRRAGHAENTNTFIREALAVLDLPPAMEKIVITPQREMTVELIINRDDGKPESFMGYRVQHDNARGPFKGGLRFHKDADLDDVRSLASLMSFKTALLDVPFGGAKGGITVDTKALSEHEIEKLTRKFVQIFDEYSKFEGYSPGVVTGKPTWLHGSHGRESATGRGTVFGIKNMLQAFGEGPPADKTFAIQGFGNVGAWAGRLLAEQGGIVKAVSDASGCVYDDGPSGIDVPKLLRHLHRGDDLSKYPHGQQLLRDEIFDVKCDVFVPAALGGVITDPVARKISCKYIVEAANGPTTPSADLILRDRGIPVLPDIYTNAGGVTVSFLEWVQNLQNFKWTTEQVNDQLKTRMDEAFQSMWDSSQEHGVPLRTGAFTVSLRRVVRATVNRGFN

SEQ ID NO: 38039 - protein, 190 aa, Ralstonia metallidurans CH34
MSNSIIQSPDLGDVTGYLRDRIRTVPDWPQPGVMFRDITPLLQNPKTLRVLIDVFVHRYMDQNLDLVAGIDARGFILGSIIAYELNLGFVPIRKKGKLPFQTVAEEYELEYGSATVEIHADACKPGDRVLLIDDLIATGGTMMAGRKLLERLGATVVEGGAIVDLPELGGSKLLQASGLSLFTVCNFDGH

SEQ ID NO: 38040 - protein, 476 aa, Methanosarcina acetivorans C2A
MKNYDLIVIGTGSGMNYVNSIIDSKPEMKIAVIDKDEPGGICLTRGCIPSKLLLYPAELVREIWTAPLFGIRLEIKDIDFRMIMERMRRRIGKDIDTIRDGLNEDTYLDYYHEAAEFISPYTLRVGEETLHSEMIFLCTGSKPSIPPVKGLEETGYLTSDTVLELEERPKSLAILGGSYIGAEYGHFFSAMGAEVTVIGRNSHFLPQEEPEISELARIKMSEYMKIITNHEAIEVRKESNGQKTVVAKDRKSGEEIKITADEILVATGRTPNTDILHPEKAGIKIDSQGWIMVDKYLETSQPNIWAFGDANGKYLLKHVGNYESGIVYLNAIMKEKVRADYHAVPHAVFSYPEIAGVGMSEKEALEEYGENRVVIGFKLFEDTAKGSAMEARGYFVKVILDSLEETILGAHIIGPHASILIHQIIPLMYAPSRSAKPIIRSMDIHPSLSEVVTRAFYSRFSPEQYHHIMKHLGLED

SEQ ID NO: 38041 - protein, 234 aa, Ashbya gossypii ATCC 10895
MSLFEWAFGKSVTPQERLKKNQNALDRTQRELEREKRKLEAQEKRLVQDIKKSAKNGQINAAKIQAKDLVRTKRYIEKFNGMKTQLQAISLRIQAVRSSDQMAISMREATGLLSSMNRSMNLPQLQRISMEFERQNDMMDQRQEFMDEAIDDAMGDELEEDEEAEEIINKVLDEIGVGLNNKLEDAPQGLVKNSAAAEARVAIPVVSNDTGGALSASSNTDDELQARLNSLKRG

SEQ ID NO: 38042 - protein, 499 aa, Arabidopsis thaliana
MARKMLVDGEIDKVAADEANATHYDFDLFVIGAGSGGVRAARFSANHGAKVGICELPFHPISSEEIGGVGGTCVIRGCVPKKILVYGATYGGELEDAKNYGWEINEKVDFTWKKLLQKKTDEILRLNNIYKRLLANAAVKLYEGEGRVVGPNEVEVRQIDGTKISYTAKHILIATGSRAQKPNIPGHELAITSDEALSLEEFPKRAIVLGGGYIAVEFASIWRGMGATVDLFFRKELPLRGFDDEMRALVARNLEGRGVNLHPQTSLTQLTKTDQGIKVISSHGEEFVADVVLFATGRSPNTKRLNLEAVGVELDQAGAVKVDEYSRTNIPSIWAVGDATNRINLTPVALMEATCFANTAFGGKPTKAEYSNVACAVFCIPPLAVVGLSEEEAVEQATGDILVFTSGFNPMKNTISGRQEKTLMKLIVDEKSDKVIGASMCGPDAAEIMQGIAIALKCGATKAQFDSTVGIHPSSAEEFVTMRSVTRRIAHKPKPKTNL

SEQ ID NO: 38043 - protein, 160 aa, Physcomitrella patens subsp. patens
MGSERPAQDGGSKVTLSGLLNFTDGLWSCCGMERIIIFTTNHIDKLDPGLLRPGRMDMHINMSYCNFEIFKVLAMNYLAVSNDPLFEEVEKLLQDESLKITPAEVTEIFFQHKNNNNLALHTLVEDMVRRTAGGDPVLLDKADAIEGNVDLDCEITPETN

SEQ ID NO: 38044 - protein, 449 aa, Pasteurella multocida subsp. multocida str. Pm70
MSQVATLDAFLERVAQRDGTQPEFLQAVREVFTSIWPFLEANPKYRSQALLERLVEPERVIQFRVAWTDDQGQTQVNRAFRVQYNSAIGPFKGGMRFHPSVNLSILKFLGFEQIFKNALTTLPMGGGKGGSDFDPKGKSDGEVMRFCQALMAELYRHVGADTDVPAGDIGVGGREVGYLAGYMKKLSNQAACVFTGRGLSFGGSLIRPEATGYGLVYFAQAMLAEKGQSFAGKTVSVSGSGNVAQYAIEKALQLGAKVVTCSDSSGYVYDEAGFTTEKLAALMELKNEKRGRVEEYAKQFGLKYVAGKTPWEVKVDIALPCATQNELDLASANTLIANGVQLVAEGANMPTTIEATDAFLDAGVLFGPGKAANAGGVATSGLEMTQSSQRLYWSAEEVDKKLHSIMLDIHANCKKYGTIEGQANINYVVGANVAGFVKVADAMLAQGVY

SEQ ID NO: 38045 - protein, 262 aa, Leuconostoc mesenteroides subsp. mesenteroides ATCC 8293
MIQLKSPREIEAMRQSGAIIAGMHHMLRDLIEPGIDTWEIETKSREYIESHGGVPLQIGFEGFKYATTISINDEVAHGLPRKGLKLKNGDLVKVDTVVGLNGAVSDSAWSYAVGEVTPEVQKLMDVTKKAMYLGIDQAIIGNRVGDIGNAIEQYTEVEHHYGDVREYIGHGVGPTMHEEPNVPHYGKPGHGVRLREGMVITIEPMINLGGWKVETDHTEADGWTVRTADGSWSAQYEHTLAITKDGPKILTSQDPEYDKRYS

SEQ ID NO: 38046 - protein, 373 aa, Symbiobacterium thermophilum IAM 14863
MKLYEYLAKQMFAEHGVPTGNGILCTTPEEAEEAARKIGPCAIKAQVLVGGRGKAGGIKLANTPEEARERAREILGMNLKGYIVDKVLVDPQIKIEKEYYVSITLDGMAKKPLVMASEYGGVEIESVPHDKIVFEHIDIETGLLPFQAREIARKINLTGDLADQFVRILTGLYQAFRKYDAELVEINPLALTDGGTRLIAADGRFNVEDDALFRHPEFPRVEEGTELEKKVRAIGLAFVQLDGDIAVMANGAGMAMGTLDTLAYYGGRPANFLDAGGGSGVEPTAQAFDALLGTKPKAIFVNIFGGITRCDLVAEAIVQVKKAKGIDVPLVVRMVGTNDVRGREILAEAGIQAYTDMGEAAKAAVEAAYGKGA

SEQ ID NO: 38047 - protein, 413 aa, Ashbya gossypii ATCC 10895
MAENSLLKPPSLSRKRSSSVGNIGLGDTKVPGLSTMSESKESKIAARARLRALSGASKTDIDIYYKLWLSYRELNYRHAWLTPLIILFLIYSCYFASGNRTESNPLHMFVAISYRVGNTNMYGKGVKDMCFVFYYMVFFTFLREFMMEMVLRPLTFRLGVTKPHKVKRMMEQAYSTFYYGLSGPFGLFVMYRTDLWLFKTAEMYKTYPDLTNEYYYKIFYLGQAAFWAQQACILVLQLEKPRKDFRELVFHHIVTLALISLSYVFHFTKMGLAVYITMDVSDFFLALSKIFNYMESSFTAPLFLLFVSSWVYLRHYVNIKILWSVLTEFRTVGDYTLNFATEQYKSWIALPIVFGLIFALHLVNLYWLALIFRILYRMLFQGVQKDERSDSESEDNEEELDDSSDETDKKKNQ

SEQ ID NO: 38048 - protein, 417 aa, Symbiobacterium thermophilum IAM 14863
MENRTGDGRQNPARNEADLKEAALRLHVQNRGKWTTASKVPLQTQEDLALAYSPGVAEPCRAIAADPEAVFRYTARGNLVAVVSDGSAVLGLGDIGPEAALPVMEGKALLFKAFADIDAVPLVLAERDVDEIVRTVTRLSPTFGGINLEDIAAPRCFAVERKLQAAVDIPVFHDDQHGTAIVVAAGLQNALKLVGKRLEEVRVVIEGAGASGLATAALLLDLGVSDLTLVDSRGTIYPGRPDGMNPFKEELAQRTNPRRVRGGLAEALAGADVAVGLARGGSMTREMVRAMAPDPIVFALANPEPAIWPEEAKAAGAAVVATGRSDYPNQLNNVLAFPGIFRGALDVRAREINEAMKRAAVRAIADLVAPEELSADYIIPAPLDRRVAPAVAAAVAEAAVRSGVARSPGFDSFDPYI

SEQ ID NO: 38049 - protein, 1320 aa, Candida albicans SC5314
MKSQSTDTLQPRISSDSLVYSSSSSSSNVYSQPKLPFARSYSSIPEQVHDPGSRQSSKNSNTNFSFSEHDDSIQEFLISPIQSDIFPYSKKPVISPVLESPEAGGDSTIVETSSPSPTKSGTVSLNSNAIGSIIGSYDYSKSSLELEKPKPVEEPVFQKDHARDHARQGSDASTISNGSEQVSKDKRFVRYAMNTQSPLVNASNKWQISNVIKWLDKNQFNNSWKETFRRNEISGNRFLELENFDKESMIWKQFSKFLQLDDDLNSVDRFIELLRKESSHELQTRKSLGGGEISPINVKHENRKSTPIYTKHMSTSSVSSSNSSSSISRPLSYVDSKPKEQLSSPSHHSFFRKHSRSTSNESKDAKKRYSSFDDNRVKSVPKNDKKSNGILSTLRKYGGDKIAKNTKQRSSTYFPSLDLPPPLESDPPAYNERKISVDSELSPKSIKSFSDDLSIDPKYLPTQHQELDLRKFHDCEPITILASKDNISFVPIVITELSNAKSHIIKALGLIDIGSITLHLTDFFHKEGEAIPDFLIPKVLKLDGLLKFYVRQELKSPEGTTTTFSTTSSDSKSYIADGNKTYPETPQYLLQAQHDSRVDYWNFKDLTSISEDPSKSLAGAKQNIDSKRNDTKQKPKEFPLKFPFANAPKKGNTVPQLQIDTSGVNNISKPPTSTGSTFQVLRKKGHEIDFDKRRKSPYESKTPKIIANIYSSSVANTKKSPISASTVMALKDDVVVQRPETISRSNSIIAKRTAPPPPGDRRVQIQRQNSILRRKPGLKSTNNVTSGSSEGSKKNISDSTDDNDSEDAFFVKPLKKKENELGNNSDNNSENDEDNDSDDDFFVKPIKKEVADVSAGKVELDDSEEDFFVKPIHKKPSHMNVRPPVEEVYNNLEKYFPYTNLDKPIIDDSPASPSPQRRPTISRTFSSANKSPVAPTSADSKNTNDEQPSLRVRRMKTIRGVANEARRKVLQMKQASPPNTFANITRENSAKLTRSNTKMWGQRVVEVTSQEIEKGFVSKLRNKNGLYQEYAWIKGELIGRGSFGDVYLGLNVTTGEMLAVKQVVCGRNNKEGIEALHKEVETMKDLNHMNIVQYLGYDQQKNIYSLFLEYVAGGSIALCLKSYGKFDETLIRFITKQILLGLEYLHSNNIIHRDLKADNLLLEVDGTCKISDFGISKRSNDIYANNANMSMQGTIFWMAPEVIDSMVEGYSAKIDIWSLGCVVLEMFAGKRPWSNEAAISVIYKTGKEKLAPPIPDDIAHLVSPVAESFINRCFTIDPKDRPTAGELLNDPFVNTLDHDFNFANTKLAEMIRYNSKRLFT

SEQ ID NO: 38050 - protein, 627 aa, Oryza sativa Indica Group
MNGQTPMGLAAAAAAAVRPCRRRLLSSATAAAAATVATATPLFPRCPHPHHHLHGRRLPFLASAASQQQQQSGQTAASPATPPIPSDPRAAVSGNLPFFDRVLFPDTFPVETPPPSSAAASAAAAADEEVASALKVREETEAEREAWRLLRRAVVSYCVEPVGTVAAEDPECTETLNYDQVFIRDFVPSALAFLMRGETETVRNFLLHTLQLQSWEKTVDCYSPGQDLMPASFKIRAVPLDDNNEAFEEVLDPDFGESAIGRVAPVDSGLWWIILLRAYCKITGDNALQERVDVQTGIKLILSLCLSDGFDMFPTLLVTDGSCMIDRRMGIHGHPLEIQALFYSALRCSREMLVMNDGSKNLLRAINNRLSALSFHIREHYWVDMKKINEIYRYKTEEYSHDATNKFNIYPEQIPSWLVDWIPEKGGYLIGNLQPAHMDFRFFSLGNLWAITSSLTTPKQAEGILSLIDEKWDDLIANMPLKICYPAMEDDEWRIITGSDPKNTPWSYHNGGSWPTLLWQFTLACIKMGRPELARRAIAVAEEKLAADKWPEYYDTRSGRFIGKQSRSYQTWTIAGFLTSKMLLENPELASILTCNEDLELLEGCACCLSKKRTRCSRRAAKSHVVE

SEQ ID NO: 38051 - protein, 609 aa, Saccharomyces pastorianus
MPLSEDFGSSGKKETSPDSISVRSFSAGNNLQSLTSEKSYSRDSTGNDKLIHRFVDSFKRAESSTTKTKQINKNTSDLEEDVHSFTSDSDLKKSMKSRHVVMMSLGTGIGTGLLVANAKGLHYGGPAALVIGYVLVSFVTYFMIQAAGEMAVTYPTLPANFNAYSSIFVSKPFGFATVWLYCFQWLTVLPLELITASMTVQFWNDKINADIFILIFFVFLLFVHFFGVKAYGETEFIFNCCKILMIAGFIILSVVINCGGAGNDGYIGGKYWRNPGAFAGDSSASRFKNICYILVTAYFSFGGMELFALSVQEQENPRKSTPVAAKRSIYRILIIYLLTMILIGFNVPYNDDQLMGSGGSATHASPYVLAASIHGVKVVPHIINAVILISVISVSNSSLYAGPRLMCSLAQQGYAPKFLDYIDREGRPLRALIVCSIFGTVAFVAASSKEEVVFTWLAAIAGLSELFTWTSIMLSHFRFRQAMKVQGRSLDELGYKATSGIWGSAYGVFFNILVFIAQFWVALAPLGNGGKCSVESFFESYLAAPIWLAFYLGYMIYNRDFTFLNPLDKIDLDFHRRVYDPELMRQEDLENKEKKKHMPLMKKAYLFWC

SEQ ID NO: 38052 - protein, 516 aa, Penicillium digitatum
MDLVPLVTGQIKCIAYYTTGLVLASIVLNVIKQLVFYNRKEPPVVFHWIPFIGSTVAYGMDPYQFFFASRAKYGNIFTFILLGKKTTVYLGVEGNEFILNGKLKDVNAEEIYGKLTTPVFGSDVVYDCPNSKLMEQKKFIKYGLSQEALESYVPLIADEISSYIKSSPSFKGQSGTIDLVPAMAEITTFTAARTLQGEEVRSKLTTEFAKLFHDLDLGFTPINFMLPWAPLPQNRKRDRAHRRMREIYVDIIQARREAGEEANDNGRDKTKGTDMISNLMRCVYRDGTPIPDKEIAHLMITLLMAGQHSSASISCWILLRLASQPEMTEKLFAEQVNNLGADLPPLQYKDLDKLPLHRNVIKETLRLHSSIHTLMRKVKNPMPVPGTDFVIPPSHTLLSSPGVTARDERHFRDPLRWDPHRWESRVEAEDSSDTVDYGYGAVSKGTRSPYLPFGAGRHRCIGEKFAYLNLGVIIATLVREFRFFNPEGMEGVPDTDYSSLFSRPMQPATVRWEVRS

SEQ ID NO: 38053 - protein, 157 aa, Photobacterium profundum SS9
MRIGHGFDVHKFGGEGPVIIGGVAIPYEQGLIAHSDGDVALHAVCDALLGAIGAGDIGRHFPDTDAEWKGADSRFLLRDVYSKVKDKGYRLGNLDVTIIAQAPKMAPYIDAMCQAIAEDLETDIGNVNVKATTSERLGFTGRKEGIACEAVVLINAQ

SEQ ID NO: 38054 - protein, 289 aa, Microcystis aeruginosa PCC 7806
MQANFFTNILLPVALGVLMLGMGLGLIPADFQRITRYPKAVLIGLVNQIIILPIVGFIIASLLPLRPEIAVGLMIVAICPGGPSSNVLTYLAKGDVALSVTLTAFSSIITIFTIPFLASFTLQHFMGESAAISLPIGSTMAQIFLIILLPMIIGMTIRHYFPLLAKSMEPITNRLSVIFLAVIICLLILREWQRLPLFIAQTGLAVIILNTITSLIGFFSGRLFQLTISQRICIAIEVGIQSGTLAIAITAGLLKNPDLTIPAIVYSLWMYVSAFIAVYYGRQKAALAK

SEQ ID NO: 38055 - protein, 169 aa, Magnetospirillum magnetotacticum MS-1
MVSRSRDADTPNSILESLAGTRVLVVEARYYDDIADELLAGARAAIEAVGAEARVVTVPGALEIPAAIAILLDAGRRAGGPFDAVVALGCVIRGETGHYDIVAGESARALMDLSVAEHLPLGNGILTVETMEQALARARVSEMNKGGGAAEAALSLLAIKRAANLESAR

SEQ ID NO: 38056 - protein, 147 aa, Methanosarcina acetivorans C2A
MVLNTTMGDITIELFEDMPITAGNFAKLVDKGFYDGVIFHRIIDKFMIQGGDPTGTGMGGPGYEIPDEFTKHNRNDRGTISMANAGPNTGGSQFFINLVNNNYLDKMHPVFGKVVEGMDVVDAMGKVKTDRQDRPKTEVKIVKAELV

SEQ ID NO: 38057 - protein, 433 aa, Photobacterium profundum SS9
MSKIVKVLGREIIDSRGNPTVEAEVHLEGGFVGMAAAPSGASTGSREALELRDGDKSRFLGKGVLKALEAVNGPIAEALLGKDATDQAAIDQVMIDLDGTENKSKFGANAILAVSLANAKAGAAAKGMPLYEHIAELNGTAGQFSMPLPMMNIINGGEHADNNVDIQEFMIQPVGAKTFREAVRIGAEVFHNLAKVLKAKGLSTAVGDEGGFAPNLESNAAALAAIKEAVEAAGYELGKDVTLAMDCAASEFYDKEAGNYNMKGEGKIFTSEEFNFYLQDLANQYPIVSIEDGLDESDWAGFKHQTELLGDKLQIVGDDLFVTNTKILAEGIEKGVANSILIKFNQIGSLTETLAAIKMAKDAGYTAVISHRSGETEDATIADLAVGTAAGQIKTGSMSRSDRVAKYNQLLRIEEALGAKAPFNGLKEVKGQA

SEQ ID NO: 38058 - protein, 451 aa, Bradyrhizobium japonicum USDA 110
MTVQRPTHHAAAAEGTVKAALSSLRSSAKHIDTRAVRGRITRAVGTLLHAVLPEARVGELCLLQDPRSGWSLEAEVIGLLPDGVLLTPIGDMVGLSNRAEVVTTGRMQEVAAGPDLLGRVIDSFGRPLDGKGPIKAGEARPLRGRAPNPMKRRAIEQPFPLGVRVLDGLLTCGEGQRIGIYGDAGCGKSTLMSQIVRGAAADVTIVALIGERGREVREFIERHLGEALHRSVVVVETSDRSAMERAQCAHMATALAEYFRDQGLRVVLMMDSLTRFSRAMREIGLAAGEPPTRRGFPPSVFALLPGLLERAGMGEHGSITAFYTVLVEGDGTGDPIAEESRGILDGHIILSRALASREHFPAIDVLSSRSRVMDAIVSVPHRKAASFFRDLLSRYAEAEFLIKVGEYKQGSDPLTDRAIASIEQLRAFLRQGQGEACSFEETIAWISRLTA

SEQ ID NO: 38059 - protein, 560 aa, Triticum aestivum
GFDAVSLPLDFFPVLKRRLKGAKVPGGSRKNNRQKIIYEHTIAYNVLIEKAEGKGSNNGGGGGACAIPRWLAWLVVSLLSLYLLNLLTHARSGLSPGPRPLPLIGSLHLLGDRPHRSLARLARTHAAPLMSLRLGAVTTVVASSPAMAREFLQRHDAAFATRSVPDATGMHAAGSVPWLPPAPRWRALRKMMATELFAPHRLDALHHLRSEKVGELMDHVARLARDGKPVNIGRVAFTTSLNLLSRTIFSHDLTSLDDDNRSGEFQEVVTGIMETVGGPNVSDFFPVLAPADLQGTRRRLARLFARLHVVFDAEVDQRLRARDAGQPRKNDFLDVLLDVAAREDGKDLLDRQTLRSLFTDLFAAGSDTSSSTVEWAMTELLQNPSSLAKACNELEQVIGPRRNIEEADIVRLPYMQAIIKETFRLHPPAPLLLPRQPEASLKIAGYTIPKGSRIFINVWAIGRDKDVWDEPEKFMPERFLGSTIDFRGADFELLPFGAGRRICPGMTLATRMVHLMLASLLHQFKWSLPVELEKDGIDMEDKFGLTLTKVIPLCIVATPV

SEQ ID NO: 38060 - protein, 136 aa, Physcomitrella patens subsp. patens
MCGRQMLRQCLLLVVLVSSLVLVCESSDGDERPSYRECVKVCEQTGCVDGQCYNSCNFPVNVDLEGNILPKKAQLNSPHEKFLEEPLYLRWKKWDCISECRYQCMLREEAGSEFPVKYHGKWPFVRIFSLQILDLK

SEQ ID NO: 38061 - protein, 229 aa, Ashbya gossypii ATCC 10895
MGKKLHLKKAQQHPGEPFFPSELHQFLDRAPRESFLPGVECMLDDKVILVRKFFTAAVCEQLIAHFSRPNVLELFHQRGSRDYAERLNDRASVTDSETALKLWRKLHAVLAQDPHVMQDLRFSEAKGLIGKLRLYRYQKGHHFGKHYDESVSVPGAGRTQWTVLIYLSGGDSLEGGDTVFYKYHERGHEAVHPMPGLALLHKHGDDCLLHEAQMVMRGVKWVLRSDIIF

SEQ ID NO: 38062 - protein, 608 aa, Gibberella zeae PH-1
MNRTSRTDEPYEGEQKGYNQSPNPLSADLTTNQDLKGTVDGRTVRRGTQSPSLYNSALDDDIRQTLDPDAGSSGARGSELVNKDVSQLMGSEVEQAAQSPFPHSPPSNSASGLGGDEGGTLSWGNRLKNGIIKFCSFIGPGFLIAVAYTAGATYQFKLLFVVLMANLFAIFLQTLCIKLGTVSGLNLAQACRAFLPRWANFGLYFFAEVAIIATDIAEVIGFAIALNLLIPAIPLVAGCAISILDVMLILLFYQPHGSMKGLRVFESFIVLLVLGVVICFCIQLSLIQETNVGSIFRGYLPSSAITEQKGLYQACGILGATVMPHSLYLGSGIVQPRLRSFDAKHDLLPENIQSPSNDSNDINKGYYIPSLRAIRHCYRASAIELAIALFTFALFVNSSIVIVSGVSLHNKPDASEADIFSIHKLLSESISSVAGTIFALALLLSGVSAGIVCTITGQMVSEGALNWRLRPWLRRLVTRGISIIPSVVIAAAVGRSGLNDALNASQVVLSIILPFVSAPLIYFTCLNKYMTVKPGGAGFGTNCDRETTRNRNEEALARDEIGSVKMANSWLTAAFAVLLWLVITVLNVANLVLLGLKDACSTRRDKAT

SEQ ID NO: 38063 - protein, 580 aa, Zea mays
  misc_feature (116)..(116): Xaa can be any naturally occurring amino acid
  misc_feature (443)..(443): Xaa can be any naturally occurring amino acid
MELVYMERRNGSYDDGAVPEFSGRGAGGDQDQDPPAAASEVQSDSRQTPDEKKSKGCQSCRDPFCSCSGGTPHSELFPPHPAKMMILEFLIASLRHPTRTHNVSDLDDLIADGVSXGSVVNLGPSEKKVLESLHAMVNAKTRPKSPSPFMAGSKLRKIRSKSHVITQSEILKLISPETWEASSFPGASPMIGGGTAEDGVHGNKPPPPCCSSVSSNQHVLSRCPSSLSACLLQCIWKDGLPHFELSLDDHPIAVYAASPVRVLEKDRAFDYVYMIHSGEQGRKDWMGHSSNVSRLVGKVKVSSSLVLNPDKSGLLETEFVLYGSPDDYLRQMRSPYSVPKGKGLVRRVTEIMRAGNVSASPRHPWKLGKSSSHQFDDLAGVLEGEMISAGGSDLVSLKADDLPSNQELAAIVVREQRRRRRKEPVSGGWGLKFLEKAGLNRPXGTEETDVQNSDGATHCVTVVVPRGYHGGVVSKSSRPSGLVERWRSGGRCDCGGWDLGCPIRVLNGDGCGSLPEGESRDRRSVEISIKGAKNETMLKLVNITEDLYILYFDSSISPLQCFSTGIAIVHSRAPELCPKL

SEQ ID NO: 38064 - protein, 421 aa, Symbiobacterium thermophilum IAM 14863
MAKFTKLTPPEGQKITMENGRLVVPDNPIIPFIEGDGTGPDIWAAAQPVIDAAVEKAYGGRRKIAWFEVYAGEKCLNKFGEWLIDDTVEAIREYRVAIKGPLTTPVGGGIRSLNVTLRQVLDLYACVRPVRWFPGVPSPVKEPHKTDVVIFRENTEDIYAGIEWKAGTPEARKVQALLAEEMGVKFPNSDKSDMIGVGIKPVSEFGSKRLVRAAIQYAIDNKRKSVTLVHKGNIQKFTEGAFRDWGYQVALEEFRPYVITEEELWSDEYKGKMPEGKILIRDRIADITFQQLLLRPEEWDVIATLNLNGDYLSDHVAAIVGGIGIAPGANISYSGGYGLFEATHGTAPKYAGLDKVNPGSVILSGEMMLRYMGWHEAADLIIKGLSATIAQKTVTYDFARLTEGATEVKCSEFGRLIIANM

SEQ ID NO: 38065 - protein, 426 aa, Pisum sativum
DLSINELTGEIPPGLCTTGNLTKLILFNNSFSGNIPTGLSNCSSLVRVRIQNNVISGTIPVGFGNLPRLQRMELAKNNLTGQIPVDLTSSTSLSFIDVSWNRLESSLPSEILSIPSLQTFLASHNSFGGTIPDEFQGCSSLSVLDLSSANISGAIPKSIASCTKLVNLNLRNNHLTGGIPKSITNMPTLSVLDLSNNSLTGRIPETFGSSPALETMNLSYNKLEGSVPSNGILMTMNPNNFIGNAGLCGGFLPSCSRGLTVTNQKRSSHISRIVIGFLTGILVILSLAAAYFGGKWLYNRCYLRNNFIYDWFKQGNEDWPWRLVAFQRISFTSSEILTCIKESNVIGMGGAGIVYKAEIHKPHTTVAVKKLWRSSTDIENGGNDVLREVELLGRLRHRNIVRLLGYVHNERDVIMVYEYMPNGSLG

SEQ ID NO: 38066 - protein, 311 aa, Ashbya gossypii ATCC 10895
MPTRVQEEELLASYPSKCAAGSLAGTPGNLTSEHEAALEELRKVLKQAGFTKRLDDSTLLRFLRARKFDVAAARAMFENCEKWRKENGVDTIFEDFHYEEKPLVAKFYPQYYHKTDKDGRPVYIEELGAVNLTEMYKITTQERMLKNLIWEYESFSRYRLPASSRQADCLVETSCTILDLKGISISAAAQVLSYVREASNIGQNYYPERMGKFYMINAPFGFSAAFRLFKPFLDPVTVSKIFILGSSYQKELLKQIPAENLPVKFGGQSDVSEAEGGLYLSDIGPWRNPKYIGPEGEAPKAFSMSPKPESA

SEQ ID NO: 38067 - protein, 637 aa, Triticum aestivum
  misc_feature (60)..(60): Xaa can be any naturally occurring amino acid
  misc_feature (68)..(68): Xaa can be any naturally occurring amino acid
  misc_feature (76)..(76): Xaa can be any naturally occurring amino acid
  misc_feature (115)..(115): Xaa can be any naturally occurring amino acid
  misc_feature (203)..(203): Xaa can be any naturally occurring amino acid
  misc_feature (261)..(261): Xaa can be any naturally occurring amino acid
MEKTTGMAGSQPTDTESFEYMLLEKDPDHYRTVFSGPSPDKPVDPTRRGLNLKHRIGRGXPFGDVWIXATHHQRTXEDYDRYHEVAVKMLHPVRDDQLQVFSARFDEVFGKCQGXGNVCFLHGISTQNGRLCIVMKFYEGSVGDKMARLKGGRLPLSDVLRYGADLARGVLDLHSRGIFVLNLKPCNFLLDDHDHAVLGDFGXIPSLLFGLSLPNPELIQRLGTPNYMAPEQWQPNIRGPISYETDSWGFACSILEMFSGXQPWRGKSPDEIYQLVVLKKEKPIFPYNLPAEVENVLSSCFEYDFRDRPLMSDILQAFESAKDVDYDNNGWDSSENPRAVVPSHTNWSHFKDKLQVGDKVRSRKVKNSCTPETMEIPDGTIVGMEEDGERDSYILVRVHGIHDPLKVHSSTVERVTYGFAAGDWVRLREEDKKRSQVGILHSIDRNGTVYVGLIGMDTLWKGEYSDLQMAEAYCMGQFVRLRTNTSSPRFEWPRKRGGVFATGRISQILSNGCLVVTFPGKFSLGEVCSCLADPSEVEVVSFDKCEGVVKKYEHLEDFHWAVRPLFIAIGFFTAMKLGVFVGKSITRPRSRKVASVSDQGGDPQKVQQQEVHNSVGTAWLPPPVANMLFRDGPAPSG

SEQ ID NO: 38068 - protein, 189 aa, Leuconostoc mesenteroides subsp. mesenteroides ATCC 8293
MTTNFIDSEITDFKVNAYHDGDFTEVTKQDTLGKWGVYFFYPADFSFVCPTELGDLADHYADFQNINAEIYSVSEDSEFVHKAWAEATDTIAKVKYPMLADPAGKLARFFNVLDEDAGLAFRATFIVDPEGKIQSYTINNMGIGRNAEEILRTLEAAQFVAEHGDRVCPANWHPGEDTIAPSLDLVGKI

SEQ ID NO: 38069 - protein, 300 aa, Physcomitrella patens subsp. patens
MSFTYLQVQLEVLDMKIEKETNEVRNEFAQKLDTQVAEVASGVRGLRAQVDQLYESGVPLNRHEVMELVKNVVEQRASESTSKSFSLEDVRSVARKIVMSELEKHAADGIGRTDYALASGGGRVVDHSEGVFLGRGQQWSSLMFGHIVPGGTRKHPLAQKVLQPSFGQPGECLPLRGSNVFLEISLRTAIRPDAVTLEHVAKSVAYDLSSAPKEFQLYGWREMRPTDGIAQPSPEHKLLGQFIYNSDGPSNVQTFQLSKDDVGDEPINMVRLQVLSNHGSPLHTCIYRIRVHGVDPQATL

SEQ ID NO: 38070 - protein, 478 aa, Xylella fastidiosa Ann-1
MSEHYDVVVIGAGPAGYHAAIRAAQLGLKVACVDAALGKDGKPALGGTCLRVGCIPSKALLDSSRQYWNMGHLFNEHGISFKDAKMDVATMIARKDKIVKQFTGGIAMLFKANKITPYYGFAQLQPGNVVKVKQHEGKNIELKGTNVILASGSDSVELPFATFDGETIVDNIGALDFTKVPKRLAVIGAGVIGLELGSVWKRLGAEVTILEAMPNFLAAVDADVSKTAAKEFKQQGLDIKLNAKVSRTEISSKNNKKEVIVTYTDASGKQTLTVDKLLVAVGRKAATKGLLADGTGVQLNERGQIMVDEHCHTGVDGVWAIGDCVRGPMLAHKGFEEGIAVAELIAGLPGHVNFETIPWVIYTEPEIAWVGKTEQELKADSIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 38071 - protein, 391 aa, Xylella fastidiosa Ann-1
MSTEVKVPVLPESVSDATIASWHKKAGEIVKRDENIVDLETDKVVLEVPSPVDGVLKEIKFDTGSTVTSNQVLAIIEEESIVAAPSPAPSQVIDQKPVAVSAPAAKSNVDSLPPGARFTATTEGIDPAHIEGSGRRGAVTKEDIINFAKQNGAARSSGTRLEERVPMTRIRQRIAERLMQSKNSTAMLTTFNEINLAKVSNIRKELQEEFQKAHGIKLGFMSFFVKAAANALQRFPLVNASIDGTDIIYHGYSDISIAVSTDKGLVTPVLRNVERMSFADIEHRIADYAKKARDGKLSLEELQGGTFTVTNGGTFGSLLSTPIVNPPQSAILGMHTIKERPIAENGHIVIAPMMYVALSYDHRIIDGKDSVQFLVDIKNQLEAPGRMLFGL

SEQ ID NO: 38072 - protein, 452 aa, Magnaporthe grisea 70-15
MATAQAAYAAEKAVGHQEGGITRQDVSDYTETGDPSRTMKALVWMGKNKVEIADMPRPKIIEPKDVILKVTGSTVCGSDLHLLHGSVIQMNKNDILGHEFCGIVDEVGPEVTKCKPGKRYVASFQIACGECFFCKQKLSSQCERTNDNTIAKAMYGNQTAGMFGYSHFTGGFAGGQAEYVRVPFGDVNLLEIPDDVPDEKALYLSDVLPTSYNAVKDTAVYPGDTVAVFGAGPIGQMAGYWALLEGAEKVIFVDTEPRLSYIQERFNAEQKAKTTCIDYKKLSSGITNKETVVSKLKEMCGGRGPDCAIECAAGEYAKGWAHWLEMTLGAETDTSEILNEMIEGVRNYGRVGVTGVYVGYTNHFNIGSLMQRGVRLIGNGQAPVHKYWEELLARIQSNDFDPLQMLSHRVRLEDLDKVYYKFEKREDSMQKIFVETKFSLPRATGTPELTTY

SEQ ID NO: 38073 - protein, 191 aa, Triticum aestivum
AYLGDTIEQVCTKKQAGTGPEFPGYRRPTRPELAVKEAAWGLARYAAISQDNGLVPIVEPEILLDGEHGIERTFEVAQKVWAETFYQMAQNNVMFEGILLKPSMVTPGAECKDRATPEHVADYTVKLLSRRVPPAVPGIMFLSGGQSQVEAPLNLNAMNQGPNPWHVSFSYARALQKHVPSRRGGAPAEKR

SEQ ID NO: 38074 - protein, 329 aa, Bartonella quintana str. Toulouse
MKKIAIGTLGGTIAMAADNFGQMQPTLTSDILIKSVPDLNNIADIHAQTLTQLPSGSLSFKILFEIIEWAKQQIKAGAEGVVLAQGTDTLEETAFFLSLYWNKAEPLIVTGAMRIPCEAGADGPANILAATRVAAHPKSRNRGVLVVINDTIHSPYWVQKSHTVKIETFQSGLTGILGTILEGKLVYFNDRNFFPTTFDLPQNDDHQVALLYSSLSSGTQLMKFCLESGHYAGLVIAGFGSGHCSFEEADIVRQYAQKMPIIIASRTCTGSTTRTTYGYKGSEVDMIASGALMSGYLSAVKARLLLWAFLAQKLSLAQINAHWNDWTIS

SEQ ID NO: 38075 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEVKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLDKETTYDEIKKVVKAAAEGKLKGVLGYTEDAVVSSDFLGDSHSSIFDASAGIQLSPKFVKLVSWYDNEYGYSTRVVDLVEHIAKA

SEQ ID NO: 38076 - protein, 574 aa, Synechococcus sp. CC9605
MLRLENVSKIYPTGEVLRAVTWEVKPGDRIGLVGVNGAGKSTQMRLIAGHEEPTSGQVVRQGEPRIAYLQQEFDVDLERTVRQELFQAFGEAAEVMNQQKQVEEAMCSERAAEDPDHLDELIQQLGKLQSRFEALHGYELDARIDKLLPTIGFTPESAELQVKDYSGGWQMRIALGKILLQEPDLLLLDEPTNHLDVETIQWLENYLLEQSAALVVISHDRTFLDRVCNQIVSTERGVSRSYLGNYTAYLEQKQLEREATQSAFERQQKEIATQQAYIDRFRASATRSTQAKSREKQLDKVERVEAPIESVAGPSFQFPPAPRSGAQVALIDNLTHSYGDKILFLGAELEVERGDRIAFVGPNGAGKSTLLRLVMGVETPDEGSARLGEHNVIAGYFEQNQAEALDLSKTVIDTMYEAVPDWTQTQVRSLLGSFCFSNDTVFKEVGKLSGGEKARLALALMLLTPCNLLVLDEPTNHLDIPAKQILEDALMAYEGAALLVSHDRYFISRVANRIVELRDGELVIYRGDYNYYLEKKEEERTAAKEKELAAEREAKRKANKEKQKARDARRKKAA

SEQ ID NO: 38077 - protein, 198 aa, Triticum aestivum
  misc_feature (107)..(107): Xaa can be any naturally occurring amino acid
  misc_feature (129)..(129): Xaa can be any naturally occurring amino acid
  misc_feature (139)..(139): Xaa can be any naturally occurring amino acid
  misc_feature (152)..(152): Xaa can be any naturally occurring amino acid
HYRTSLYKKAGWYRSGIPGISSTHASGGNFIKFTAIGVYLQADAAVSALAAKWAGKPAADLASDAAFFRDVVTGEFEKFTRVTMILPLTGAQYSDKVTENCVAYWKXTGVYTDAEAAAVDKFKEAFGPXSFAPGASILXTHSPAGLLTVAFXKDSSVPESGGVAIDNARLCEAVLDPSSASRGVAGGQLSLATRAASC

SEQ ID NO: 38078 - protein, 332 aa, Saccharomyces cerevisiae
  misc_feature (12)..(12): Xaa can be any naturally occurring amino acid
  misc_feature (48)..(48): Xaa can be any naturally occurring amino acid
  misc_feature (95)..(95): Xaa can be any naturally occurring amino acid
  misc_feature (233)..(233): Xaa can be any naturally occurring amino acid
  misc_feature (242)..(242): Xaa can be any naturally occurring amino acid
  misc_feature (287)..(287): Xaa can be any naturally occurring amino acid
MVRVAINGFGRXGRLVMRIALQRKNVEVVALNDPFISNDYSAYMFKYXSTHGRYAGEVSHDDKHIIVDGHKIATFQERDPANLPWASLNIDIAIXSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRXPTVDVSVVXLTVKLNKETTYDEIKKVVKAAAEGKLKGVLGYTEDAVVSSDFLGXSNSSIFDAAAGIQLSPKFVKLVSWYDNEYGYSTRVVDLVEHVAKA

SEQ ID NO: 38079 - protein, 177 aa, Zea mays
MGKDDVIESGAGGGEFAAKDYTDPPPAPLIDAAELGSWSLYRAVIAEFIANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 38080 - protein, 427 aa, Haloarcula marismortui ATCC 43049
MSTQKEPPEQATDEDESPIATARRQLERAAEHLDLSEGMLEQLRHPSKTVEVSVPIHRTDGSVEVFNGYRVQHFEVRGPYKGGMRYHPSVSAEECTALAMLMTWKCAVMDLPFGGAKGGIVVDPSTLDAQETEQLTRRFAEELREVVGPTKDIPAPDMGTDEQTVAWFMDAYSMQEGETVPGIVTGKPTAVGGTHGREEAPGRSVAIVAREALDYYDGSVEGATVAVQGFGAVGANAARLLDSWGASVVAVSDVDGGIYDESGLDIESISADGDEHGQLGAVDAPRQLSNAELLELDVDVLIPAAVGNVLTEENAADVQASIIVEGANGPTTTAADTVFEERNIPVIPDILANAGGVTVSYFEWLQHINRRSWSREEVNDELEAEMLDAWEALQAEVEDRDVTWRTAAYIVALSRIGDAMNARGLWP

SEQ ID NO: 38081 - protein, 332 aa, Saccharomyces cerevisiae
  misc_feature (32)..(32): Xaa can be any naturally occurring amino acid
  misc_feature (324)..(324): Xaa can be any naturally occurring amino acid
MIRIAINGFGRIGRLVLRLALQRKDIEVVAVXDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLAKEATYDQIKKAVKAAAEGPMKGVLGYTEDAVVSSDFLGDTHASIFDASAGIQLSPKFVKLISWYDNEYGYSARVVXLIEYVAKA

SEQ ID NO: 38082 - protein, 285 aa, Triticum aestivum
  misc_feature (220)..(220): Xaa can be any naturally occurring amino acid
MRSARHLHLAVSALLLLLLLSAVVPAARAQQEIDDESEFSYVCGSENGPENWGKIKEEWATCGTGRMQSPIDLSDRHASRAPNLGYLNHSYLPAEASIVNRGHDITVMFHGDAGSLWINGTAYHLRQVHWHSPSEHRVNGRRYNLELHMVHLSAENKAAVIGLLYKIGRRDHFLHELESYLRRMAGTKEKEEKVGVVDPWEARGDGEAYYRYMGSLTTPXCDEGVIWTVIKRVATVSSQQLKLLTDAVHDGFEMNARPLQKVNGRDISLFCPHDHHERYYAAADH

SEQ ID NO: 38083 - protein, 429 aa, Methanosarcina acetivorans C2A [sequence omitted]

SEQ ID NO: 38084 - protein, 367 aa, Synechocystis sp. PCC 6803
MEIPGQSILPPMNTSSPVFIPVILAGGKGERFWPLSRRQRPKQFLSLDGSGVSLLQATAQRLLSLAGDWENLWVITAAPIAEGVFEQLPSLPKENCLVEPEGKDTAPAVAWASLEIAQQYGDDAIIGFFPADHWIKDQCAYEQTLKAAIAYAQEQDAIVTLGIKPHGPATGYGYIEQGTLEREIDGLPVYQVTRFTEKPDRATAQTFVDSGKFSWNSGMFIFRAGVVLRELDRHAPELLATLRAKGAAGYPALEKKSIDYVLMEKTQLAAVLPANFGWDDLGDWNALERLFPETEANVDLANHVNLHSRGCIVYASDENQIIATIGLKDVVIVREGNVTLVVPKDHTQDIKDLLKQLQSQPEYENLL

SEQ ID NO: 38085 - protein, 284 aa, Brassica napus
  misc_feature (72)..(72): Xaa can be any naturally occurring amino acid
  misc_feature (105)..(105): Xaa can be any naturally occurring amino acid
  misc_feature (119)..(119): Xaa can be any naturally occurring amino acid
MSKEVSEEGQTHSHGKDYVDPPPAPLLDMGELKSWSFYRALIAEFIATLLFLYVTVATVIGHKKQTGPCDGXVGLLGIAWAFGGMIFVLVYCTAGISGGHINPAXVTFGLFLARKVSLXVRAVGYMIAQCLGAICGVGFVKAFMKTPYNTLGGGANTVADGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSNATN

SEQ ID NO: 38086 - protein, 1043 aa, Physcomitrella patens subsp. patens
LKDSLRIAKDQLEFARASSKTLEAKAQECAEKALALHDQATSARLAAVSTLASIQSVLERELKAEENVAAAGARVLAAQEKFTRAEKAFQVARWKLEPPGTSLDDLETDARKEYLAMESARMDFVASEAALAECEAELAQIQTVKMELQKEALRRSELSQVAEDAAVLADEDVASAMTSAEEAVALEMEALKRVSDAEIVLRKVEAFAEEAARALTKTEASGEEVFKTHQNAETSGEEASQTPELAAAGTEQLDFQNAMESSIESEKLDKEPQPDQMLVDVNPKHEEPKSSPTKRAESTTNESSGPKSLTKKSSRFFPASYFSSGDEAEFSPSMVFSNFAAALKEQLVKVTIGMALLIAGGYYLNNQLEKRALLMQPPEVTSTQELKTTTKPLVSEIRKISRRVKQVILKLPHQEVNEDEASLFDVLWLLLASVVFVPIFQRLPGGSPVLGYLAAGVLIGPYALSIIKNIHGTRMIAEFGVVFLLFNIGLELSVERLTSMKKYVFGFGSIQVLVTALVIGAFAHVACGFSGPAAIVIGNGLALSSTAVVLQVLQERGENTSRHGRATFSVLLFQDLAVVVLLILIPLLSPNSSKGGVGIQAIAEALGIAAVKAVVAITGIIAGGRLLLRPVYKRMAENHNAEIFAANTLLVVLGTSVMTARAGLSMALGAFLAGLLLAETEFALQVESDIAPYRGLLLGLFFMTVGMSIDSQLFINRFPTILGSLMLLIGGKTLLVTGVGRFFGLSTVAAARAGLLLAPGGEFAFVAFGEAVNQAISLVFLQGIMSNQLSSLLFLVVGLSMAITPWLAAGGQLLASRFDQQDVRSLLPAESETDDLQGHILICGFGRVGQIIAQLLSERLIPFVALDVRSERVSVGRALDLPVYFGDAGSKEVLHKVGAERAAAAVLTLDTPGANYRTVFALTKNFPHVKTFVRAHDVEHGLNLEKAGATAVVPETLEPSLQLAAAVLSQVKLPAAEIAAAIDEFRSNHLSELSELSETRGTSLGYGFSRIMMKSKIQPPEVQTRLGIDDGVSDWRPEGSVLP

SEQ ID NO: 38087 - protein, 1158 aa, Chenopodium quinoa
MAAYRIAVPFPLMLAEVGAETTAPMNSTISASAMAEESESNPTDAVIFFGVSLIPGIACRHFLRGTRVPYTVALLIIGIGLGSLEYGTKHGLGRFGDGIRIWENIDPELLLAVFLPALLFESSFSMEIHQIKRCAAQMILLAGPGVLISTFCLGAALKLSFPYDWSWKTSLLLGGLLSATDPVAVVALLKELGASKKLSTIIEGESLMNDGTAIVVYQLFLKMILGRTFNWASILKYLVQVSFGAVGFGIAFGIASVLWLGFIFNDTIIEITLTLAVSYVAYFTAQEGADVSGVLTVMTLGMFYAAAARTAFKGESQQSLHHFWEMVAYIANTLIFILSGAVIAQGVLSSDNIFENHGTAWGYLILLYVYVLVARGVVVGVLYPFLCYFGYGMEWKEAMILVWAGLRGAVALSLSLSVKRSSGDPAYLSTQTGTLFVFFTGGIVFLTLIINGSTTQFVLQFLGMDKLSKAKRRILEFTKYEMEKKALEAFGDLGEDEELGPADWPTVKRYIKSLNSIDGDRIHPHDASDNGFLDPMNLKDMRVRLLNGAQAAYWAMLDEGRITQSTANVLMQSVDEALDSVDHEPLCDWKGLKNSVHFPKYYRLLQGGIYPKKLVTFFTVERLESACYICAAFLRAHRTARGQLHDFIGYSEISSAVITESETEGEEARKFLEDVRTTFPEVLRVVKTRQVTYAVLQHLIEYIESLEKAGILEEKEMLHLHDAVQTDLKRLVRNPPTVKIPKIGELISMHPFLGALPSGVRDLLVGSTKEEVKVRGMTLYKEGGKPNGIWLISNGVVKWACKVKKNKHALHQTVTHGSTLGLYEVLIGKPYLCDMITDSVAVCFYIETEKILAALGSDPAVEHFFWKESVIVLAKVLLPRVFENMSMQDMRKLTAERSTLNTYLRGETIEVSSHSIGFLLEGFVKSHPLAEELIPSPAALWPAQGNSSFLSQEGSGYKSTSFLHQGTSYYVETRARVLLIDMVPIQADNTLLRRKSSLLLHDQSSRSLSSRDHAGLLSWPENQYKSYQHLPDGQEIDDSQNLSAKAMRLSIYGSTAKDVPVRGLSFQGYTLGNPSHVRSYPQVPIGQKQLPLTSVKSEGSNTVRKRLGEDVMREELLPPTHSRHPSRAVDDSSSESGGEDEVFVRIDSPSKLSFRQAP

SEQ ID NO: 38088 - protein, 545 aa, Physcomitrella patens subsp. patens
MAAVGIVDSGNHMAVVAVSLFVTLLCACIVLGHMMEEFQYISESVTAIFLGFCTGIVVLVTSSGASSHVLQFNEELFFIYLLPPIIFNAGFQVKKKSFFRNFVAIMLFGVIGVFISVAIITAGCKFMFPKLGLEKLVIGDYLALGTIFSATDSVCVLQVLNQDDSPLLYSLVFGEGVVNDATSVVLFRAVQKLALKHFTGMEVLQICGSFLQLFFSSTVLGVAIGLLSAYIIKTLYLARHSTDREIALMTIMAYLSYILAELFYLSGILTVFFCGIVMSHYTWHNVTESSRVTTKHGFATMSFIAETFIFLYVGMDALDVDKWNMVQITAGNYFGLFMTLIVLILVGRAAFVFPLSALSNYMRKSSDTKITFRQQIMIWWAGLMRGAVSIALAFNQFTSSGDAKSPEYAAAITITIGIVLFSLTVFGTATKPLMHWVLLPTSRSELGESEPNTPKDFAFADFHVPLLLGSSQQTGSPHPGPRRSSLAVLLSAPSNIIHDGWRSFDDGYMRPLFGGRGFVPYNTDVLTNAEDDAAYPFHSPFHSRS

SEQ ID NO: 38089 - protein, 338 aa, Leuconostoc mesenteroides subsp. mesenteroides ATCC 8293
MHSHFQGKSFLKEIDFTKKELETFIDLAAHFKYLKQNNIPHKYLEGKNIALLFEKTSTRTRSSFTVAANDLGAHPEFLGKNDIQFGKKESLEDTAKVFGSMYDAIEYRGFSQATVEGLATYSGVPVWNGLTDDWHPTQMLADFLTIKEQLGHIAGITLAYMGDGRNNVANSLLVTGAILGVNVHIVSPKSLQPSEEILNIANQKAAESGAKLLVTDDIDGGVNDVDVLYTDVWASMGEEDTFEERIKLLSPYQINATLVEKTNNEQVIVLHDLPAFHDLNTKMAQDIYDKFGIKEMEITDEVFHASYAHQFEQAENRLHTIKAVMAATLGNMFIPELN

SEQ ID NO: 38090 - protein, 156 aa, Wolinella succinogenes DSM 1740
MNVIEGKLNLTGNERVAVIASRFNHLITDRLVEGARDSFVRHGGKDEHLDLILVPGAFELPFALEKVLAQGDYDGVCCLGAIIRGSTPHFDYVSAEATKGIANVTLKYGAAVTFGVLTTDNIEQAIERAGTKVGNKGFEAMTGLIEMMNLYKNIGA

SEQ ID NO: 38091 - protein, 399 aa, Symbiobacterium thermophilum IAM 14863
MARWHGVIRQYQRFLPVSERTPVVTLLEGNTPLVPAPRLGAELGLDLYLKFEGLNPTGSFKDRGMTLAMSKAVEAGAKAVICASTGNTSASAAAYAARAGLPCYVVIPDGAVAMGKLAQALMYGARTIQIEGNFDDGLRLVRRLTQEHPEIALVNSVNPYRLQGQKTAAFEVVDALGGYPDFLAIPVGNAGNITAYWMGFQEYAAAGVGAVESCSSSGAPAGALLPRMLGFQAAGAAPLVHGGEVEDPQTVGTAIRIGRPASRAGALAAARESGGAFWAVTDEEMLAAYRRLAATEGIFAEPASCASVAGLIKLCRLGYFEGRTGSAGDVSGVGGFIDGVPAPVPTHRPFTGRGGRPKVVAVLTGHGLKDPDTAIRVSPLPEKLPADYGRLERLILSGS

SEQ ID NO: 38092 - protein, 412 aa, Arabidopsis thaliana
MPLEEILSRLPLKSTRAVRSTCKKWDSLFKNRSFISKAAAAREGESQMVVLMDHNLHLVSFFFGSDTSVEIKGKRICLNDDSDSEQVKISQVFHCEGLLLCILKDDNFSLVVWNPYWGQTRWIKPRCSFEIPQGCDMYRYAIGYDNKRRNHKILRFIDYEFHYPRDNVVLWYEIYDFESDLWTTLDVTTPHWLINCGNRGVTLKGNTYWCAKKRNSDLFLNADHIICFDFTSERFGPLLLLPFSDLDGVVTLACVREEKLAALVCHEDVVEVWITIKIEANEVLWSKFLTVNVDLGDEIPSSLTYGSFFIDEEKKVAMIFDKTLDRGDTVHIMGEAGYGGQVDLGEPVNKRRCPLVCSYVPSLVQIKKPAGFQRKQQSKLEKRQYVRNISKLRALKTQSSWTLSMSLECHQQ

SEQ ID NO: 38093 - protein, 394 aa, Wolinella succinogenes DSM 1740
MMGEALDKEYVLHSYGRNYVQFTQGKNATLWDSEGKDYIDFASGIAVCSVGHGNERLAGAICDQAKKLIHTSNLYYIEPQARLAEKLVKLSGYDMRVFFANSGAEANEGAIKIARKFGESHEGEVKRYKIITLESSFHGRTITALKATGQEKMHHYFGPYPDGFVYAKNLDHVFKLVDEKTCAVLLELVQGEGGIEPQDREGIKKLERFLKERGVLLMVDEVQTGIYRSGELFASQAYGIVPDVITVAKGLAGGVPIGAVMTTLKDIFAPGDHGSTFGGNFLSTRAGLEVLSILESLYQEGTLQKSIDRFSAELRALCVEFPSLFECEVGLGLMRGIRAKSAEIQKSVIDEAFKKRVLVLRSGRNTVRFLPPLTLSEREMQEGFSRLREALKGI

SEQ ID NO: 38094 - protein, 949 aa, Mycobacterium avium 104
MVDGAPTADPSEESTRSGDLPDRLRVHSLARTLGTTSKRVLDALSELDGRVRSAHSTVDREDAVRVRDLLAAQPSAELEPAAEDAASGGPDAGITGEPESRLLLETPDATERPHYMPLFVAPQPLESSDDDGDADETADSDDSDGDDDEQADRPSSRRRRRGRRGRGRGRGEQGGSDGPGDGDNDEPQNRGKKGGQSDGDDDSDGQDAEDADDSDTGDDGSADGGNRRRRRRRRRKSGSGDDNEDGPSPDDPPNTVVHERPPRNGKNGGDDGNGSSSSEIKGIDGSTRLEAKRQRRRDGRDAGRRRPPVLTEAEFLARREAVERVMVVRDRIRTEPPHQGSRYTQIAVLEDGIVVEHFVTSAASASLVGNIYLGIVQNVLPSMEAAFVDIGRGRNGVLYAGEVNWEAAGLGGSDRKIEQALKPGDYVVVQVSKDPVGHKGARLTTQVSLAGRYLVYVPGASSTGISRKLPDTERQRLKEILREVVPSDAGVIIRTASEGVKEDDIRGDVTRLQERWKQIEAKAIEIKEKAAGAAVALYEEPDVLVKVIRDLFNEDFAGLIVSGDDAWNTINEYVNSVAPDLVSKVTKYEPATGPDGTPGPDVFAVHRIDEQLAKAMDRKVWLPSGGTLVIDRTEAMTVIDVNTGKFTGSGGNLEQTVTKNNLEAAEEIVRQLRLRDIGGIVVIDFIDMVLESNRDLVLRRLTEALARDRTRHQVSEVTSLGLVQLTRKRLGTGLVEAFSTSCPNCGGRGILLHADPVDSAPSNGRKSESGGRRGRRKKSKAEEPVVAKVPVHSPGEHPMFKAMAAGSSTQAASDEDESAAEEAGDELERKKAARAEELEAAEDTEDLEDTEDDDEDSDDSDDSDDEDLDDEDIDDEEDLGDDDEDLELDDDDLDTEDSDDSDDSDDSEDSDDSEDQRDPAAECPGVSALGRPRRRRAAGRPAGPPIHAD

SEQ ID NO: 38095 - protein, 106 aa, Brassica napus
MTDQGLEGSNPVDLAEHPSGIVPTLQNIVSTVNLDCKLDLKAIALQARNAEYNPKRFAAVIMRIREPKTTALIFASGKMVCTGAKSEYFSKMAARKYARIVQKLGF

SEQ ID NO: 38096 - protein, 353 aa, Coprinopsis cinerea okayama7#130
MNLYQVLGVDNDVSAEDLKKAYRKKALEHHPDKNPDNPEAAHQRFAKVQEAFETLNDDQRRAGYDYDLALGAFKREEPTEEGPPEPTFVALWDPFLWLGVIIVFVSLSLRLVFKGATLAWRGASLLWKQLTLANAFSKPRSATSQSERFSPSRVQDPSSKLTHPFLRFDPVNYQTQKSRGWGTIDPDDITDYLIAFGQLPDNTTGKEILLRMGNLFQCIAMDEARLGGRKLPKLGDVSQPWCPGDLSFPHEPTKDYASDFYEQWRMFETRKDFSWIPVGGGFGLREKEMVGETKRVQAEVKTRYVEMVRKLATDFQQIDPRFIRYQTYLEQHGYTTKNADHQTSKSRKKGKKQ

SEQ ID NO: 38097 - protein, 728 aa, Coprinopsis cinerea okayama7#130
MITKRSVLSATLSLLAASSTVRSAAVYSKNDYVDNLFGSSSYSDRLASVASARTSPSPAAAASPAVTTSPATLFSAARTFSASTAASSSSVAEAVATTSIASDDSDDNSVDNAGNVGDGNSISGGDDDSASVGSVGDDVAVSSTGDEAAAPEDVDGAAPAPQPSAVIAAGSTSFPFVGSVATLNIGNANLSPDGFERPSSVVNGVFPAPLIKANKGDHFSLNVVNDMTDDTQFRATSIHWHGIYQKHTNWADGVAGVNQCPIGPGDSFLYQFDVPNQAGTFWYHSHFRTQYCDGLRGPLVIYDPEDPYRDLYDVDDENTVITIGDWYHLQSPSITGVASNDATVINGKGRYVGGPLVDLAIINVVPGKRYRLRIMAISCDPNYIFSIDGHQLTVIEADAQSTQPLVVDSIQIFAGQRYSAILTADQPIGNYWIRALPNSGNNNLFTGFIDGTNSAILRYAGAPIADPTTSAPDAPVLLDETLLVPLDTTPVPGQPFPGGADVNLLLNLDFNVDAWRFYVNNETFNPPTVPVLLQVMSGAVAAQDLLPAGSVYTLPPNASVEISIPGGVISSPHPFHLHGHSFSVVKSAGIDTPYNYVNPVKRDVVSTGDVGSNTTIRFFTDNSGPWILHCHIDWHLDLGLAIVLAEDPVGTPALNPTPQDWDDLCPAYDALDPSMTEIAVVATPSPLDPQVVSVPESYLATSTEAEDVTVTVTVTVTEGDDAAATDSS

SEQ ID NO: 38098 - protein, 519 aa, Ceriporiopsis subvermispora
MARFQTLSAAVALGLSLGAFAAIGPVTDLEITDAFVSPDGPGLGREAVLAGGTFPGPLIQGNKGDNFQINVVNNLTNHTMLKTTSIHWHGLFQHGTTWADGPAFVSQCPIASGNSFLYNFNVPDQAGTFWYHSHLATQYCDGLRGPLVVYDPNDPHADLYDVDDESTVITLSDWYHAAASTLTFPTFDTTLINGLGRFAGTGGSDSNLTVITVEQGKRYRFRLVSISCDPNWVFSIDQHELTVIEVDGVNAVPLTVDAIQIFAAQRYSFVLNANQTVDNYWIRANPNNGNMGFANGINSAILRYVGADDVEPTSTGTTANLLNEADLSPLVPAAAPGAPNQDFDAVDVPMNLNFTFNGTNLFINGATFVPPSVPVLTQILSGAMTAQELLPAGSVYTLPRNATVQLSLPGNIIAGPHPFHLHGHTFSVIRSAGQSDYNYVDPIQRDVVSIGGATDNVTIRFTTDNPGPWFFHCHIDWHLQAGFAIVFAEETADVASANPVPADWSALCPTYDALSDADH

SEQ ID NO: 38099 - protein, 779 aa, Debaryomyces hansenii CBS767
MAKGGHSHRSTLKNDHKPFKSKHASKGQLKNQYKGKVEKTGAGNGKANKVMSKTERKNAARQMKENKIHETKVIRKLFDGSQGAEKIVTVISLTKDISTQDIVSRLVNNVKEESDEEFVVGLPSVSSAKINRFKTNLKFIVPDQNNLLSILDAAKISDYVVFGISANEEVDKEYGEQILRALIAQGIASVIGVLPNVVSAYPKKNLQLDIRRSLFSFFTHFFPNEEKLYALEYDTECLNCIRTICQRFPKSVTWRDSRPYLLADKTSWMASENDASMGHIVVEGTVRGVGFNANRLVHIPGFGDFQVDRIEKLFKSRVNKKSEMDIDTEENDVFLPNENRETLEELNPEEIDMEGEEWDDEDEFGVRMEGKHYFEDGKDGGYSSRSKLPRGTSEYQGRWLLDDVLENASDLESEDEDIDVDIEQNNDDEMQMEDAQSEYAPTEAGDNQSEMFVDLPPEEEERQLHEFRESVKEDLEFPDELELDPSESAKERLASYRGIKSLGNCDWDYDEEDVEAPSIWKRLLRISNFKATRNKVCKDVIKDVQLNIGNKARIFIKAPSYVMEKVNCEQQPFVVYGLLEHEHKLAVVNFSFESWEDYDEPIPNKDTLIVQYGPRRQVIQPLFNQGSNNANNVHKSENYAHQGKLSIATCVAPVLFSNAPVIFFRQATDGSLQLVGQGTFLNCDHTRIVAERAVLTGHPVKIHKRVVTIRYMFFNPEDINWFKAIPLFTKTGRSGFIKESLGTHGYFKATFDGKLDALDTIAMSMYKRVWPEISTGWTD

SEQ ID NO: 38100 - protein, 264 aa, Dehalococcoides ethenogenes 195
MTVAELFDLSGKVAIVTGGAMGIGKGISMRLAEAGASIMIPDLNLEVAQKTAAEIKALGGKAAAIQADVSNISDAQKVVDATIKEFGDLNIMVNNAGIYRFMPAIDMTEAMWDKTLGINLKGLMFFSQAAAKAMIAAKHGGKIINIASIDGFRPTGNLSHYDASKGGVIMLTKAMAQEWAPHGILVNAVAPGGINTPGASALTPSGSMSTEQLMELSKSFVEKLPLKRMGEPDDIGKVVLFLASAAADYMVGGVIVADGGALLV

SEQ ID NO: 38101 - protein, 81 aa, Zea mays
MVANGDAPARGSAAAAASLRRRRTTSGAAAGGGGASSMLQFYTDEAAGRKMSPNTVLIMSIGFIAVVAMLHVFGKLYRTSN

SEQ ID NO: 38102 - protein, 234 aa, Methanosarcina acetivorans C2A
MTERNTSTDSPEKRAAGIAAAGLVSSGMLVGLGTGSTVAYTIKELGRRVREEGLDILGVVTSYQSEMLAIEAGIRLTTLAQHPELDLAIDGADQIDSELRAIKGGGAAHTREKIVSVSARRFVVVADESKTSKQLDKLVPVEVLPFAKEPVVKKIRELGGKPQLRSAVKKDGPVITDNGNFVLDVEFGVIKDPEALALQLSSIPGVVEHGIFCNVSELYIGNKDGAIKIITRQK

SEQ ID NO: 38103 - protein, 489 aa, Dehalococcoides ethenogenes 195
MKYQYDLVVIGGGLAGFTAAVFANGLGKKVAIVEKGKLGGACTWNACVPSKALLQLGLRIRQLNNYNRSGTKLASVNLQTENVMPYLHSVLENISRIDDFASLVNTGIDILNGEAVFNGRHQVSLNGQLISAKHFIIATGSSPAIPPVEGLSDIPYYTNETVFDIKAIPSSMIVLGGGPAGIELGLAFAWLGCKVDIIEMADRILPKDDTELSALLLEYLNAEENLNIHISTKAVRFQSQTDGSLKLEMQTREGKISEISSETVLVAVGRRANVAGLALEKAGVKYTPRGISINNRLQTSSSNIFAAGDVAGPIQLGMMAEKQAILAASNACLPFKQSIRYEDVAWVTYSEPQMAHIGLTEDEARRKYGNNVRVIRYPLTKVRRAVMDHDTRGLCKFILDKNDRLIGAHLLCSHAENLVHELQIVKCLNKPLSKLHTIPHIYPTYEEGIIKRAADISYTIKMQRNPFVRLVLRYWPGYKDRLDTVISRL

SEQ ID NO: 38104 - protein, 518 aa, Synechocystis sp. PCC 6803
MAGKTTGVVAAGHAQTAEAGKCMLEEGGNAFDAAIASVLAACVVESSLTSLGGGGFLLAQTAAKKSYLFDFFCQTPQVNPGEKAVDFYPVALNFGGAWQTFHIGKGAIAVPGMVAGLFAAHRKLGQLPFKVLIEPAVAYARQGFTLNRFNDFTNGLLEPILTQQEEGRKFYAPQGKILRQGEKAYLPQFADVLEQLARHGPDWFYRGELTEWVLESLGEASALTAKDWADYQVEIRLPLRAQYRQRQLLTNPPPSAGGILIAFALQLLEKYDLSQYPLGSAAQIQLFSQVMALSNQARRQYLDGNLHCGDIEAKFLGGDRLASELGQSKFINKLGSTTHISVLDGEGNAASLTSSNGEGSGHFIPGTGIMLNNMLGEEDLNPQGFYQWPPGQRLSSMMAPTILLDQEQPRLVLGSGGSNRIRSAILQVVCHHLDYQLPLAEAVGRERIHWEAHKLDLEPTSVADILAQLRFDDGTQGTLWTEQNMFFGGVHGVATTTAGTMEGVGDPRRSGAVAYSLE

SEQ ID NO: 38105 - protein, 441 aa, Ralstonia metallidurans CH34
MTHVFHRNPKQTLPVAVGGQGIELIDSNGRRYLDASGGAAVSCLGHGHPRVIEAIKAQVDTIAYAHTSFFTTEVSETLAQTLADAAPGDLDHVYFVSGGSEAVEAALKLARQYFVEIGQTQRRHFIARRQSYHGNTLGALAIGGNAWRREPFLPLLVPAHHVSPCYAYRDQAAGEADTQYAQRLADELEAKILELGPDSVAGFVAETVVGATAGAVPPVADYLKRIRAVCDKYGVLLILDEVMSGMGRTGYLFACEEDGVVPDIVTIAKGLGAGYQPIGAMLSTSRIYDAIIGGSGFFQHGHTYIGHATACAAALAVQRTIVEDKLLDNVLARGEQLRARLRESLGDHPNLGDVRGRGLFVGVEFVADRATKATLDPAKKTHAVLKRTCMEHGVLVYPMGGTVDGIHGDHVLFAPPFICTPTDIDNIVDRFTQAVKTVLPA

SEQ ID NO: 38106 - protein, 269 aa, Glycine max
MRAKLLVFPLRGRNWCFSRTIDHSLLSASHASSQSSPSTLKGLWTNINVRDKPLNAKAELFVDYIANKMNSVWIGLEKAPEGSFKNKIHGLGLRLLSRVKPSEIFLKSISKEITSVEIIYPSSLNAQLVRRRLRHIAVRGAIIHRKYFYGSVLLIPLSAACGILPLPNVPFFWVLFRTYSHWRALQGSEKLLQLVSDGNKTSNTYTQTEHKNSKSQSHSSNEPCWVLKPSKELDNLVRLEGLSQHAIVNICKIYDLNTKDVIKYQKSIF

SEQ ID NO: 38107 - protein, 427 aa, Oryza sativa Indica Group
MAGVSAASTAGKIGSFLSKRPYAPPSWASHLSPAPSQTFSLGHFPTPIHKWNLPNLPNGTEVWIKGRVVCLWSLASDTRVWGKLQRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTEVSDISLSKKSIRLNLYDKIQSRWLM

SEQ ID NO: 38108 - protein, 419 aa, Glycine max
MARAACNHLHLVPSLVHPLKSTLFTNHTLSTTRTRFYGIHRRFSSSSSKISMSLKAGIVGLPNVGKSTLFNAVVENGKAQAANFPFCTIEPNVGIVAVPDSRLHVLSDLSKSQRAVPASIEFVDIAGLVKGASQGEGLGNKFLSHIREVDSILQVVRCFEDNDIVHVNGKVDPKSDIDVINLELVFSDLDQIEKRIDKLKKGKAKDSQKLKEEAEKSALEKIREALMDGKPARSVTLTDFERDAVKHLCLLMKPVIYVANVAESDLADPANNNYVKDVTNVVSELQSRIVTISAQVEAELTELPVEERQEYLQSLGVSESGLGNLIRATYDLLGLRTYFTSGEKETKAWTILAGMTAPQAAGVIHSDFEKGFIRAETVSYEDFVAAGSLSAAREKGLLRSEGKDYVVQEADVMLFRFNV

SEQ ID NO: 38109 - protein, 831 aa, Oryza sativa
MQLPPLSLPHSLSPLKHSTNRRNISRPLLPGSVRSNQTYAPLSRSIDRSPGRRARCDEMVSAADAVIPACAAVGIAFAVWQWLLVSRVKVSPYSAAAAAARNGGAGRAVFRPEGEVDDDDGGCGDDEEADGDGGVAAMARCAEIQSAIRVGANSFLFTQYKYLAAFTAVFAVVIFLFLGSVHRFSTESQPCQYTRGKACKPALANAVFSTIAFLLGAATSVASGFLGMRIATAANARTTVEARRGIGPAFAAAFRSGAVMGFLLASLGLLVLYVAIKVFGLYYGDDWEGLYESITGYGLGGSSMALFGRVGGGIYTKAADVGADLVGKVERNIPEDDPRNPAVIADNVGDNVGDIAGMGSDLFGSYAESTCAALFVGSISSFGADHNFAAVSYPLLISSAGLIVCLITTLFATDLYRVKTVDGVAPALKLQLLISTVLMTVGVLVVTFTALPHEFTMFDFGEVKRVKNWHLFFCVTIGLWAGLAIGFTTEYFTSNAYSPVRDVADSCRTGAATNVIFGLALGYKSVIVPVFAIAVSIYVSFTLASIYGIAVAALGMLSTVATGLAIDAYGPISDNAGGIAEMAGMSHRIRQRTDALDAAGNTTAAIGKGFAIGSAALVSLALFGAFVSRAGMAVINVLSPKVFVGLVVGAMLPYWFSAMTMKSVGSAALKMVEEVRRQFAAIPGLMEGRATPDYASCVRISTDASLREMMPPGALVLLAPLVAGTFFGVQTLAGLLAGALVSGVQVAISASNSGGAWDNAKKYIEAGASDHAKALGPKGSDAHKAAVIGDTIGDPLKDTSGPSLNILIKLMAVESLVFAPFFAAHGGLIFK

SEQ ID NO: 38110 - protein, 360 aa, Ashbya gossypii ATCC 10895
MARNIDLKTVTDWSVLIGTGISLYYLLHRLFNDADGPLASVSKESREKQSTTWRRLVEANPELSRVHLNSYEQNALASVVTPQDIDVSFSDIGGLETIIDELTESVIYPLTTPELYTQHSLLEAPRACLLYGRPGCGKTMIAKALARESVANFLSIRMSSIMDKWYGESNKIVDALFSLANKIQPCIIFIDEIDSFLRERASSDHEVTAMLKAEFMTLWDGLTSNGRIIVMGATNRITDIDSAFLRRLSKRFSVPLPNEPQRRKILDVILENVEVDPQDFDIDYLVKATRGLSGSELKELCRDAALNAAREYIRQKRQLSAKDASYEGKPLKVRPLQTRDFLKNLKLDATQPFVTSVALD

SEQ ID NO: 38111 - protein, 326 aa, Leuconostoc mesenteroides subsp. mesenteroides ATCC 8293
MELFEQLKNKITGQNKTIVFPEGEDPRIQGAAIRLAADNLIEPILLGDAQEISKTAQAHNFDLSNIETIDPASYDENELAKLNATLVERRKGKTDAETAAKWLQNVNYFGTMLVYTGKADGMVSGAVHPTGDTVRPALQIIKTAPGSSRISGAFIMQKGEERYVFADAAINIDIDSDTMAEIAIQSAHTAQVFDIEPKVAMLSFSTKGSAKSPLVDKVATATALAKKLAPELADSIDGELQFDAAFVESVAAAKAPDSKVAGKANTFIFPSLEAGNIGYKIAQRLGGFEAIGPILQGLAKPVSDLSRGANEEDVYKVAIITAAQAL

SEQ ID NO: 38112 - protein, 109 aa, Oryza sativa
YYLDLKKKSKLSPFQYNLRCKRFFICLAAKSARLRQAKEEAEREIAEYRAQMEAEFQRKVAESSGDSGANVKRLEQETAEKIAQLKQQAASISPEVIQMLLRHVTTVKN

SEQ ID NO: 38113 - protein, 506 aa, Glycine max
MAKLHFAFSFSLLFLLSNASAAPSTTLPAKIVSGFLSNAVPAFTKWVWSLKAPTKTAIGAKSMMKFESGYTVETVFDGSKLGIEPYAVEVLANGELLILDSANSNIYRISSSLSLNTRPKLVAGSAEGYSGHVDGRLREARMNHPKGIAVDNRGNIYIADIMNMAIRKISDSGVTTIAGGKWSRGGGHIDGPSEEAKFSNDFDVVYIGSSCSLLVIDRGNQAIREIQLHFDDCAYQYENGLTLGIAMLVGAGFFGYMLALLQHRLGTIVASQDLEGAAMSGISPSPYQKPLKSVRPPLIPSEDESDKQEESFIRSIGKLLTNAGASVVEIMGALFPGFRKKPQSYEFQSQPLFQQPQKQVNAWPVQESFVIPDEDEPPSIDPRSPTPRKTYAFMSQDAEKMPQLWQSHAFYSGWGGDLQQQQQLKLQQQQQQQQLKHHRHLYHSSVPHTYYEQSHEEINEIVFGAVQEQEGKKETVVIKPVDYGQSLYDHHYIRPRNSSMGHINKY

SEQ ID NO: 38114 - protein, 298 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGHPL

SEQ ID NO: 38115 - protein, 129 aa, Candidatus Protochlamydia amoebophila UWE25
MAKCRQASMPYPKFSFYQIGFIEMIAKHVIFDDVEEHFCLDMYLSIFNSDEDDNEEIYDGDDEDDDEDDDDDDDDEDDDDDDDDDDEDYDDEDYDDEDDDDDDDDDDDDDEDFETEVEEENIFRFSLAA

SEQ ID NO: 38116 - protein, 282 aa, Schizosaccharomyces pombe 972h-
MSGFCVLGCGTMGKALLTGIFDSIAENGNDVSDEIIIPNKFYACVKFPKEKEDVQKLFGDRVKVVMGAKENAEMAAISNVLLLSCKPQAAEDVLNSPKMKEALKGKLILSILAGKTISSLQSMLDESTRVIRIMPNTASRIRESMSVICPGPNATEEDIKFAEWVFNGIGRSMKLPEKLIDAATAVCGSGPAFVATMIEAMTDGGVMMGIPFPQAQELAAQTMVGTGRMVLQGQHPAMIRNDVSTPAGCTISGLLALEDGKIRSTIARGIEQATKTASGLGK

SEQ ID NO: 38117 - protein, 176 aa, Leuconostoc mesenteroides subsp. mesenteroides ATCC 8293
MTVDLHDFVATVEDYPEPGVSFRDISPLMGDGVAYKQAVDAIADFAKHLNVDLIAGPESRGFIVGSPLAYAMNIGFVPARKGGKLPREAVSASYTLEYGGVNELEIHKDAIKPGQRVLIVDDLLATGGTINATREIIEKLGGIVAGVAFIIELESLQGREKIMKAGEVPFLALMEY

SEQ ID NO: 38118 - protein, 397 aa, Oryza sativa
  misc_feature (333)..(333): Xaa can be any naturally occurring amino acid
MDAMRQSTPRAMLLLCAVLMLAVAPPGAATAAAVAGCECGNAAAAAVAGEDARGALRLKLVAIASILAAGAAGVLVPVLGRSFAALRPDGDVFFAVKAFAAGVILATGMVHILPAAFDALASPCGGGRGGGGGFPFAGLVAMAAAMATMMIDSVAAGYYRRSHFKKPRPVDDPADAARAAGVEEGGAEHAGHVHVHTHATHGHAHGHVHSHGHGHGHSHGSAPAAATSPEDASVAETIRHRVVSQVLELGILVHSVIIGVSLGASLRPSSIRPLVGALSFHQFFEGIGLGGCIVQANFKAKATVIMATFFSLTAPVGIALGIAISSSYSKHSXSTALVVEGVFNSAAAGILIYMSLVDLLAADFNNPKLQTNTKLQLAVYLALFLGAGMMSLLAIWA

SEQ ID NO: 38119 - protein, 390 aa, Wolinella succinogenes DSM 1740
MYSHRIESLSESMTIAISTLARELQSKGKDVISLSAGEPDFETPQVIKDEAIKAIEDGFTKYTSVAGIPELLKAIQAKLARDNHLEYETKEILVSNGAKHSLFNIFQAIVEEGDEVIIPSPYWVTYPEVVTYCGGKNIFIETCDASGFKMSAAQLKAALTPKTKALVLTTPSNPTGSVYSRQELEAIAEVLKGTNVWVVSDEMYEKLVYGVEFTSVASISEDMLKRTITVNGLSKSAAMTGWRMGYLATKDKKLIKLMDNLQSQCTSNICSITQKASIPGLDGRIDPEVEKMRQEFERRRNFAVDALNAIKGLSVIKPEGAFYLFVNTKALELDSMQFCKDLLEEEGVAVVPGIGFGMEGYFRLSFATSMEKIEEGIKRIARFCEKRERA

SEQ ID NO: 38120 - protein, 131 aa, Brassica napus
MAAAARVRCHCNALFTSHRNSSTLPISPSRVGFTALKCPRKFLLSIGDGSSSCTRNVSGSCLKGTVRAVMEEEKTDVIKEREGDEKRFTCVMKFGGSSVATAERMREVADLILAFPEESPVIVLSGYGEDN

SEQ ID NO: 38121 - protein, 211 aa, Chlamydomonas reinhardtii
MAEAGGPVKVTLQQLGVATGEEYEGQLDMDIGHLTAFDPAPLDAARMTVDAAGTCAEAARGITQYVPKPKPLTRWQQFAAKKGIPGEDPFAALAAEKRERVKQNKANQLGNLKAAAKRAGASALPASLRLAATLPGENKKVGKGTDKSMRRKELKEDIKSASRLAGISTASIGKFDKRLKGEKPGERTPLGKRRNFASVTDTKSERTKMGG

SEQ ID NO: 38122 - protein, 562 aa, Thiobacillus sp.
MADTITLQIEGMTCDSCAVHAQQTLERVPGVRSASVSYPQRRAEIEVDARVGLDPLVAAVAALGYRARLPDTPNKPTGLLDKSLDGQGSETRRTGDGEALHIAVIGSGGAAMAAALKAVEQGARVTLIERGTIGGTCVNVGCVPSKIMIRAAHIAHLRQESPFDGGIVAAVPVIDRGKLLAQQQARVDELRHAKYEGILDGNPAITVLHGEARFMSGHSLNVQLNDGGECEVAFDRCLIATGASPAIPPIPGLKDTAYWTSTEALISDTIPERLAVIGSSVVALELAQAFVRLGSQVTILARGTLFLREDQAIGVAITAAFRAEGIEVLEHTQASHIAYADGEFVLATGHGEVRADKLLVATGRAPNTCSLNLEAAGVTINAQRAIVIDPGMRTNRPNIYAAGDCTDQPQFVYVAAAAGTRAAINMTGGDTILNLTAMPAVVFTDPQVATVGYSEAQARHDGIETDSRTLTLDNVPRALANFDTRGFIKLIAEKGSGRLLGAQVVAPEGGEVIQVAALALRARMTVQELADQLFPYLTMVEGIKLCAQTFTRDVRELSCCAG

SEQ ID NO: 38123 - protein, 477 aa, Propionibacterium acnes KPA171202
MRRAKIVNTLGPAVTSHDAMKELMEAGMNIARLNMSHGDYSEHQERLDLVRSVSKELGLNVAALADLQGPKIRTGLFEKAEGESNGKIDLKIGDKFTITTDDIVGNQERVSTTFKGLPQDCKPGDVILIDDGKTVLQVDSVSGNDVNCHCTVAGPVGDHKGINLPGVAVSIPALTKKDEENLRWALKAGIDLVALSFVRHGSDIDRVHEIMDEEGRTVPVIAKLEKPQAIENLDEIIDVFDAVMVARGDMAVECPLEEVPLIQKQIIEKARLQAKPVIVATQMLESMIHAPRPTRAEAADVANAILDGADGVMTSAETSVGDFPGETVRTMAKIVESTEARGLDKIAKIDWDPHTTSGIMSKAAAEIAERAEAKFIVAFTKSGDTARRIARLRPSTPLIVFTSDETTTKTLAWVWGAHAVVTPVFKNAEELYRWVNAYLRDKGFVPVGDRVVVLSGSPMDIPGKTNNLRILRIKEDD

SEQ ID NO: 38124 - protein, 110 aa, Burkholderia pseudomallei K96243
MTVLELNELVKAFEEKFGVSAAAVAVAGPAAGGAAAAAEEKTEFTVVLAEAGSNKVAVIKAVREITGLGLKEAKDLVDGAPKPVKEGVDKASADEAKKKLEDAGAKVELK

SEQ ID NO: 38125 - protein, 247 aa, Triticum aestivum
MAMAAAASPSKILIPPHRASAATAAASTSCDSFRLLCAPRGRRQRPRGLVARSAPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLM

SEQ ID NO: 38126 - protein, 471 aa, Mycoplasma gallisepticum R
MNTKYSYGKVYQVVGPVVDVVFEKQDDLPKIYDCLIIDEPNMKLHLEVAQLIGDDIARCIAMGPTEGLARNVKVTSTNQPISVPVGTEVLGRMFNVIGEPIDEKKPIDASVKRMSIHRPAPSFADQSNELEIFETGIKVIDLLIPYAKGGKIGLFGGAGVGKTVLVQELIHNIATGHGGLSVFAGVGERTREGNDLYYEMIEGGVIDKTALVFGQMNEPPGARMRVALTGLTMAEYFRDVNNQDVLLFIDNIFRFTQAGSEVSALLGRMPSAVGYQPTLAEEMGSLQERITSTKSGSITSVQAIYVPADDLTDPAPSTTFTHLDAKTVLDRNIASLGIFPAVNPLDSTSRLLDPSVVGIQHYQTARKVQMILQKFLELQDIIAILGIDELSEEDKLTVSRARKIRNFLSQPFFVAEKFSGNKGKYVPISETIKGFSEIVEGKHDDLPEQAFFYVGSIDEAIERAKTLTRNG

SEQ ID NO: 38127 - protein, 528 aa, Prochlorococcus marinus str. NATL2A
MASMISAEKRNPAIVILDFGSQYSELIARRIRETEVYSLVMSYTTSADQLRSLKPKGIILSGGPGSVYEEGAPYCDPEIFNLGIPVLGVCYGMQLMVHELGGSVKPAAGKAEYGKAPLEVDDPTALLTNVISGSTMWMSHGDSVQKLPKGFVRLAHTSNTLEAAIALHDKSFYGVQFHPEVVHSTHGMVVIRNFVYDICSCEPDWTTNLFIDEAVSQVQQHVGDKKVLLALSGGVDSSTLAFLLNKAIGPQLTCMFIDQGFMRKGEPEFLMSFFDEKFKINVEYINARERFISQLKGVTDPEQKRKIIGREFIRVFEEESLRLGPFDYLAQGTLYPDVIESSGTNIDPKTGERIAVKIKSHHNVGGLPKDLQFKLVEPLRRLFKDEVRKVGKSLGLPDEIVRRHPFPGPGLAIRILGEVTHEKLNCLRDADLIVREEINNAGLYNKIWQAFAVLLPVYSVGVMGDQRTYAWPIVVRCVSSEDGMTADWSRLPYAVLEKISNRIVNEVEGVNRVVLDITSKPPGTIEWE

SEQ ID NO: 38128 - protein, 627 aa, Staphylococcus epidermidis RP62A
MEAYKIEHLNKSYADKEIFNDLNLSISEHERIGLVGINGTGKSTLLKVIGGLDEDFTADITHPNQYRIRYSSQKQDLNGHMTVFEAVLSSDTPTLRIIKKYEEAVNRYALDQSDSNFNKMMEAQEEMDQKDAWDYNAEIKTILSKLGIHDTTKKIVELSGGQQKRVVLAKTLIEQPDLLLLDEPTNHLDFESIRWLINYVKQYPHTVLFVTHDRYFLNEVSTRIIELDRGKLKTYPGNYEDYIVMRAENELVEQKQQEKQKALYKQELAWMRAGAKARTTKQQARINRFNQLESDVKTQHTQDKGELNLAYSRLGKQVYELKNLSKSINNKVLFEDVTEIIQSGRRIGIVGPNGAGKTTLLNILSNEDQDYEGELKIGQTVKVAYFKQTEKTLDRDIRVIDYLREESEMAKEKDGTSISVTQLLERFLFPSATHGKKVYKLSGGEQKRLYLLRLLVHKPNVLLLDEPTNDLDTETLTILEDYIDDFGGSVITVSHDRYFLNKVVQEYWFIHDGKIEKIIGSFEDYESFKKEHERQAMLSKQTEQQNKHKHQPKKKTGLSYKEKLEYETIMTRIEMTETRLEDLEQEMINASDNYARIKELNEEKEQLEATYEADITRWSELEEIKEQ

SEQ ID NO: 38129 - protein, 399 aa, Ralstonia metallidurans CH34
MSTSPSRQSSLTEAPPRARDVVHALRASRIREVANAGIGLPDVLPFWFGESDQVTPSFIRDAASRALANGATFYNHNLGIAPLRAALSEYVTRLHGATPVDHIAVTSAGVNALMLAAQLVTGPGDRVVAVTPLWPNLVEIPRILGAAVETVTLDYGADGWTLDVDKLLAALTPGTRAVMINSPNNPTGWVMPRGAQQAVLDHCRRHGIWIIADEVYERLYYGDEGAVAPSFLDIAGRDERVIAVNSFSKAWLMTGWRLGWMVVPSSMMDDLGKLIEYNTSCAPSFVQEAGVVAVREGEAFTQDLVKRLRSARDHLVSALSALPGIDAHAPDGAMYVFFRLKGATDSLDLCKRLVRDAHLGLAPGSAFGDEGEGFVRWCYACDEARLDEGVKRLRGYLGR

SEQ ID NO: 38130 - protein, 640 aa, Bartonella quintana str. Toulouse
MKNMPVETTYRVLARKYRPQNFSDLIGQETMVRTLTNAFETGRIAQAWMLTGIRGVGKTTTARILARALNYKTKDIDQPTTVLNTLGEHCTQIIEGRHIDVIEMDAASHTGIDDIREIIEQIRYRPVSARYKVYIIDEVHMLSTQAFNGLLKTLEEPPPHVKFIFATTEIRKVPITILSRCQRFDLRRIETAVLSAHLCQIAKHENVKVEDQALSMIARAAEGSARDALSIFDQAIAYSNGNISAVAVRALLGLVDQARIIDLFEFIMKGDIVNALHELRSQYDAGADPLTILTELADFNHLVTRLRFTPEIAEDLSLTEVEHSRSLDFSKKLSVPVLSRNWQMLLKGLQEVSETTRPLQAAEMLLIRLAYTADLPTLDEALKKLTQEKTSLTIVENSSHQESTSVGNTTKIAAVNAHSFPRVSNASLNQPNLKTSFENQLNRSLQSEASLKVEIPESTNSPGIPKILETAQSVNLAENSANLPHLSTQITEEIFGPKTIIIDSLHDIIKLAEQYNEIPFKLLVKEFVHPVSFEPGHIILRLAENAPRSLARDIKKMLSQWTEKRWTITFVNEGGGPTLQEESMAVQKTLFSNAEADPDIAKILNHFPEAKIVDIRLNKQENDLDLLPNTFKNESDINDE

SEQ ID NO: 38131 - protein, 241 aa, Glycine max
  misc_feature (131)..(131): Xaa can be any naturally occurring amino acid
  misc_feature (153)..(153): Xaa can be any naturally occurring amino acid
  misc_feature (171)..(171): Xaa can be any naturally occurring amino acid
LTYLFLFCINNYTVLTTGYVYLGARTTDELIANADYIGTAGKGILAADESTGTNGMRLTSITVKNIEYNKRALKELIFTDPGVLKYFSGVILYEETLYHSTIASQPFVNVLNEAGELTGINVDKGTVELAXTNGETTTHGLDGLDQRCAKYYXAGARCAKWTAKLQIVPNXPSELSMHENSYGLLRYTGICQENRLITIVEPEILGERPHDIDKCSRVTEQLLTLCYKAMNDHHVLIEGTL

SEQ ID NO: 38132 - protein, 498 aa, Rickettsia conorii str. Malish 7
MNNPKNDNYLSELSKVIWPIERYENKKFLPMAFMMFCILLNYSTLRSIKDGFVVTDIGAEAISFLKTYIVLPSAVIAMVIYVKLCDILKQENVFYVITSFFLGYFALFAFVLYPYPDLVHPDPETIESWSVAYPNVKWFIRIVGKWSFASFYTMAELWGTMMLSLLFWQFANQITKTDEAKRFYSMFGLLANLALPVTSVIIGYCLHEKTQIVAEHLKFVPLFVIMITSSFLVILTYRWMNKNVLTDPRLYDPALVKEKKAKAKMSLIDSFKMIFTSKYVGYIALLLIAYGVSVNLVEGVWKSKVKELYPTKEAYTIYMGKFQFYQGWVAIAFMLIGSNILRKVSWLTAAMITPLMMLITGAAFFAFIFFDSVIAMHLTGILASGPLALAVMIGMIQNVLSKGVKYSLFDATKNMAYIPLDKDLRVKGQAAVEVIGGRFGKSGGAIIQSTFFILFPAFGFVEATPYFASIFFVIVILWIYAVKGLNKEYKVLVNKTEK

SEQ ID NO: 38133 - protein, 140 aa, Rickettsia conorii str. Malish 7
MTIQYTFSMIKPDAIKRNKIGQVNTYLENAGLKIVAQKMKFLTKYEAACFYDEHRARPFFNSLVEYITSGAVVLQVLKGEDAITLNRTVMGATNPAEAEAGTIRKDLGESIEANSIHGSDSENSAKREIEFFFNKSEIIE

SEQ ID NO: 38134 - protein, 342 aa, Mycoplasma gallisepticum R
MSKIKIGINGFGRIGRLVCRELLNHEDVEVVAVNDLTDAKTLAYLLKYDTAHGKLSHNVSSTDSEIVVGKQKIKVYSEKDPTQIPWKKHKVDLVVESTGRFLTQEAASAHLKGGAKKVVLSAPAKEKNVKTVVYNVNHTEIKPDDTVISAASCTTNCLAPLVKVLEDKFGIKVGYMTTVHAYTADQRLQDAPHSDYRRGRAAAFNMVPTSTGAAKAIGLVVPKATGKLNGIAVRVPTITGSLVDLTVKLEKDTTVEKINAAMKAAASESFLYSEDEIVSSDILNETHGSIFDSKLTSVLETNGEKLYKLYAWYDNESSYVSQLVRVAKYFAKQQPKKASAKK

SEQ ID NO: 38135 - protein, 305 aa, Halobacillus halophilus
MSYVRNVQSLIGHTPMIELTHSDIPNQARIFAKLEFMNPGGSIKDRLGLKLIEDALNRGLLKPGGTIIEATAGNTGIGVALAAVGKGYRVVFVTPEKFSQEKQTLMRALGAEVINTPTEEGMRGAIKKADELVNDIPDSFNLQQFNNQANPDAYYETLGPEIHTDLNGEIDIFLAGAGTGGTFMGTSRYLKEQNPAIKTVIVEPEGSVINGGKAGPHDTEGIGMEFLPFYMDTSYFDAIHTIPDSIAFQRVKELALNEGLLVASSSGAAFEAALREAEQAEPGARIVTVFPDSSERYLSQGIYEE

SEQ ID NO: 38136 - protein, 413 aa, Mycoplasma gallisepticum R
MINYNKKTLKDVDLKDKTVIVRVDFNVPIKDNKVIDDTRIVQALDTIKYLIEQNCKIVLLSHLSRIKSLEDISSKKKSLRPVYENLKTKLNNVKFLEENVGYDVVEAVKQLKHQEVLLLENTRYNDVDNQGEVVKKESKNSPELGRFWASLADVFVNDAFGTSHRAHASNVGIAANISQSCIGFLVQKELEALSKLTNNPQRPFVVILGGAKVSDKLKVIESLLKSADQILIGGGMVNTFNKAKGYHIGKSLFEPEMLETAKKILAEDKDNKIILATDQMVTKASTITDIKTAPAGKCVFAKDEAENEDFEALDIGDESIKTFKSYIAKAKSIFWNGPLGVFENPNYERGSYEIAKAISESDSYSVIGGGDSAAAANQFKLADKFSFVSTGGGASLTFMEQTVLPGIEAIQSK

SEQ ID NO: 38137 - protein, 568 aa, Yarrowia lipolytica CLIB122
MPIPPTQLHTQLANFHSNRDGEKTTTLAKPPKTTTPFQKLQNSSSNPLPCLPRLPQFFRINLWGNKLYQSAEIKLRRIHYSVRPSPLHPHKTMSISTLPLANIYAEPTKQQPRYDQLTKRFSELYAVSSPTLVRSPGRVNLIGEHIDYSHFSVMPMAIEDDVIMAFSVGGDSIEIANMEDDKFPAEKYNVPTADQVLTIDQTKTVWTNYFKCGHTVGRKHLRDSGEEVKPVGIKVLVHGTVPDACGLSSSAAFVVCSTLVTLLSQGMQEVSRELLTRLSITCEQLIGVNTGGMDQAASIYGQLNHTLLVDFAPTLKATPFQFPSTTPKTVFLVANTLVKSNKHETAPRNYNLRVVEITLAVNVLLKSLKGVTIPQNGNLNKGTLHGLMKAVDTDLHGLLDLVETLPKEPVTLQEVAGLLNVSEDDVKKQYFIFPVEFDTLALYSRAKHVVTEAIRVKEFQNLLSKGESDPRQLGKLMNESQKSCDQLFNCSCPAIDKVCDIVLNSGGFGSRLTGAGWGGSTVHLVEEAKLNNVIDALKKEYYSDMDGVDYDSAMVVTVPGEGCAIVDL

SEQ ID NO: 38138 - protein, 193 aa, Microcystis aeruginosa PCC 7806
MSPQFNFQENELEEADVITLWDEQGRSLDCYIENAYETDDLTYMLLVPVDTPVMILAWDEESEEEESDAFLIEDSEEIERIFADAKAVLAELDLLLKSTAHTLTVSGELPPLEEDNVLSLEIDSDEPSSSSEPEELQFLASFFSEDQKYSIYSPLAPLLFLAVGDGEGKVELVSPDDDGMGPILEELLFDELD

SEQ ID NO: 38139 - protein, 565 aa, Ralstonia metallidurans CH34
MSAGRCPTTVAVTAPVARQLPTWHCQVRHPLSLAVSADFSGFFAAAPRRRTPQTMTRTPAKPDYLKKILTAKVYDVAQETELTYAPALSARTGNAVWFKREDTQPVFSFKLRGAYNKMASLTPEELKRGVIAASAGNHAQGVALAAARMQCKAIIAMPTTTPQVKIDAVRERGGEWVQIVLHGESYSDAYLHAAELEKKHKLAFIHPFDDPEVIAGQGTIAMEILRQHPGPIHAIFVAIGGGGLISGIAAYVKAVRPEIKVIGVQTFDSDAMKRSVDAGKRVELKDVGLFSDGTAVKLVGKETFRITRELVDDIILVDTDAICAGLKDVFQDTRSILEPAGALAVAGLKAYAEREKLKHQHLVAIACGANMNFDRLRFVAERAEVGEAREAVFAVTIPEERGSFKRFCEQVGTRSVTEFNYRIADKGVAHIFVGVQIASRAESDKIAANFRRHGFDTLDLSNDELAKQHIRYMVGGHSPLAHDELLYRFEFPERPGALMKFLSSMSPNWNISLFHYRNQGADTSNILVGIQVPKNEKRAFRSFLSTLGYVHWDETDNPVYKLFLS

SEQ ID NO: 38140 - protein, 296 aa, Pennisetum glaucum
IIESVGEGVTDVAPGDHVLPVFTGECKECPHCKSAESNMCDLLRINTVRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 38141 - protein, 427 aa, Dehalococcoides ethenogenes 195
MTGMETEIYFKFILSFGLILLVARLGGAFAERFLKQPAVIGELLAGIIISPFLLGHFLFANDPVILNFALIDGVFSQNGEHLSEFAPMEIISQIAVVVLLFVAGLETNVASFIKNSFTGAMVAIGGVVVPFALGVFGAMYFFPDLHIAGWLFIGAILTATSIGITVRILMDMGKLSSREGTIILVAAVVDDIIGLVILSVVISMAQSGSINALSAIGTGVIGFAVWLGILLLGVYGHKYISKYILTPFKASGTMPVMALIVGLLVSYMVTLVGLHPVVGAYVAGLMFASTAEKEEILHQTRPIMLFIAPFFFAYLGMQVDLKEVWAVIVPALVIVVLAIIGKIIGCYFPARFVGKTSHKGALIVGVGMVPRGEVGLIVAGAGLIAGAITRDLFGIAVAVSILTTLVMPLMIKPLFKPKAEANGKELP

SEQ ID NO: 38142 - protein, 382 aa, Synechocystis sp. PCC 6803
MISCHSFTMTPSAPNSTVLPSATPVCPQSSACRWRGLIETYRPYLPVSDQTPVVTLLEGNTPLIPAPAIAKRIGKDVRVFVKYDGLNPTGSFKDRGMTMAISKAKEAGAKAVICASTGNTSAAAAAYARRAGLRAFVIIPDGYVALGKLGQALIYGAEVIAIDGNFDDALTTVRQLSEHYPVTLVNSVNPYRLEGQKTAAFEIVDVLGQAPDWLCIPVGNAGNITAYWMGFCQYKELGKGDRLPRMMGFQAAGSAPFIQGQPISHPETLATAIRIGNPANWDKAWAASRESNGEFHPVTDAEILEAYRILAAEEGVFCEPASAASVAGLLKQKDQVPAGATVVCVLTGNGLKDPDCAVQNSGNQVKAGLKPDLEIVAKAMGF

SEQ ID NO: 38143 - protein, 239 aa, Ashbya gossypii ATCC 10895
MRSQMLALGRAARCVARRGLHIKTLTTPNENALKYVSTDGELLQERGAPSVEIRNFDMELIRQAPLAEKLFAQVPGVEAVMIGDDFVTVSKDAELGWAQVTPRVLEVLTQQLASGQAAVQGQVAVGGTERFQYDEEEQEISDTIEEIIQTRVRPAIMDDGGDIQYRGWDPETGRVYLKLQGACKSCSSSEVTLKHGIESMLKHYVEEVSGVEQVLDVEEQVALHEFGRLEERLRARTSK

SEQ ID NO: 38144 - protein, 208 aa, Dehalococcoides ethenogenes 195
MKKIYDLSPEIRPEMISWPGDGPPQIKLLHSIRGGFPTNLGQLTMTLHNGSHIDAPLHFFEDGDGVGEIPLEILIGNVRVLCFSGVKTITRDMLEQAELRGVTRLILATDNETLWDKPDFDRNYTYIDIGAARYLTEIGIRLLGIDYLSVEDFEETQGVHKHLLSRGVVILESLQLAGVAEGDYELFCLPLKLGKVDGAPARVILIER

SEQ ID NO: 38145 - protein, 315 aa, Triticum aestivum
  misc_feature (62)..(62): Xaa can be any naturally occurring amino acid
MAEHLASIFGTEKDRVNCPFYFKIGACRHGDRCSRLHNKPSVSPTLLLCNMYQRPDMITPGXVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSGRSHSRSSRSPSPYRHHARDRDRSSRSRDRGDYYGGSLDRGDYGDYYHHSRRSSERNRNYDSDGSRCRRHRSRTRSPVREGSEERRAKIEQWNREREAPARQGSEERRAKIDQWNRERETAQA

SEQ ID NO: 38146 - protein, 296 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 38147 - protein, 352 aa, Schizosaccharomyces pombe 972h-
MLSREEQNRCFVPVRRILDNEDLKLFKEGDAYKLIDSFICDLDEAVKDKPISASIPQSSSIEHVLNILDRVGEIKQENPAIDNMGSRFGNPAFQSFYDQVYIETPKLHQVFGIEHNAAMEAGRYFYESFGNRKRIDYGSGHELYFMSWLLILKQLGIFTKNDYPALVVRVFVKYVELMRSLQIFYTLEPAGSHGVWGLDDFHFLPFLFGAAQLVNHKYLRPKHVRDPEILEMCRADYMYLGYVYFLNKLKPSVSLRFHSPMIDDISAVKTWSKVNEGMIKMYRAEVLGKLPIMQHYLFGHLIPASPGMSPAPQDGDDSEVTHVHSHYADCCGIKIPSAISAAKNNGSRIPFD

SEQ ID NO: 38148 - protein, 344 aa, Oryza sativa Indica Group
MAGATAATPMDIDAAAPPPGAAAKGKAPLSSTPGGRAAPWVEKYRPQSLGDVAAHRDIVDTIDRLTNENRLPHLLLYGPPGTGKTSTILAVARKLYGSQYGNMILELNASDERGIDVVRQQIQDFASARSLSFGAKQSVKMVLLDEADAMTKDAQFALRRATSSNLPHLTVIEKHTRSTRFALICNHVNKIIPALQSRCTRFRFAPLDGTHVRERLKHIIQSEGLDVDDGGLTALVRLSNGDMRKALNILQSTHMASKQITEEAVYLCTGNPMPKDIEQIAYWLLNESFSTSFKCISDMKMRKGLALVDIIREMPSDVRIKLINDLADIEYVLFSAVKLITCQI

SEQ ID NO: 38149 - protein, 296 aa, Pennisetum glaucum
IIESVGEGVTDVAPGNHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 38150 - protein, 296 aa, Pennisetum glaucum
IIESVGEGVTDVAPGNHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVWLGCRCAGGCATQGCRVQDSPNELPEREDPEGNLLWQLQATHWPAQCGGAVYEEVEKFITHSVPFSEINKAFDLMAKGGGH

SEQ ID NO: 38151 - protein, 576 aa, Zea mays
  misc_feature (115)..(115): Xaa can be any naturally occurring amino acid
  misc_feature (277)..(277): Xaa can be any naturally occurring amino acid
  misc_feature (302)..(302): Xaa can be any naturally occurring amino acid
MGGGGAIVHGFRRWFHRRSGSTSNQSSIAGDGEGEADGGSPDLEIVDDPDLLGLRAIRVPKRKMPLPVESHRKDSVEMEFFTEYGEASQYQIQEVIGKGSYGVVAAAVDTRTGEXRVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSRYTPXAIDIWSIGCIFAELLTGRPLFPGKXMLYNHLDIITDLLGTPSSETLSRARRYLSCMRKKYPVPFTHKFRNADPLALRLLERLLAFDPKDRPTAEEALADPYFASLANVEREPSRHPISKLEFEFERKKLAKDDVRELIYREILEYHPQMLEEYMKGGEQISFLYPSGVDRFKLQFAHLEEHYSKGERGSPLQRKHASLPRERVVVSKDGNTEQQINDQERSADSVARTTVSPPRSEDADMDDVKPTSLSSRSYLKSASISASKCVVVRNKHPEPEDDGIPEEMEGTVDGLSEKVSRMHS

SEQ ID NO: 38152 - protein, 151 aa, Brassica napus
  misc_feature (6)..(6): Xaa can be any naturally occurring amino acid
  misc_feature (12)..(12): Xaa can be any naturally occurring amino acid
  misc_feature (16)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(32): Xaa can be any naturally occurring amino acid
  misc_feature (38)..(38): Xaa can be any naturally occurring amino acid
  misc_feature (55)..(55): Xaa can be any naturally occurring amino acid
  misc_feature (58)..(58): Xaa can be any naturally occurring amino acid
  misc_feature (68)..(68): Xaa can be any naturally occurring amino acid
  misc_feature (77)..(77): Xaa can be any naturally occurring amino acid
  misc_feature (80)..(80): Xaa can be any naturally occurring amino acid
  misc_feature (85)..(85): Xaa can be any naturally occurring amino acid
  misc_feature (87)..(87): Xaa can be any naturally occurring amino acid
  misc_feature (92)..(93): Xaa can be any naturally occurring amino acid
  misc_feature (97)..(97): Xaa can be any naturally occurring amino acid
  misc_feature (102)..(102): Xaa can be any naturally occurring amino acid
  misc_feature (104)..(104): Xaa can be any naturally occurring amino acid
  misc_feature (106)..(106): Xaa can be any naturally occurring amino acid
  misc_feature (108)..(109): Xaa can be any naturally occurring amino acid
  misc_feature (115)..(115): Xaa can be any naturally occurring amino acid
  misc_feature (125)..(126): Xaa can be any naturally occurring amino acid
  misc_feature (130)..(130): Xaa can be any naturally occurring amino acid
  misc_feature (135)..(135): Xaa can be any naturally occurring amino acid
  misc_feature (142)..(143): Xaa can be any naturally occurring amino acid
  misc_feature (146)..(146): Xaa can be any naturally occurring amino acid
MASSMXSSAAVXTSPXQAXMXAPFXGLXSSAXFPVTRXANNDITSIASNGGRVSXMKXWPPVGKKKFXTLSYLPDLXEVXLGKEXYXLLRNXXIPCXEFELXHXFXYXXHGTTPXYYDGRYWTMXXLPLXFGCTXSAQVLKXXQEXKRSTL

SEQ ID NO: 38153 - protein, 292 aa, Rhodobacter sphaeroides 2.4.1
MKVFVIGNVALDETLSIEDFPRPGASIFGAALSRDLGGKGANQAVAMGRTGLACIFVSAVGQGPRGQEIAQRLAQEPLEAELVALEGVATDISIVLMSARGENAIITTREAASALTPEAAAAALARGQTGDLLVLQGNLSAAATQAALRAARDAGMRTAFNPSPLQPYFGTLWPLVDTVFLNEGEAEALGGVESLLAQGVGEIVLTLGAQGAELIRTTERTRVPAHPCAVVDTTGAGDCFMAVALASAALRGTRLDARALNHAARAAAHTVGRAGTVAAFPNRAEMAAILAT

SEQ ID NO: 38154 - protein, 482 aa, Vibrio angustum S14
MTFSFGGLFKQQAFINGQWSDAFSGKTVNITNPATNEVIGHVPLMGVEETNIAIDAADKAYRLWSKTTAKHRSLILRQWYELIVSHSDELAHILTAEQGKPLAEAKGEIAYAASFVEWYAEEAKRLNGEIIPSHKEDARILVSRQPVGVVAAITPWNFPAAMITRKCGPAFAAGCSVVLKPAPDTPYTAFALAELAHRAGIPAGLFNVITGDAVKIGAELMSNKRVRKVSFTGSTAIGKLLMAQSAATVKKVSLELGGNAPFIVFDDADLSRAIDGVMVSKFRNAGQTCVCTNRIYVHSDVYQQFVEKLAEKVSALTVGNGVDNGVTIGPLINRAAVEKVEKHINDAMMKGANLVIGTREASTNCFVQPTVLSNVTDNMLVASEETFGPLAAVFKFTDEQDVITRANNTDSGLAAYVYTQSLSRAFRVSEALEYGMVGVNEGLISTELAPFGGVKESGIGREGAHQGLEEYTEMKYTLMGGL

SEQ ID NO: 38155 - protein, 362 aa, Burkholderia pseudomallei K96243
MATPQFHPLRIRDVRPETADAVTVSFEVPPELRDAYRFTQGQFVTLKAHVDGEETRRSYSICVGTTDYDRDGELRIGIKRVRGGRFSNFAFDTLKPGHTIDVMTPDGRFFTHLNAGHGKQYVAFAGGSGITPVLAIVKTTLELEPRSTFTLIYGNRSVDSIMFVEELEDLKNRFMQRLALYHVLSDDVQDVELFNGVLDQAKCAAFLDSLVPAATIDEAFICGPAPMMDAAEAALAAAGVPRERVHVERFGTPLPQAGAPAVEITADTPAADLEIVLDGKKRKLRLPYEGASLLDVGLRAGLALPYACKGGVCCTCRAKVLEGEVRMEKNYTLEPQEIADGFVLTCQCHPVSEKIVVSYDER

SEQ ID NO: 38156 - protein, 318 aa, Gibberella zeae PH-1
MVQFGSRANTNMTGLPTEQAVEDRRVGNPKRDRMRNALVIVLGEFCGTFMFLLLSFIGAQTALVTNSPSDAGSPLLPFSLMYIAASFGTALAVNVWIFYRVSGGMFNPAVTLGLVLVGAVTPIHALLIIPTQLVAAITAAGITDALLPGKLLVTNALGNGTSVAQGVFIEMFLTSQLVLTVYFLAVEKHRSTHLAPIGIGISVFIAHICATNWTGTSINPARSFGPSVVAGFHGYDWIYYIGPFMGSLLAFGCYKIFKVLEYQTANPGQDDDNLDRSGHHHFFGHRKEPMPHTHTDNIEPKDHGVPQRNDSVIDDQMV

SEQ ID NO: 38157 - protein, 210 aa, Escherichia coli
GALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRA

SEQ ID NO: 38158 - protein, 332 aa, Streptomyces lividans
MPQHEQPPTNAAPRRVVVTGSAGFIGSHLAHALVRAGTTVIGVDRRDPATDPTAAANLAGLRGRPGYHHVTADLLHCAIDPLLIDAEAVFHLAGIPGVRPSWGPQFGDYLASNVLATHRVLEASTRIGVPRLVVASSSSVYGPTDGDASRETDRPNPASPYAVTKLAEEQLCLAYAERPVGPGVVALRYFTVYGPRQRADMFTHRALYAALAGQPLRLYGDGHQRRDFTYIDDVVAATIAAGVVPNAHGTINVGGGSNASLLDVINIANSLTGREIQLHQDHVRNGDVLLTRADPGRAKEVLGWQPRVDLHNGLRAHMQALTAPLPDYSRAA

SEQ ID NO: 38159 - protein, 417 aa, Glycine max
VTADFNGVEGCTIAGKKNDRVINEDLLKDEIVSEQLTRNVQFFGFESQQKVTASYVVVIGLGGVGSHAASMLLRSGIGKLLLVDFDQVSVSSLNRHAVATRADVGISKAQCLKEHFLSIFPECQIDAKVMLYDSSTEEEILSGHPDFVLDCIDNIDTKVALLAACVRRGLKVLSATGAGARADPTRIRIADLRESTNDPLSRAVRHRLRKDYGIEGGIPVVFSLEKPKAKLLPFKGPSGEEENPSDYQIVPGFRVRIIPVLGTIPAIFGQFMASYVVTELAGVHVQTEPVVNFNMDHYHILHQRLIEHEESLYGTYMEVQVDVEEVMYIVKELWHGRSAREQHVKDVGRGMWRSVNELMLVRWDRTKPASISNLILLKFKEVDEHESRTLDDIKKNEPEFYSRVIAVLKRAELDFGL

SEQ ID NO: 38160 - protein, 354 aa, Bacillus subtilis subsp. subtilis str. 168
MTMKQFEIAAIPGDGVGKEVVAAAEKVLHTAAEVHGGLSFSFTAFPWSCDYYLEHGKMMPEDGIHTLTQFEAVFLGAVGNPKLVPDHISLWGLLLKIRRELELSINMRPAKQMAGITSPLLHPNDFDFVVIRENSEGEYSEVGGRIHRGDDEIAIQNAVFTRKATERVMRFAFELAKKRRSHVTSATKSNGIYHAMPFWDEVFQQTAADYSGIETSSQHIDALAAFFVTRPETFDVIVASKLFGDILTDISSSLMESIGIAPPANINPSGKYPSMFEPVHGSAPDIAGQGLANPIGQIWTAKLMLDHFGEEELGAKILDVMEQVTADGIKTRDIGGQSTTAEVTDEICSRLRKL

SEQ ID NO: 38161 - protein, 151 aa, Prochlorococcus marinus str. NATL2A
MTLERTFVAIKPDGVQRGLIAEILGRFETKGFKLVGLKQLTPSKELAEKHYGVHKDRPFFSGLVDFITSGPVIAMVWEGEGVIASARKLIGATKPLEAEPGTIRGDLAVNIGRNVIHGSDGSDTAVFEINLWFQENELVDWNPSDQAWRVE

SEQ ID NO: 38162 - protein, 505 aa, Frankia sp. EAN1pec
MTELTTRTRITVAEQPRPPRDPRERLARLLDPGTLTVIPHSPPCRVTVSHGRVDGTDVIAYCTDATSMGGAIGAAGARRIADAIDRAVAERIPVIGLWHSGGASLGDGVEALDGIGQMFAAMIAASGRVPQVSVVLGPAAGGAAYGPALTDVIVMAPEGKVFVTGPDVVRQVTGEQIDMDGLGGADAHGRRSGVVHVAARSEADAYLRARRVTTLLAAPGAFDLAATRDGRDPGSLLPDNPRRAYDIRPVVRAVLDGAVAPGGPAGSGTGTNPDGGSGAAHQTGLADDDYVELQPRWAPNVVVALGRLSGHSVGVIANNPLRKGGCLDSLAAEKAARFVRMCDSFGLPLVVLVDVPGYLPGVGQEWEGVVRRGAKLLYAFAEAVVPRVSVVLRKSYGGAYIAMNSRSLGATTVLAWPQAEVAVMGAEAAVGILHRRALAAAAPDELAALRTTLANEHTRTTGGLSRAISLGVIDRVIEPANTRRELTLALATAPGDRGTHGNIPL

SEQ ID NO: 38163 - protein, 118 aa, Schizosaccharomyces pombe 972h-
MTIWNVAALTGLLSVGLGAYGSHGLQKRVQDPHLLKSWSTACTYLMFHSLATMAVSLHPVYGKSRWTGPLLITGSCLFSGTIYGLCLLPKGHSLRRILGPLTPIGGLVMLTGWATMLV

SEQ ID NO: 38164 - protein, 445 aa, Kluyveromyces lactis NRRL Y-1140
MGKSTDKKVSKKVSKKDLKLKKKQDEKKVKAVEPESSSDSSSDSSSDSSSDSSSDSSSDSDSSSSSDSSDSSDEEEEPKKETKKEESSSDSESSSDSDSESEKEEAKKEESSDSDSSSDSSSDSDSDSDEEEEKKEEKKKEESSASSSDSDSSSDSDSSSDDDEEEEKSSNKRKADDDEEKSESKKPKTELAGEPATIFVGRLSWSIDDEWLKTEFEPIGGVISARVMYERGTDRSRGYGYVDFEDKSYAEKAIKEMHGKEIDGRPINCDMSTSKPAGAPRDDRAKKFGDVPSEPSDTLFLGNLSFEADRDNLYEIFGKYGEIVSVRIPTHPETEQPKGFGYVQYGSIEDATKAFEGLQGEYINNRPVRLDYSIPKQNFGNNQRGGFNRGGSDRGGRGGRGGSRGGRGGFGGNRGGREFSSGSNASPLGATRQTASFQGTKKTFD

SEQ ID NO: 38165 - protein, 313 aa, Candidatus Protochlamydia amoebophila UWE25
MSFCHQPLLFAGSSHPILATEIAQQLKISLGQMQLSKFPDGEIGVQLLESVRGKDTFVLQSIALDPNFYLMELLIIVDALKRASARNIVAVIPYYGYCRQDRKDKFDVSITAKLVANLLVEAGITRILTMDLHVDQLQGFFDIPVDHLSGRQLLIDELQKLDLTNSIVVAPDIGSVKTARTFASQLSVDFAIVDKHRKSAIEVVDYHLIGDVNGKDVLLADDICSTGATLMSAAKACQEKGANRIFAAFTHGLLVDDSVKQIENSLLEIVWMTNTIPHTKRLKEASKLKTVSIASLLTHAIQCIVSDESISSL

SEQ ID NO: 38166 - protein, 365 aa, Stylosanthes humilis
MGSTGETQITPTVVSDEEANLFAMQLASASVLPMVLKSAIELDVLEIIAKAGPGVHLSPADIAANVPTTNPDAAVMLDRMLRLLACYNILNHSLRTLPDGKVERLYGLAPVAKFLVKNEDGVSLSALNLMNHDKVLMESWYYLKETVLEGGIPFNKAYGMTAFEYHGTDPRFNKVFNKGMNDHTTITMKKILEIYTGFEGLKSLVDVGGGVGAVVNMIVTKYPHIKGINFDLPHVIEDAPSYPGVEHVGGDMFVSVPKADAVFMKWICHDWSDEHCIKFLKNCYDAVPDNGKVIVAECILPVAPDSSLATKGVVHIDVIMLAHNPGGKERTEKEFEALAKAAGFQGFRVVCCAFNTYIMEFLKKP

SEQ ID NO: 38167 - protein, 521 aa, Xanthomonas axonopodis pv. citri str. 306
MTNIHTDKILILDFGAQYTQLIARRIREIGVYCEIWAWDHDPSEIAGFGAKGIILSGGPESTTLPGAPVAPQEVFDSGLPVFGICYGMQTLAAQLGGATEAADQREFGHAEVDVVAADALFAGLTDHAGASRLNVWMSHGDHVSQVPPGFTITATTDRIPVAAMSNEAKRWYGVQFHPEVTHTLQGQTLLRRFVVDVCGCQTLWTAANIIEDQIARVREQVGDDEVILGLSGGVDSSVVAALLHKAIGDKLTCVFVDTGLLRWQEGDQVMAMFAEHMGVKVIRVNAADRYFAKLEGVRDPEAKRKIIGNLFVEIFDEESNKLANAKWLAQGTIYPDVIESAGSKTGKAHVIKSHHNVGGLPEHMKLGLVEPLRELFKDEVRRLGVELGLPRTMVYRHPFPGPGLGVRILGEVKREYAELLAKADAIFIDELRKADLYDTTSQAFAVFLPVKSVGVVGDARAYEWVIALRAVETIDFMTAHWAHLPYDFLGTVSNRIINELRGVSRVVYDISGKPPATIEWE

SEQ ID NO: 38168 - protein, 355 aa, Wolinella succinogenes DSM 1740
MDLQKFREEIDSVDDQILRLLNQRMEVVKLIGRHKKMEGSVIYRPEREREIIARLNSLNQGLLNEAAIEAIYLEIFAVSRNLELPERVAYLGPLGSYTHQAAESRFGAMSEYLSMNNIASVFKTVESKRAKYGVVPIENNKNGIVGETLDLLGKSSLKIVAELTMPIHHTFATQCDSLKEIRRIYSKDIAFGQCLNFLSEYNLEEVERIPVDSTAKAAQLAASEPHTAAICSHIAAKLYHLPILFENIEDSSHNKTRFVIISDFKNQASGSDKTSIFADISHTDKPGALLGLLKDISGLGLNMTKIESRPRIDAAKDFAFCFFIDFEGHIDDENVQELLKRRGDEIKWLGSYVRG

SEQ ID NO: 38169 - protein, 616 aa, Xanthomonas axonopodis pv. citri str. 306
MSQPAESSELINVVVLLGAAVVAIPVFRRLGLGSVLGYLAAGLAIGPFGLGLFNAPQAILHVAELGVVMFLFVIGLEMRPSHLWSLRKEIFGLGALQIAVCALALTGVGMLLGFALPVAFVAASGFVLTSTAVVMQLLAERGDVALPPGQKIVAILLFEDLLIVPLLAIVAWMGASGDPQAASQRWQGIGIGLACIVGLLVAGRWLLNPLFRILAASKAREVMTAAALLVVLGAALLMQVGGLSMAMGAFLAGVLLSESTFRHQIEADIEPFRGILLGLFFLGVGMSLDLRVVAADWRLIASGVLALMVGKGACIYGVARLMRSDHRQALDRGVLMAQGGEFAFVLFAAASASGVINAQVNASLTAIVVLSMALTPLFVLLQRRLTPAAAVSLDGVEAASGQTGSVLIIGFGRFGQVASQSLLARDVDVTIIDNDIEMIQSAEEFGFKIYYGDGTRLDVLHASGAHSARAIAVCVDNQEAANRIVELATREFPHAKLLVRSYDRQHSLQLVAAGVDYQIRETFESAVIFGKVALVELGVDEDEAGMISREIRRRDAERFELEIAAGDARAGARLMYGNTVPTAPRPTPFTRPRRGSRTLNPDAVPQAGQVETQTRD

SEQ ID NO: 38170 - protein, 297 aa, Xanthomonas axonopodis pv. citri str. 306
MSQRIRKAVFPVAGLGTRFLPATKTVPKEMLPIIDKPLIQYAVDEAIQAGCDTLIFVTNRYKHSIADYFDKAYELEQKLERAGKLEQLELVRHALPDGVRAIFVTQAEALGLGHAVLCAKAVVGNEPFAVLLPDDLMWNRGDAALTQMANVAEASGGSVIAVEDVPHDKTASYGIVSTDAFDGRKGRINAIVEKPKPEVAPSNLAVVGRYVLSPKIFDLLEATGAGAGGEIQLTDAIAELLKEEQVDAFRFEGRRFDCGAHIGLIEATVHFALEHEKHGGPAKEILREALAQADVRG

SEQ ID NO: 38171 - protein, 403 aa, Triticum aestivum
  misc_feature (40)..(40): Xaa can be any naturally occurring amino acid
  misc_feature (226)..(226): Xaa can be any naturally occurring amino acid
EISSRFRFRFRSENSPGERARWRPPGRLIKCKAAVAWEAXGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGSWAHPINVAKPPKGSTVAIFGXLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 38172 - protein, 756 aa, Burkholderia pseudomallei K96243
MDEQLKQSALAYHQNPKPGKISVTPTKPLSNQLDLSLAYSPGVAAACEAIHADPLDAQKYTSRGNLVGVVTNGTAVLGLGNIGPLAAKPVMEGKGCLFKKFAGIDVFDIELAESDPDKLVEAIAMLEPTLGGINLEDIKAPECFYIEQKLRERMKIPVFHDDQHGTAIIASAAILNGLKVVGKDLSSVKLVCSGAGAAAIACLDLLVKLGLSKSNVLVADSKGVIYEGRGNLDPSKQRYAATTGARTLADAIAGADVFLGCSSAGVLKQDMVKTMADRPLILALANPEPEIRPEDAKAVRPDAIVATGRSDYPNQVNNVLCFPFIFRGALDVGATTITEEMKLACVRAIAELAQETDQSEEVAKAYEGHSLEFGPEYLIPKPFDPRLIIKIAPAVAQAAMDSGVATRPIADMDAYREQLGTTVYRTGMVMRPVFATAKTKAARIVFAEGEDERVLRAAQFVLQERIAKPIIVGRPSVVEMRLKKIGSKLVGGVDFEIVNPEDDPRYQQCWQAYHEIGARDGVTPEVAKAALRKFNTLIGAMLVHLGDAHGMICGMIDTYHSHLKFIEQVLGRAKGAEHFAAMNLLMLPGRNLFMCDTYVNEQPSAEQLADMTIQAAAEIERFGITPKAALLSNSNFGSAPSASSRRMAEARKLIVERAPELEVDGEMHGDAALSEVVRKAAFPGTTLTGEANLLIMPNVEAANIAYNLLKMVGGEGVTVGPFLLGAAKPVHILTPAATVRRIINMTAVAAANVQVK

SEQ ID NO: 38173 - protein, 1316 aa, Gibberella zeae PH-1
MRRGRSSSGSPYRALAHHQNAAAAAASSDSISLIRSFNVETNPTRPVRPSPLTASLIRDMPLDLVDRIRSFPLFMSAPEEFLVAIGNHLKPQIQSPNDHIVTEGDEAKAMYWLVRGVVAVTSRDGEAVYAELNPGSFFGEIGVLMSMPRTATIVARTKCLLLVLKKEDLHAVIPKFPDMEKAIREEAQERLNLLKKKRQEGGRLTKSPPQGDFTAREAAPGEVSTGESGVIKDGAVVNNKKRKSPSPGIMEDPTAGSAIGSGQINIRTTLKELPLFSTLPADMLHFLGLSVQPKSYTPFTDIVRQGLPGNEIFFIVRGEAEVIHDEPVYDSNVQNKAMAIPKRPRLKAGQYFGEVASLGLSRGRTATVRSITSVECIMITGDVLDEFWRRCPSDILTQVKETARSRYIKQSDDVDMIDVDVREKANKSDPTTPTASMRASLPNLTFTTPSKPGSPSKEDIANVAPKDPDPFLSVNMENIRNRRRHSLAPPIPPTDSSAPNTNGARSRLSEVTPIKFAFSETPSDDDDVPAKRVRTTLPTRPITMSKPVLSDEILIYIFKHVDIGELFRLRLVSTHWRKILTTSPRVCQDVDLSVYNRRITDEVLLKVLAPFIGTRALSIDLSNCFHVTDEGFGALWRSCGKNVKTWKMKSVWDVSANQILEMSENAKGLEEVDWSNCRKVGDNLLGRVVGWVVPDPPPSKSVVISSSTARSRTKQQQQKHAPQNVLPPGTVVGCPKLRRLNLSYCKHITDRSMAHLAAHASNRIEWLSLTRCTSITDAGFQSWAPFRFEKLTRLCLADCTYLSDNAVVALVNSAKNLTHLDLSFCCALSDTATEVVALRLPKLKELRLAFCGSAVSDGSLESVALHLNDLEALSVRGCVRVTGRGVENVLNGCGRLNWMDVSQCRNLESWIRAGGVSNWGFDDRLGQRPAEYTPGEVSGSAEGEDDAPAPKAMSVAMLTSQNFMPRSAFGYRSKRARRPGPARLAQRLPELSKTAFRNSASARSFHIQAKPTANFFTSRITSTATRNVFQRTSRAGGRSYHQGSPTGVATAPQSTSRRLLVGGAIFGGTLVAINAVFNRETREDGGMPVYEREYLNNTFLHTGLGIGIIGLTARQMVQTGFVYRIMVTNPWVVGIGGLALSFATMIGTRSISPDNYIPKYAMWTAFNATQAAFVAPLLAFVPPVLLGRAGLYTVAMMGGLAIVGATAKQEKYLYIGGPLLAGAAIVAASGLAPLIIPATAIRTLAFTENLWLYGGLAVFGGFTLYDVQKVLHHARLAQAGVMRRDPVNESISLELDFLNIFIRMVQILMMQQNRRK

SEQ ID NO: 38174 - protein, 275 aa, Pasteurella multocida subsp. multocida str. Pm70
MQAKSICFIGGGNMAQAIIFGLLKQGYPANQITVSDPNAAKRQCLAEKGVNTVEASQTDTQDAVETSEVLLLAVKPQMIAAVCQGLSAVDFSQKLVISIAAGVSVTKLQSRLPTAKQIVRVMPNTPALVAEGMSGLFAQNSLKPEYKQFTQDLLNAVGKTCWVTQEADMHTITAGSGSSPAYFFLFMEAMQQALCQMNMDEDTARLLVQQSALGAAKMVIENPDLPIATLRENVTSKGGTTAAALQVLNQQQLQHIVQQAMQACVERSQQMEKLF

SEQ ID NO: 38175 - protein, 198 aa, Arabidopsis thaliana
  misc_feature (128)..(128): Xaa can be any naturally occurring amino acid
HEAKVFKAGGFGDILTDQKVDKKQLVDDVRKALYASKICSYAQGMNLIRAKSIQKGRGLKLGESARIWKGGCIIRAIFLDRIKQAYDRNAELANLLADPELAKEITQRQFAWTTAARLAINSGLTTPXLPASLAHSAPHRRERPPVNPAQVHTAYSGAYTYQRPDAQGSPPTEWSKLASTPQALTPPIPPHFSFSSQS

SEQ ID NO: 38176 - protein, 565 aa, Chlamydomonas reinhardtii
MAAHGEPAQPAVTATVTTTNGGHRSALNFPDYRRSVAFKYVKRGYTFLMSYVLTIALVPLAGMLLLELVNMHRTGELTRLVGVAKQTDLTFNLVTVIATIAALMGVVISYYILRTRPVYLVDFQVYRAPDSWMATYTRFMAGSRKCGRFTDEALEFQEKIMTRSGLGQETYLPPGLGCSVGSPGYPSADAATRLEAARLMDSGDMDTAVQTVPPECTMENARKEFEMVVFPIIEELLQRTGVHPKQIGVLVLNCSLFNPTPSLTAMIINKFKMRSSILSYNLAGMGCSASPISIDLAKQLLQLHPSTYALVVSTENITQNWYFGNDRDKLLPNCLFRVGGAAILLSNRRRDAWRSKYELMHTVRTHLGAKDEAYSCIFQMEDSERNIGVRLTKELFAVAGEALKINVTTLGPLVLPLSEQLLFFFNLVARKVFGYRGKPYIPDFKLAFDKVCIHTGGRAVIDEIERQLQLTNDMVEPSRAALYRYGNVSSASIWYVLAYLESFNGMRRGDRIWQMGFGSGFKCNSAVWRANRNFKCLHQAWEGFNLEEMRAHLASLPNHHNKKGS

SEQ ID NO: 38177 - protein, 389 aa, Methanosarcina acetivorans C2A
MTFPMYSDRINALPPYLFAAIDEAKDEMIAKGVDVIDLGVGDPDLPTHPHIVEAMREAVCDPKTHQYPSYAGMPEFREAAAEWCKKYKGIELDPATEVLSLIGSKEAVAHIPLAFVNPGDVVLYTDPGYPVYKIGTLFAGGEPYSLPLKAENSFLPDLDSIPADILKRAKLFFFNYPNNPTSATADMKFFEKVVEFCKKNDIIAVHDNAYSQMVYDGYDAPSFLAAEGAMDIGIELYSHSKTYNMTGWRLGFAVGSKALIKGLGKVKSNVDSGVFDAIQIAGIAALSSSQACVDDTNKIYEERRNVLIEGLTAMGLEVKPPKATFYVWAPVPTGFTSIEFAKLLLEEAGIVATPGVGFGDAGEGYVRFALTKPVERIKEAVERMKKLQF

SEQ ID NO: 38178 - protein, 784 aa, Oryza sativa
MSLMRTAALTLTVLAVVFVVLVQGKPVTTDAVTEVNAPSLGEGATAFFLVAIPAIGFAFGMYWWQLAAEISIDPAKAAGRNSFLTTEIMRNVQNISQKVSDGATAFLFAEYKYLFMFMTGFGGLLCFMLGTSLASPTSGEKPVEAPWVNAFLSLVAFAMGASTSIVSGWIGMRIAVFCNSRTAVRATEGADEGDQGAGFAAAFETAFRGGITMGFCLTSLGIFSLFCCVKICQGYFGTSQAMAPQLYECVAAFGLGGSAVACFGRVGGGIFTKAADVGADLVGKVEKNIPEDDARNPGVIADCIGDNVGDIAGMGSDLFGSFGEASCAAFVVASQSAELSASFTSMMYPLLITASGVIVCMGTSLLAATNCGVKKAEDVEPTLKRQLLVSTVVATFVLMAVTDVCLPEHIKVGNTETTKWRALVCVLFGLWSGLFIGYTTEYYTSNTYRPVQEISEACETGAATNIIYGLALGYLSVLPPTVAMASTVYVSYKMADLYGYALAALGVLSTMCIALTIDAYGPISDNAGGFAEMAHMGHEIREVTDALDAAGNTTAAIGKGFAISSAAFVALALYGAYVVRVQIPVVNILDQRVMPGLMIGAMLPYWFSAMTMKSVGIAAMDMVEEIRRQFQDPKVADGTKEPDYNACVAIATQASLRQMVAPSVLVIFSPIVIGVLFGKYTLAGMLPGAVVSGVQMATSSSNTGGAWDNAKKYIERGGLGKGKGKGSPQHAAAVTGDTVGDPLKDTSGPALNILIKLMAIISVVFAPVMQSKMGGILMNYLEAM

SEQ ID NO: 38179 - protein, 231 aa, Zea mays
MASSSDPWMKEYNEASRLADDISSMIADRGSLPQSGPEIMRHTSAIRRKITILGTRLDSLESLLGRIPPKSITDKEMHKRQDMLSSLKSKAKQMATSFNMSNFTNREDLLGQSKKPDDMSRVAGLDNQGIVGLQRQIMKEQDEGLEKLEETVLSTKHIALAVNEELTLHTRLIDDLEDHVDVTNSRLQRVQKRLAILNKRTKGGCSCTCLLLSVVAIVILAVIVWLLVKYL

SEQ ID NO: 38180 - protein, 735 aa, Oryza sativa Japonica Group
MVKKKGKYSPGASGSGSGSGGGNAGGGPRPGGRETVVWSEKMNEYLIDALLHQQAIGNRGEGRFHSAAFDSIISGVAERFGVAIDRSNIKNRLKSIKENFHECENLFQNQSGFKWSAMNKKFYADPTVWREYIERKPEARKWINKPIDHYDRLLELFGKDRERCLASGSPKSPPAKKARRDPPKEKPQRTPTNGLVSPIVKSLKDMESQRTPTNVLVSPIIIKSSKEMVNENEVPSEAVTEINIAEEQDLSEKFTSENGAMPVEGNSCGTGMPYAPENWPCPGDQWSWKVGNRASATGHWLDRYLTPPSRFRDATGKKTSFTSRLKVEEFIKTEFPDMDPNTFFSMFIWKIPAKGHCIQRGGGEVRRVFCPYARQADPAGPCKARNNLCKLEREGFIESSPAQDCDLCCKMPDFCRECCCVFCRRVVDYSFGGYSYIKCEAVLEENKICGHIGHLDCALRTFMAGTVGGCIDLDMQYCCRRCDNKTNLMLHVEKFLEICQSLQSRDDIEPILNTGLCLVRGSRQTRAKSLESIMRSAMAKLKCGVDLAEVWKMEDNGINSTPSAEVSPATGGVTVLGIQQAPEEDAPPGFPYYVDLADNDLQRAVENLPAYITEDQHTLSVRFEDSIDHALKELKRSQEAEYKLAEQKLYSQKDHVLSLYRQLDSERSVLADPMPLADDDGSLYSTLITNVMKRVDQVKSEEEKLKVMLGIADGFGKTPSGVIQEHFGLPADTAN

SEQ ID NO: 38181 - protein, 175 aa, Zea mays
VPQSFYSWPFAVDVGGEVFDPETNSWEQMPAGMGEGWPARQAGTRLSAVVEGDLYALEPTTSSSGGCEIKMYDAQEDAWKVAVSQVRAGAFDESDSPCLLAAFLGKLHLVVKDMGSRISVVQMDSLMKPVDSPALSAATTCRTPDVSSEQTHVWKAIASKNIAAAELVSCQVLSI

SEQ ID NO: 38182 - protein, 503 aa, Rubrobacter xylanophilus DSM 9941
MSQDGRRDGQPREGGVGRVVEVKGPVVDVRFPPDQIPEIYNALTCKIETEEGEHTLTLEVQQLLGDDMVRTVAMSSTDGLRRGVEVQDTGRPIAVPVGEAVLGRVLDVLGEPVDEQGPVEGEADRWPIHRPAPKFEDLSTKAEQFVSGIKVIDLLCPVRRGGKVGLFGGAGVGKTVLITELINNIALQYEGTSVFTGVGERTREGTALYGEMEEAGVLKNTALIFGQMNEPPGARFRVGLTGVTIAEYFRDVLGQDVLFFLDNIFRFAQAGNEVSALMGRMPSEVGYQPTLGTEMGALQERITSTKKGSITSFQAVYVPADDPTDPAPFTVFAHLDSTVELSRSLFEQAIFPAVDPLASSSTILDPDVVGQEHYEVAQEVKGILQRYKELQDIIAILGIDELSEEDKVIVARARRLQRFLSQPFFVAEQFTSLPGKFVELEETVQSFREVVEGKHDDLPEQAFYLVGGIDDVLEKARQLSGEEEEGEEAAKEEAGVGAGGEGS

SEQ ID NO: 38183 - protein, 468 aa, Bartonella henselae
MSYDVVVIGAGPGGYVAAIKAAQLGLKTAIIEKRMTLGGTCLNVGCIPSKALLHASEVFAETQHGFETLGISIAKSKLNLEQMMAHKKAVVTANTSGVSFLMKKNKIDTFFGTAKILNAGQIEVVARDGNKQTIETKNIIIATGSESSGIPGVNVEIDEKVIVSSTGALALEKVPTRMIVVGAGVIGSELGSVWSRLGAKVTIIEYLNKVLGSMDGEVSRQFQKIMEKQGIEFKIGAKVTAITQSGSVAQVTFEAVKGGPSETLEADVVLIATGRFPYTEGLGLEEAGVQLDERGFITIDAHWQTNIPGVYAIGDVVKGPMLAHKAEEEGVAVAEILAGQKGHVNFDVIPSVVYTQPEIASVGKTEEELKAAGIDYNVGKFPFMANGRARAMQKSDGFVKILADKKTDRVLGGHILGFGAGEMIHEIAVLMEFGGSSEDLGRCCHAHPTLSEAVREAALATFAKPLHI

SEQ ID NO: 38184 - protein, 225 aa, Schizosaccharomyces pombe 972h-
MSQSQFDPYVQNGGTTVAIAGDGFAILAGDTRSVNGYNINTRFQPRVHEVGDDLVIGASGFEADALALVKRIQQRIDLYHDNHERKMSAQSCACMVRTLLYGKRFFPYYVYTTVAGIDKEGKGEIYSFDPVGSYEREWCRAGGSAANFITPFLDNQVNLHNQYVPGSHGKERKPRRLLKLEEAMKITTDAFTSAGERHIEVGDSVLVKIITKEGVETRIIPLKKD

SEQ ID NO: 38185 - protein, 449 aa, Pseudomonas putida KT2440
MSTMIESVDNFLARLKQRDPGQPEFHQAVEEVLRTLWPFLEANPHYLQSGILERMVEPERAVLFRVSWVDDQGKVQVNRGYRIQMSSAIGPYKGGLRFHPSVNLSVLKFLAFEQVFKNSLTSLPMGGGKGGSDFDPKGKSDAEVMRFCQAFMSELYRHIGADCDVPAGDIGVGAREIGFMFGQYKRLANQFTSVLTGKGMTYGGSLIRPEATGYGCVYFAEEMLKRQDKRIDGRRVAVSGSGNVAQYAARKVMDLGGKVISLSDSEGTLYAEAGLTDAQWDALMELKNVKRGRISELAGQFGLEFRKGQTPWSLPCDIALPCATQNELGAEDARTLLRNGCICVAEGANMPTTLEAVDIFLDAGILYAPGKASNAGGVAVSGLEMSQNAMRLLWTAGEVDSKLHNIMQSIHHACVHYGEEADGRINYVKGANIAGFVKVADAMLAQGVV

SEQ ID NO: 38186 - protein, 331 aa, Neisseria gonorrhoeae
MNLKNRHFLKLLDFTPEEITAYLDLAAELKDAKKAGREIQRMKGKNIALIFEKTSTRTRCAFEVAARDQGADRTYLEPSASQIGHKESIKDTARVLGRMYDAIEYRGFAQETVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKGVGFIHTDVWVSMGEPKEVWQERIDLLKDYRVTPELMAASGNPQVKFMHCLPAFHNRETKVGEWIYETFGLNGVEVTEEVFESPAGIVFDQAENRMHTIKAVMVAALGD

SEQ ID NO: 38187 - protein, 451 aa, Oryza sativa Indica Group
MRRMLRCFFGGGGGGDETGGDEEKKASAAAVVKNKKAVRRMRSATGRLRSLSLEDLSRTLAQSGLQAFTLAELKAATRSFSGSNFIGEGGFGPVYKGFIDAKLRPGLLQPQHVAVKYLDGEGDQGHREWLAEVVYLGMLSHPHLVKLIGYCCQDDHRMLVYEYMARGSLEHHLFKNLLSSLPWATRLKIAVGAAKGLAFLHDADTPVIYRDFKASNILLDSDYTAKLSDFGLAKEGPQGDATHVTTRVMGTHGYAAPEYILTGHLTAKSDVYSFGVVLLELLTGRRSVDKRRRGREQNLVDWARPYLRRPERLHRVMDPSLEGGYSDKAAGKAAMVAYHCLHSVPKSRPHMRDVVAALEPLLQTSCGDVLAGPFVYTVPSAAAVVVAAKDDEKKAAAAAGEDGEEEVAAAAKAKRRYVASAVHAEGAMRKGEHRYASSVSGSPRQSRDRGG

SEQ ID NO: 38188 - protein, 899 aa, Schizosaccharomyces pombe 972h-
MNCEMVTSPESVNLGDSNRAVSPFCLPDCSENAVAQTRSKTLDNAALDLPYVGNRKKSEQDFFKMLSSRDRDAHSTLRKRSNSLSSFLSTKSTSASENKFHGGLNWLSLKLNLLLRLQGRMNSARTNTSMNPYSCDSNENLSTLSSVNQNFNSRQLLATIVPESIQNGCSLLRITKKKVRQRKVSLDPISGYLMLDKNTGKAYKKLCVDDIKEIRQGRDARNYREQYKISSENEKRWFTIIYCADNKLKAMHMISPTLDAHNQWIMALEGLKTYRLNEFIIGLNLVCHQGEKMIDYSENLNPWEKLEKEQSAQLDLGDVHRMCQMLHLNASMEFLEETFQKADADHSGKLSFEEFQHFVSLLKTRSEIVDIFKEYTSGSDKMSLEQFRHFLSTSQKARLDSDSIRTLYVSFCSNDDSKMGLIEFTSFLLSPHNSPVVPVIQDMSRPLNEYLISSSHNTYLLGKQFGGESSIEGYIRSLQRGCKCIEIDCWDGPNGPVVCHGHTFTSMIKFNDVIDAIRKYAFVVSPYPLFISLEIHCCPDQQRQMVSYMKQAFGDTLVMKPVTANESVLPSPEDLLNKILLKVKCSATPLHQFSTDILKVGITDSSTDTTESSELENSELTGLRKGKRRMKNIIVQELQQLAPYARSLKFRNFSLPESKTYSHIFSFSERTIKKHGKAMVPRLSKHNLRYLCRVYPGPLRVGSTNFNPQVYWRLGVQMVALNWQTYDTGLQINDALFIADPPTGYLLKPPCQRIIGTTVGEEGLPRKIKLTIDVISGQQLRRARELSNSETLSPYVEIQVHSMEESPFRWCSKVVHENGFRPFWGETMVYESIISDDFYSMIRFLVHHRGSNGNDSIFANFTCPIDRLQQGYRHIRLLDMQGENLLFSSLFLKIKKEDI

SEQ ID NO: 38189 - protein, 588 aa, Nicotiana rustica
MGSYRVCVCFTRKFRVTEAEPPSDVKEAFKKYAENGNQMNSEQLLKFLIEVQGETLFTVGDSDVIVRQILQKRHPITKLTRQTLALEDFHHFLFNTDLNPPINYKVHHDMNAPLSHYFIFTGHNSYLTGNQLTSDCSDVPIIKALKKGVRVIELDIWPNSDKDDIHVLHGRTVTTPVELIRCLKSIKEHAFVASPYPVVITLEDHLTPDLQAKVAQMLTETFGEMLFVPESDSLKECPTPEELKHRIIVSTKPPKEYLEASASTTVSKERRNSSQRSNCSEDDVWGTEPSSLTADQEENEKSDSDNFEDEDDCNHRPQFASAYKRLIAIHAGKPKGGLKEALKVDPDKVRRLSLSEQALEKAAESHGTEIVRFTQRNILRVYPKGTRFNSSNYKPLIGWMHGAQMVAFNMQGYGRALWLMHGMFRSNGGCGYVKKPDFLLNVGPNNEVFDPKAKLPVKKTLKVKVYMGDGWHLDFKQTHFDLYSPPDFYTRVGIAGVPADEIMKKTKTKEDKWTPVWDEAFTFPLTVPELALLRIEVHEYDMSEKDDFAGQTCIPISELKPGIHAVPLCDRKGEKYSSVRLLMRFEFV

SEQ ID NO: 38190 - protein, 758 aa, Kluyveromyces lactis NRRL Y-1140
MKQSTLLALEGFQTVLKALIFIAIFGVAISSRLFSVIRFESIIHEFDPWFNFRATKYLVSHSFYEFLNWFDDRTWYPLGRVTGGTLYPGLMTTSGAIWHILRKIGLPIDIRNICVLFAPAFSGFTAWATYEFTKELKDSSAGLLAAAFMAIAPGYISRSVAGSYDNEAIAITLLMVTFMFWIKAQKTGSILYSMLAALFYFYMVSAWGGYVFITNLIPLHVFILILMGRYQSKLYSAYTTWYAIGTLASMQIPFVGFLPIRSNDHMAALGVFGLIQIVALGDYIKSQVSGERFKVVMFISLGLIISIGISGLFFLTYMGYIAPWTGRFYSLWDTNYAKIHIPIIASVSEHQPPAWPSFFFDNQFLIWLFPAGVFLLFLELKDEHVFVLAYSVLCSYFAGVMIRLMLTLTPIICVTGAIAISKLFDIYLDFSVALSTKSPKDVKSVKLDKEKKETSDLEQEDDDYEAELVVDYEPSSKARWFDITAKAVVSSTFLMYLFLFVYHCTYVTSNFYSSPSVVMPSQNPDGSVALIDDFREAYYWLRMNTAEDAKVAAWWDYGYQIGGMADRTTLVDNNTWNNTHIAIVGKAMSSPEEKAYEILKAHDVDYVLVVFGGALGYSGDDLNKFLWMVRISEGIWPDEVKERNFFTGRGEYRVDADATKTMKDSLMYKLSYHDFPSIYPNGVGHDRTRNQKITNNEVGPLDYFEEVFTSEILLVRIYKLKSPDSLGRDHGEAAKFDRNLQSGVKKRLVKKPELELRV

SEQ ID NO: 38191 - protein, 275 aa, Wolinella succinogenes DSM 1740
MIKKCLFPAAGYGTRFLPATKAMPKEMLPIVNKPLIQYGVEEALEAGITTMAIVTGRGKRSLEDHFDISYELEHQIRGTDKEIYLKDIREVMEQCTFSYTRQMEMKGLGHAILTGETLIGNEPFAVVLADDLCDNPEGEGVLSQMIELYHKYRCSIVAIEEVEVSEVDKYGVISGREIDAGVYMVDNMIEKPSIAEAPSNLAVIGRYILTPDIFDILRDTKPGKKGEIQITDALLEQCKKGMVLAYKFKGKRYDCGSIDGFVMATNVFYQKHHQG

SEQ ID NO: 38192 - protein, 344 aa, Xanthomonas axonopodis pv. citri str. 306
MTDRLRFPAEWEPQSAVLVAWPHAGTDWAERLADVEETYIALVTAISRFEPVVICVADDDLQIYAEARLRSARVDMTRVRFVIAAYNDTWLRDSGPITLRQEAGFRLMDFRFTGWGGKFEASLDDQLVSSLDAAQVFVPAQVETVDFALEGGAIETDGAGTLLTTWKCLHERHPQRTRESLSSDLATWLAQERVLWLDHGYLEGDDTDAHIDTLARFAGPDAIVYQGCDVASDSHYVELQAMGAELAALRKADGQPYRLFVLPWAQPILDEGRRLAASYANFLIVNGAVLMPAYGDAADATAQAVLAQAFPHHEIVPVPCRALIWQNGSLHCLTMQLPAGLLAA

SEQ ID NO: 38193 - protein, 67 aa, Vitis vinifera
MVLNGATPPRGSAAAASSLRRRRTTGGAAAGGASGNILQFYTDDAPGLKISPNVVLVMNIEYSPCHG

SEQ ID NO: 38194 - protein, 322 aa, Synechococcus sp. CC9605
MSIAPDITALIGGTPLVRLNRLPQACGCQAEILAKLESFNPSASVKDRIASAMVLEAEQSGTIIPGRTVLVEPTSGNTGIALAMVAAARGYRLILTMPDTMSTERRAMLRAYGAELQLTDGAQGMNGAIALAKELVDEIPNAYLLQQFDNPANPAVHERTTAEEIWRDTEGQIDAFVAGVGTGGTITGCARLLKQRQPQLQVIAVEPEASAVLSGKPPGAHRIQGIGAGFVPAVLELDRIDSILTVSDEEAMQVGRRLAREEGLLCGISSGAAMAAALRVGQDPAMVGKRLVVMLASYGERYLSTPMFSAASQLPARRDGQL

SEQ ID NO: 38195 - protein, 313 aa, Yarrowia lipolytica CLIB122
MPIITETFKLNDGRSIPALGLGTASDANVEEVTYAAIKDGYKHIDTAYIYKSEEAIGKGIKRAIADGLIKREELFVTTKVWPTFHGRVKESLDYSLKDLGLDYVDLLLVHWPAALHPDPNDRHAYVPKNADGSAHYTDNNDWISIYEELEKEQAAGRTKSIGVSNVSEKYLKELLKRVKTVPAVNQFENHPYLPQKKEIEFNKKHGILVTAYSPLGSSNGKIKLHENPVVAEIAKKHNATTGSVLINWHISQGRSVIPKTRSVERVKANAQKVDLDSDDLAKLDKIWEQTGTQRAIGLDWLDKAGDNLGFEDK

SEQ ID NO: 38196 - protein, 468 aa, Burkholderia pseudomallei K96243
MQKGHSETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIAFGIGNHGVPMGISNLWAHGGFFPNGAQGVLMSMQMVMFAYLGVEMIGLTAGEAANPQKTIPGAINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAIVVSMAALLVGVLLNYLVPEKVFVWVTSISTFGAIWTWGVILVTQMKFRASLAPAEERALRFRMPFWPYASWVALAFLVLVIGLMAYFPDTRIALYVGPAWLVLLVVLYFVLKLEPEGGKAAGLERRYGRG

SEQ ID NO: 38197 - protein, 698 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSFTNIVNNTNSSSPLMNQQQQYYHQQQHQQQVTQSSLYQHHHQYHQ

SEQ ID NO: 38198 - protein, 370 aa, Aspergillus niger
MPSPLRTAPQPPLRAFHNPPALRRLYSSTSHSAATPATSPFAPRHLLSIADLTPTEFATLVRNASSHKRAIKSGSIPQSLHGALSGKTVAMMFSKRSTRTRISTEGAVVQMGGHPMFLGKDDIQLGVNESLYDTAVVVSSMVECIVARVGKHADVADLAKHSTKPVINALCDSYHPLQAIADFQTISEHFAASGKGKLEGLGLNGLKIAWVGDANNVLFDMAISARKMGVDVAVATPKGYEIPKEMLEIIEKAGEGVKSPGKLVQTNVPEEAVKGADVLVTDTWVSMGQEEEAAKRLRDFAGFQITSELAKRGGAKEGWRFMHCLPRHPEEVADEVFYGHRSLVFPEAENRLWAAISALEGFVVNKGKIE

SEQ ID NO: 38199 - protein, 359 aa, Emericella nidulans
MASLRSVLKSQSLRHTVRSYSSQTMPPASPFAPRHFLSIADLSPSEFATLVRNASSHKRAIKSGSMPQNLQGSLLGKTVAMIFSKRSTRTRVSTEGAVVQMGGHPMFLGKDDIQLGVNESLYDTSVVISSMVSCIVARVGKHAEVADLAKHSSVPVINALCDSFHPLQAVADFQTIYEAFTPKAHHLSSLGLEGLKIAWVGDANNVLFDMAIAATKMGVDIAVATPKGYEIPPHMLELIKSAGEGVSKPGKLLQTNIPEEAVKDADILVTDTWVSMGQEEEKAQRLKEFDGFQITAELAKRGGAKEGWKFMHCLPRHPEEVSDEVFYSNRSLVFPEAENRLWAAISALEGFVVNKGKIE

SEQ ID NO: 38200 - protein, 422 aa, Arabidopsis thaliana
  misc_feature (225)..(225): Xaa can be any naturally occurring amino acid
MRGLVNKLVSRSLSISGKWQNQQLRRLNIHEYQGAELMGKYGVNVPKGVAASSLEEVKKAIQDVFPNESELVVKSQILAGGRGLGTFKSGLKGGVHIVKRDEAEEIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKXTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVRLEGTNVEQGKRILKESGMKLITADDLDDAAEKAVKALAH

SEQ ID NO: 38201 - protein, 233 aa, Pasteurella multocida subsp. multocida str. Pm70
MTIEQNLAQIQQNIQHAVQQAKRPESAVKLLAVSKTKPVEDIYQAYQAGQTAFGENYVQEGVEKIQYFAQKNIPLEWHFIGPLQSNKTKLVAEHFDWMQTLDRKKIADRLNEQRPHYKKPLNVLIQINISDEDSKSGIQPNEMLDLAKQIQNLPHLCLRGLMAIPAPTDDLATQEQAFTQMHSLFEQLKQALPDAQIDTLSMGMTDDMASAIQCGSTMVRIGTAIFGARDYSK

SEQ ID NO: 38202 - protein, 467 aa, Desulfococcus oleovorans Hxd3
MSDNIGKVVQVMGPVVDVEFEPGKLPAILTALLITNTVINDEADNLVVEVAQHLGDNVVRTIAMDVTDGLVRGMPVKDTGAPITMPVGAASLGRVLNVVGKPVDGLGPVSREKTMPIHRPAPLFTEQDTSVNVLETGIKVIDLLVPFPRGGKMGLFGGAGVGKTVIMMEMVNNIAMQHGGISVFAGVGERTREGNDLYHEMKDSGVLPKAALIYGQMTEPPGARARVALSALTCAEYFRDVEGQDVLIFIDNIFRFTQAGAEVSALLGRIPSAVGYQPTLAVDLGGLQERITSTDKGSITAVQCVYVPADDLTDPAPATTFAHLDGTVVLSRQIAELGIYPSVDPLDSTSRILDAAYIGEEHYRVAREVQQTLQKYKELQDIIAILGMDELSDEDKVTVERARKLQRFLSQPFHVAEVFTGKPGSYVKIEDTVRSFKEICDGKHDDLPESAFYMVGSIEEAVAKAKG

SEQ ID NO: 38203 - protein, 194 aa, Zea mays
MPLPPLPHQISNSCLILLAGRSTGGGKGGLSSLYLLGGSCLLALLIYFCSHSLLTTVVEDGIEIRGQGTVSMVGATTSFGWFMGFRLLGGRDVVCAAVSFRPCIDIHKGKVKQIVGSTLRDSSNDGMELVTNFESDKSPAEFAKSYKEDELLGGHVIMLGSDPASQAAALEALHAYPGENLLSSCCKNCGCSLG

SEQ ID NO: 38204 - protein, 568 aa, Schizosaccharomyces pombe 972h-
MSKKLKDLPVSSTFTSNLPPDPLVPTVQAMKKADDRILHVPRFVEGGGLFTYLTPSLKANSQLLAYSPSSVKSLGLEESETQTEAFQQLVVGSNVDVNKCCPWAQCYGGYQFGDWAGQLGDGRVVSLCELTNPETGKRFEIQVKGAGRTPYSRFADGKAVLRSSIREYLCCEALYALGIPTTQALAISNLEGVVAQRETVEPCAVVCRMAPSWIRIGTFDLQGINNQIESLRKLADYCLNFVLKDGFHGGDTGNRYEKLLRDVAYRNAKTVAKWQAYGFMNGVLNTDNTSILGLSIDYGPFGFLDVYNPSFTPNHDDVFLRYSYRNQPDIIIWNLSKLASALVELIGACDKVDDLQYMEQLHNSTDLLKKAFAYTSEVFEKIVEEYKNIVQNDFYDLMFKRVGLPSDSSNKILITDLLQILEDYELDMPNCFSFLSRNSPSSMENEEYAAKLMQACICLNPNNERVRNESVKAFTNWVGRYSEATKTQEDSSRLASMKKVNPHFTLRNWVLEEVIKEAYIGKFELFKKVCKMAACPFEDTWGFSKEEEDYLCYNTTPSKSQIQCSCSS

SEQ ID NO: 38205 - protein, 347 aa, Pachysolen tannophilus
MINSISNTVLLKSVVSKRFFSSSAKMSSQAKPRHLVSMLELSIKELESLVNRAAYHKQQIRSGLVNTTQPLSGKTVSLIFNKRSTRTRVSSEGAAAYLGGCPMFLGKDDIQLGVNESLHDTTKIISSMTSSIFARVNKHSDIQEMCKYSSVPIINALCDTFHPLQAITDILTIKESFGNTTKGLKLAWIGDVNNVINDLCIAALKSGIDVSIAVPSGLKFEELILSGAKEISAENGTTLKITNDPLEAINGANVIVTDTWISMGQEDERLQKLKQFEGFQITKEMISKGKAAENWKFMHCLPRHPEEVHDEVFYDEERSLVFEEGENRLYAAIAVLEGFVVNKGKLL

SEQ ID NO: 38206 - protein, 333 aa, Wolinella succinogenes DSM 1740
MSPLRIAINGFGRIGRSVARVIAQRSDVELVAINDLASPETLAYLLRHDSVHGAFPHEVSWEGNRFYIGKKEVLLYQERDPQKLDFSAASPEVVIESTGLFLTQELVKHHLQKGVKRVIFSAPAKDSTPTYVLGVNHERYQGEPIISNASCTTNCLAPLAMLLDEAFGIEKGIMTTIHAYTNDQNILDTAHRSDFRRSRAAAINMIPTTTGAAKALGLVLPSLQGKLHGHSVRVPTPDVSMVDLNVKLAQKSSAQAINELFMEASQGRLKGILGMDKDFGVSLDFQGDPRSSIVASDLTFVIEGDMAKVMAWYDNEWGYSNRLVDMARFITSL

SEQ ID NO: 38207 - protein, 467 aa, Schizosaccharomyces pombe 972h-
MTATAKSCALDFLDFVNASPTPYHAVQNLAEHYMSHGFQYLSEKSDWQSKIEPGNSYFVTRNKSSIIAFSIGKKWKPGNGFSIIATHTDSPTLRLKPKSQKSAYGYLQVGVEKYGGGIWHTWFDRDLSLAGRVMVEEEDGRVIQYNVHIDRPLLRIPTLAIHLDPSANSSFSFNMETEFVPLIGLENELAKEETSDNGDKYHHPVLLSLLANEISKSLETTIDPSKIVDFELILGDAEKARLGGIHEEFVFSPRLDNLGMTFCASQALTKSLENNSLDNESCVRVVPSFDHEEIGSVSAQGAESTFLPAVLQRICELGKESSLFSISMVKSFLVSADMAHAMHPNYSSRYENSNTPFLNKGTVIKVNANQRYTTNSAGIVLLKKVAQLADVPIQSFVVRNDSPCGSTIGPKLAAMTGMRTLDLGNPMLSMHSCREMCGSKDFEYAVVLFSSFFQNFANLEEKIIIDE

SEQ ID NO: 38208 - protein, 325 aa, Schizosaccharomyces pombe 972h-
MQVVDEKTILELENERFDESSQFKTPEKLIVEASDMTAFRQSKAYYRIFDFLQRLNIASVGVNDYHVEYSTRVEKLVRILCRVKEITKTVPPASGRHRFGNPAFRIWHEKLRDSASQIMDIIIPDSLSKAKVELLDYFLGSFGNSQRIDFGTGHELNFLGFIKGLDLLGLLDAADYKAIALYITHVYLEVCRELVQTYRLEPAGSHGVWGLDDHFFIPYIFGSAQLADKASSSIIKPDAILNKKIVDEKANSNLYFSAIKFINVMKKGPFYEHSPILYDITAVPIWSKVNQGLIKMYDVEVLSKYPVVQHFHFGNLFPFNPLVAK

SEQ ID NO: 38209 - protein, 526 aa, Oryza sativa
VSIAVFFQLEPRVGGWRGDSAVPHFRHRDDHPASAPQVEPDKSEECLEFDDEEEEVEEEEIEYEEIEEEIEEEEEVEEDEDVVEEVEEVDEEEDEEEDEESDETEGVSKTKGVHQKDVTEKGKHAELLALPPHGSEVYVGGISSDVSSEDLKRLCEPVGEVVEVRMMRGKDDSRGYAFVNFRTKGLALKVVKELNNAKLKGKRIRVSSSQAKNKLFIGNVPHSWTDDDFRKAVEEDGPGVLKADLMKVSSANRNRGYGFVEYYNHACAEYARQEMSSPTFKLDSNAPTVSWADPKNNDSVSTSQVKSVYVKNPPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGSRYGGGGGSSGSSRPGAKRQRGDDNSSSRHKGRRRPY

SEQ ID NO: 38210 - protein, 237 aa, Vitis vinifera
METGMISSPSSSSPSRPPVILTQDELKKIAAYKAVEYVESGMVLGLGTGSTAKHAVDRIGELLRQGKLKNIVGIPTIEDDPRTSVDPYLNLVKGRGGSLLREKMVEGACKKFVVIVDESKLVNYLGGSGLAMPVEIVPFCWKFTAQRLQMLFEESGCVAKLRTYQNGEPFVTDNMNYIVDLYFKREIGDLKVASDAILRLAGVVEHGMFIDMATTLIVAGECGVIVKDKWDSASHRR

SEQ ID NO: 38211 - protein, 181 aa, Solanum lycopersicum
MASSIVSSAAAATRSNVAQASMVAPFTGLKSAASFPVTKKNNNVDITSLASNGGRVRCMQVWPPINMKKYETLSYLPDLSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 38212 - protein, 139 aa, Nostoc punctiforme PCC 73102
MARYQETTQTDTLHLPSTITSRGVAATELRPWGAFTVLEEGRGYKIKRIEVKPGHRLSLQMHHHRSEHWIVVSGTARVTCGEKEVLLSNNESTYVPQCTSHRLENPGVIPLVLIEVQNGEYLGEDDIIRYQDDYARTKD

SEQ ID NO: 38213 - protein, 167 aa, Thermoanaerobacter tengcongensis MB4
MHIISVLVNNHPGVLSRVVGLFSRRGYNIESLAVGTTEREDISRITLTVLGDDYTVTQIIRQLNKLVDVIKVQNIGKRDNVSRELLLVKVGYDSNTRNDIMHIVETFRGRVIDISLDSLIIEMTGDPEKIEAFLNLINKFDVKELVRTGLISLERGNKTLKEYEGEL

SEQ ID NO: 38214 - protein, 386 aa, Arabidopsis thaliana
MASSSSSSLSFSTSKKNKTFFKKPNSAFSSSRATSLIKRQQTVFKKAKELSILCDIDVCVICYGSNGELKTWPEEREKVKAIARRYGELSETKRRKGSVDLHEFLEKMNKDDPEKEEKKKIKVRRVPKVKYPVWDPRFDNYSVEQLMGLVQSLERNLTRIQHRTCAVVEAQGQRRVQYTNMANQELMMANTMNQLQQHSNQVSMYLWNHGNGAFSQIPVSALASNQTQSLAPIPPELMIYPNSDAGNYSGSLGVQGTGINGLQNMNMLTYNNINSVNDFSKQFDQNSRAESYSSLLGVHEDGNNEFENPNMSSRNNFNVQDCAGLLGMQGAGTNGLQSMNMHDYSNNNSINSNGLSHQYVQFPTYNSQHQDRVFNLDQNGNNTRSL

SEQ ID NO: 38215 - protein, 456 aa, Salmonella typhimurium LT2
MTTRLTRWLTALDNFEAKMALLPAVRRYGRLTRATGLVLEATGLQLPLGATCIIERQDGPETKEVESEVVGFNGQRLFLMPLEEVEGILPGARVYARNGHGDGLQSGKQLPLGPALLGRVLDGGGKPLDGLPAPDTLETGALITPPFNPLQRTPIEHVLDTGVRAINALLTVGRGQRMGLFAGSGVGKSVLLGMMARYTRADVIVVGLIGERGREVKDFIENILGPDGRARSVVIAAPADVSPLLRMQGAAYATRIAEDFRDRGQHVLLIMDSLTRYAMAQREIALAIGEPPATKGYPPSVFAKLPALVERAGNGIHGGGSITAFYTVLTEGDDQQDPIADSARAILDGHIVLSRRLAEAGHYPAIDIEASISRAMTALITEQHYARVRLFKQLLSSFQRNRDLVSVGAYAKGSDPMLDKAITLWPQLEAFLQQGIFERADWEDSLQALDLIFPTV

SEQ ID NO: 38216 - protein, 112 aa, Glycine max
MILLLGGSQLPNCSASAIITYSSSPSMSGFYIVMQTASSIISFSAVVAVFRAAPGMVTPFSDIKTMVGFPSKKTNNDITSIPSTGGRVQCMQVWPPVGKKKFETLSYLPDLM

SEQ ID NO: 38217 - protein, 381 aa, Oryza sativa Indica Group
MEEKKPYVIAMLIQVIYAGMFVVTKAAFDEGMNTFVFIFYRQAAATLLLLPPALLLERKNARSMSLMLLIKLFFCAFIGNTFSLNLYNVSMKFTSATVASAASNSLPVITFFLALITRMECVKVRSSSGIAKLAGVALCFAGVMVLALYKGPALNPVSHHHHHIASFAGDARSSSSRGAWIRGIFLMVLANVTWSIWIILQAAVLREFPNKMLVTAAQCVFSTVQTAVVAAAAEREMARWKLRLDISLLAVLYTGLVVTGVSYYLQAWCVELKGPVFLAMSNPLCLLFTIFCSSFFLAEIVHLGSIIGGILLVGGLYSVLWGKSAEMTMNGNGDEQQQQQSHHKISTEMIVVEKTMISGSQEKDQNNNEQSTPTKSPLQQV

SEQ ID NO: 38218 - protein, 401 aa, Rickettsia conorii str. Malish 7
MSIISTRLSSIKPSPTLAVVKKTLELKKAGVDIITLGAGEPDFDTPDNIKEGAIKAIKDGFTKYTNVEGMPLLKQAIKDKFKRENNIDYELDEIIVSTGGKQVIYNLFMASLDQGDEVIIPAPYWVSYPDMVALSTGTPVFVNCGIENNFKLSAEALERSITDKTKWLIINSPSNPTGASYNFEELENIAKVLRKYSHVNVMSDDIYEHITFDDFKFYTLAQIAPDLKKRIFTVNGVSKAYSMTGWRIGYGAGSKTLIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIEKTIDVIPA

SEQ ID NO: 38219 - protein, 560 aa, Azoarcus sp. BH72
MYRYDDYDQRLVDERVAQFRDQTRRYLAGELSEDEFRPLRLQNGLYVQRHAPMLRIAVPYGLFSSAQLRTLADIARRYDRGYGHFTTRQNIQFNWPELAKVPEILAQLATVQMHAIQTSGNCIRNITSDAFAGVAADELIDPRPWCEILRQWSSFHPEFAHLPRKFKFAVNGAKEDRAVIQAHDIGLDVVKNDAGEIGFRVLVGGGLGRTPIIGEEIAAFVPWQHIVTYCESILRVYNLHGRRDNKYKARIKILVKALGIEEFRRQVEAEWAFHKNGPSTLTEAEVARVAAHFVDPAYESLPATDAGYASLLDENKPFAAWVKRNVRAHKVPGYASVTISLKKTGVPPGDITESQMELVADLADAYSYGEVRATHQQNLVLADVRQSDLFKVWQSLRDAGLATPNIGLLTDIISCPGGDYCALANAKSIPIANAIQERFDNLDYLYDIGEIELNISGCMNACGHHHVGHIGVLGVDKNGEEWYQVTIGGDQGNKAAIGKVIGPSFAAAEMPDVVTHLIETYIANRHEDERFVDTVRRIGIEPFKAHVYGNRQTEKKVAHA

SEQ ID NO: 38220 - protein, 486 aa, Pseudomonas syringae pv. syringae B728a
MTSQSLNSHHVDPDTALKLYIDGRWSAPLDPVSIAVINPATEEVVAHVASGSAADVDRAVAAARAAFAGWSGSSPHARAQVIGRIHELILERKEQLAQAISLEMGASISSARAMQVPLAAEHVRVARDLLATYRFHTVEGSTAIEREPIGVCGLITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFAKAVPPGVMAAFRNVGQSCSAPTRMIVPRNRLAEVEALAAETAAAIVVGDPQLEETVLGPIANEAQFQRVQAMIDAGLSEGAKLVCGGPGRVQGHERGFYTRPTVFSEVDSSMRIAREEIFGPVLCLIAYDTVEEAIAIANDTVYGLGAHVQGQDLEQARAVASRIRAGQVHLNYPAWNPMAPFGGYKRSGNGREYGVQGFEEYLETKAIVGFA

SEQ ID NO: 38221 - protein, 267 aa, Escherichia coli CFT073
MAIPAFGLGTFRLKDDVVISSVKTALELDYRAIDTAQIYDNEAAVGQAIAESGVPRHELYITTKIWIENLSKDKLIPSLKESLQKLRTDYVDLTLIHWPSPSDEVSAEEFMQALLEAKKQGLTREIGISNFTIPLMEKAIAAVGAENIATNQIELSPYLQNRKVVAWAKQHGIHITSYMTLAYGNALKDKVIARIAAKHNATPAQVILAWAMGEGYSVIPSSTKRENLESNLKAQNLQLDAEDKKAIAALDCNDRLVSPEGLAPEWD

SEQ ID NO: 38222 - protein, 477 aa, Polaromonas sp. JS666
MPSRATKIVVTLGPASSDPVLLEKMIRAGVNVVRLNFSHGTAQDHVDRAKLVREAAQRAGREVAIMADLQGPKIRVGKFAEGKVRLEAGEKFILDASRTEPGDLKGVGLDYKELPRDVKAGDVLLLNDGLIVLTVEAVRGEEVHTIVKLGGDLSNNKGINKQGGGLTAPALTAKDMEDIKTAMSFRADYVAVSFPKNATDMEMARQLCDVAAAPYKHKPGLIAKIERAEAIPKLEEILRVSDAIMVARGDLAIEVGNAAVPALQKRMIKMARALDKVVITATQMMESMIVNPVPTRAEVSDVANAVLDGSDAVMLSAETAAGKYPLETVEEMAKICEEAEKAEYKELEADFTGKTFTRIDQSIAMGTLFTAHHLGAKAIVALTDSGSTPLWMSRHDIRVPIYALTPHLATQRRMALYRNVRPLLMDTSADRDTALAQAEGHLLRRNIVQSGDVYAITCGEPMGAPGGTNMLKICRVA

SEQ ID NO: 38223 - protein, 220 aa, Dehalococcoides ethenogenes 195
MKDVKIVPAVLTDDPAAFECMLNQLESFAPSAQIDIMDGQFVPSLSIPPEVLGRYKPRFASEIHLMTLNPEEYLTYCKQHGAFRVIFHFEATTRPEYVISRIKELGFQAGLAVNPETPVSDFAYLVPQLDMVLFMSVIPGFYGAPFIPEVLLKVKEFKRRFPETEIGLDGGAKEGNIPEIVAAGVNDICVGSAIFRQTDPKSSYLYLDKLAKNASKEAGI

SEQ ID NO: 38224 - protein, 409 aa, Mycoplasma gallisepticum R
MIMKLLNTIKSYADFLKIKKAALKQLATEIRDYLINLGKEKSIHWSSNLGIVELSIALAYFFNLDRDKVFYDTSHQAYVHKMVTGRFDRMRSIRETNGLSGLQDLNESKYDYYAGGHTSNSLSVASGLVFSNQLLDKEQLIIPVIGDGSIANGIAFEAINNISFHHHKMIIILNDNQMSISENFGEFNKLLTNLKDDQANFFKQLNYEYLKIEDGHDLDQIFAGLEKAKELVKQKPVIVHVKTIKGKGVEQAEADLIGTYHNSNRSNKTYQDQSGFIAASHLEAKLKDKKQFCMINPAMTYATGFIDLIKKYPKNYIDVGISEEHALSMASGVSLNQVPVFLPIYSTFLQRSYDQLIHDLSRLNLGINLLIDRCGLNGTEGSSHQGSLMWGWLKTPRMLRSMLLVIRSY

SEQ ID NO: 38225 - protein, 553 aa, Aspergillus oryzae
MKRKQTDSGDERPVSTPKRQRTAAFNGSTNGHEDTETPVGASPSKRIKSTPQKPSTATPAALKESGLKTPTQKSKAKALFSTPTKSTAVSTPSRARNADRSAKKKSARLLLEQNDDEEDWDGADRLAEEILQDENDTTAAENVNGVVETVEGEDEANKTAQTPKRRAGRPKGAKNKRSPTPEGELPAHERYFFQNRAGPPRTSNNTLNKISLLTHEEYFEKMAQYADPCKDEKAFLLDVHHRSFPQWNFEFEQGYNICLYGYGSKRPLLQNFAEWLYQKNSSAPPSIVVVNGHTPNISIRSIFATIVTAVLGADIPSKMGSQPIEVLELLQSVLKSRSSQRPITVLINSIDAPPLRRAANQALLARLAATPKIHLLVTADTPNYLLMWDISLREQFNFVFHDCTTFAPFDTEFDVVEEVHNLLGRKGRRVGGKEGVEFVLKSLPENARNLYRLLLTEIISMFDEGHNSDDEMDGGAGRDGDGKDEVGIEFRALYQKATEEFIASSEMMFRTLLKEFHDHQMITSRLDPSGMEILGVPLPRDEMEGVLEDLVLS

SEQ ID NO: 38226 - protein, 443 aa, Polaromonas sp. JS666
MPDRRRRPLRGEQATRSETGRGWAYTPTYNLRLRPCWPAYFTCERSMNFIRFSDLCASGKAAGQRVFIRADLNVPQDDSGAITEDTRIRASIPCLQMALDAGAAVMVTSHLGRPVEGEFKPADSLAPVAKRLGELMKREIPLVTQWVDGVDVQPGQLVLLENCRLNPGEKKNSEALARKMAALCDIFVHDAFGTAHRAEASTYGIAQYAKVASAGPLLAAEMDAISTALSNPRRPLVAIVAGSKVSTKLTILKSLASNVDQLIVGGGIANTFMLAAGLKIGKSLAEADLLPEARAVIEAMKARGAAVPIPTDVVTAKTFAADATATVKAATDVEDDDLILDIGPETTARLAAQLKAAGTIVWNGPVGVFEFDAFSRGTEGIARAIADSSAFSIAGGGDTLAAIAKYGIEKQVGYISTGGGAFLEVLEGKTLPAFEILQKRAAG

SEQ ID NO: 38227 - protein, 219 aa, Zea mays
YVKSRNDAQLRDASKANQTSACEPEKTTANGQPIVPCGLIAWSLFNDTYNFTRGNENLTVDKKDISWKSDREHKFGKDVYPSNFQNGALKGGATLDPKIPLISIDFLFMWKKTVWMRTAALPTFRKLYGRIYIDLKENDTITVTLNNNYNTYSFGGKKKLVLSTATWLGGKNDFLGFAYLIVGGLCIFLAFAFTLLYFVKPRKLGDHNYLSWNRRHAGR

SEQ ID NO: 38228 - protein, 263 aa, Pseudomonas syringae pv. phaseolicola 1448A
MSAVQLADGELNYLLEGPAGAPVLVLSNSLGTDLHMWDNQIPAFIRHFQVLRYDTRGHGKSLVSEGSYSIEQNGRDLLALLDALHIDTAFFCGLSMGGLIGQWLAINAPQRLRKVVLCNTAARIGNPDIWNPRIETVLRDGQSAMVALRDASVARWFTPSFAHAEPAVVDTVVGMLARTSPQGYAANCAAVRDADFREQIASIQLPVLVVCGTEDAVTTPADGRFMVERIKGSQMIELHAAHLSSVEAGESFTVLVLAFLTAE

SEQ ID NO: 38229 - protein, 324 aa, Azoarcus sp. BH72
MPRQPVIALVATGGTIAGTADTPGAVTGYTAGVLGAEALLAAFPGLGEIAALRAETLFSLDSKDMAPAHWLALAQRVQALADDPAVDGVVITHGTDTLEESAFFVHLTVATAKPVVFTAAMRPATALSADGPMNLLAAVRVAAAPAFHGLGTLVAINDRVYAARDVQKQRTHGLDAFGAGEGAAVGRSDPARPGLLVNRDGGSCAAALASAALPAVEVLYVAAGASPALLDAVRGSGAAGAVLAFPGNGSVPEAWKPAIDAALHAGMVLVRASRVPAGPVGHDTRLPASLLSAGDLPPSKARVALMLALACDRPQRFCTLAAPH

SEQ ID NO: 38230 - protein, 390 aa, Methanosarcina acetivorans C2A
MHRRLGGVLEVESKVRLRTIHDLSVAYTPGVAEPCRKIKENPSLVYLYTIKKNTVAVVTDGSAVLGLGNIGPCAALPVMEGKAIIFKEFAGIDAFPICLNTQDTEEVIKAVKYLAPAFGGINLEDISAPRCFEIESRLREELDIPVIHDDQHGAAIVVFAGLLNALKIVKKELGELKILITGLGAAGVAIFRFLVRAGADPAKILTCDSQGIVYEGREKDMNPIKAEIATLTNPGKLKGGLKEAFPGTDLFIGVSVGGIVTEEMISSMANDAIVMAMANPTPEIMPDAAKRAGARIVATGRSDFPNQLNNCLSFPGVFKGALGTCARKITPEMEMAAAHALANVVSVGELSEDYIIPEPLDKHVVPAVAKAVANASLESCAARRSLEDEL

SEQ ID NO: 38231 - protein, 520 aa, delta proteobacterium MLMS-1
MIENRENPERRSDDAGDCTLLNGADLPSCTIVIFGASGDLTARKLIPALQNLFRQGCLPPRWNIVGCGRSPMDHEEFRQSLVAFHEQANPDAEEWRRDWPQFAANIFYQELSYDRAEDYRALATLLDRLDRERGSAPNRVFYLAVPPALYPLIGEQLGAAGLATAADNCWSRIVVEKPFGHDLPSAVALDGVLHGSFTEQQIFRIDHYLAKETVQNILMLRFANTIFEPLWNRSYIDYVGIISSEKLGVEHRAGFYESAGVLRDMFQNHMMQLLALTAMEPPSRFEAAQVQDEKVKIFRALKPFDRANLAAHLVLGQYGPGTIDGRPVAGYRQEPEVAADSATPTFAAMKLLIDNWRWRGVPFYLVSGKRMPAKETRIVIQFKEVPHSMFRRELAASIMANRLVLGIHPEEKISLNFQAKNPGTKECLQPVTMDFNYERRQSPHPHFDAYEMVLLDCILGDHMLFWRQDGIELSWSFLDPILRACEECNNPEKLLQSYPAGSPGPEAAHPWLRLLNDFNG

SEQ ID NO: 38232 - protein, 365 aa, Azoarcus sp. BH72
MPLSSQLRHLLLPALAAAALLLPPAAHAREAAAPARLAKVVILATGGTIAGAGADAASSATYQAAKVPVEKLVAGIPELKNLAEVRGEQVFQIASESFTNEHLLQLGRRVAELSASADVDGIVITHGTDTLEETAFFLNLVIRSDKPVVVVGSMRPGTALSADGALNLYDAVAVAASSDARGKGVLVTMNDEIHSGRDVSKAVNIRPDAFRSPWGPLGMVVEGKPYWFRLPAKRHTLNSEFDIARIQSLAPVEIAYGYGNVSDTAYKAFAAAGAKAIIHAGTGNGSVSNRVVPGLQALRAQGVHIVRSSRVDGGGFVLRNAEQPDDKYDWVAAHDLNPQKARILAAVALTTTSDSRELQRIFWEY

SEQ ID NO: 38233 - protein, 206 aa, Ustilago maydis 521
MVGTLVLTRHGQSEWNKLNLFTGWKDPALTELGREEALTGAKRVAATGIKFDVAFTSALQRAQTTLGIQLKEIGQEDIPIHKDQALNERDYGELSGLNKDDARKKWGEDQVHIWRRSYDIPPPGGESLKLTAERVWPYYHKEILPLVKQGKNVIVAAHGNSLRAMIKDIENISDDDIVGLELATGVPILYKLDSDGKVVSKEILQG

SEQ ID NO: 38234 - protein, 236 aa, Brassica napus
TQVAYAVGTDSRIGPKFLNASVGFGGSCFQKDILNLVYICQCNGLPEVAEYWKQVIKINDYQKNRFVNRIVSSMFNTVSNKKVAILGFAFKKDTGDTRETPAIDVCKGLLGDKAQISIYDPQVTEEQIQRDLAMKKFDWDHPLHLQPMSPTTVKQVSVKWDAYEATKDAHAVCVLTEWDEFKSLDYQKIFDNMQKPAFIFDGRNVLNVDKLREIGFIVYSIGKPLDAWLKDMPAFV

SEQ ID NO: 38235 - protein, 152 aa, Arabidopsis thaliana
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (88)..(88): Xaa can be any naturally occurring amino acid
  misc_feature (93)..(93): Xaa can be any naturally occurring amino acid
  misc_feature (105)..(105): Xaa can be any naturally occurring amino acid
  misc_feature (126)..(126): Xaa can be any naturally occurring amino acid
  misc_feature (144)..(144): Xaa can be any naturally occurring amino acid
MASSMLSSNAVVKSQAQATMVAPFTGLKSSASLKVTRKANNDITSITSNGGRVSRMKVWPPIGXKKYQTLTXLTXLGESERLRKLAKXLRNKXVPSVELELQHGXMLRDHGYTPGYSDGWYWTMWXLHMFGILESAQVFKAVKXCNYEYPGA

SEQ ID NO: 38236 - protein, 308 aa, Methanothermobacter thermautotrophicus str. Delta H
MLNPSDFIEEAVEEIRSTVGNEKAIIALSGGVDSSVASVLAGRAIGDNLTAVFVDHGLLREGEAEYVRKTFSERLNFRYIDASEEFLKELEGVTDPEEKRKIIGRVFIEVFERVAEEIGARYLVQGTIAPDWIESEGQIKSHHNVALPHGLVLEIVEPIRELYKDEVREIGLELGLPREMIQRQPFPGPGLAVRIVGEITREKIEICRRANAIVEEEVVESGLHESLWQYFAVLTDTMVTGVKGDVRDFGYLVVIRMVESLDAMTASVPELPWDLIKRISKRITAEIPEVTHVALSVSDKPPSTIEFA

SEQ ID NO: 38237 - protein, 514 aa, Capsicum annuum
METWFIIVVTLCISFFLKSIFDIIISSNSKSKKKLPPGPYTWPVIGTFLWARRGIIDVERILVDLKAKYGPMITLNMGTRTTIFVSSHSLAYQALVQKGSVFSDRESVDSNNETRVINSAPYGSTWRLLRRNLTSEMLHPSRIKSYSKARAWVLDILLKQLRGKQDDSVKLVDHFQYAMFCLLVLMCFGDKLDEPQIKKIENMLVKFLLGLRRFKVLAIFPRLGKLIFGKLWKEFYELGQEQEKTYLPLIEARIKAKEQKTEHGELEDEFVTCYVDTLLNLEWPDEKRKLNHREIVGLCIEFLTAATDTTSTALQWIMANLVKNPTIQDKLYQEIASVVGEKKSESTEEVVKEEDLQKMPYLKAVILEGLRRHPPGHILFPHKVTEEVELNGYVIPKNVTINFMLADMALDPNVWEDPLEFKPERFLVEGSDKESFDITGSREIKMMPFGAGRRICPGYALAMLHLEYFVANLIWHFQWNPVEGYGVDLSEKQEFTVVMKNPLRARICPRVNTL

SEQ ID NO: 38238 - protein, 315 aa, Rhodobacter sphaeroides 2.4.1
MTASKPGRIAVVGSNMVDLVTYITRMPAPGETIEAPDFEIGCGGKGANQAVAAAKLGSAVSMVTKVGDDIFGENTRRNLAQHGIDIRHVETVAGKSSGVAPIFVEASGENSILIVKGANADLLPADVDTAEETLRAADLILMQMEVPRETVIHTVRRAAEWGVRTILNPAPAAADLNVDDLRDLSFLVPNESELALISGLPTGSEEEIAAAALSLIERGIGTVIVTLGGRGARLVTRAGVVPIAPVRVTPVDTTGAGDAFIGAFAHFLAATGEVEGALAHAARYAAHSVTGRGTQKSYATPEAFEAFCRALPPSA

SEQ ID NO: 38239 - protein, 355 aa, Thermoanaerobacter tengcongensis MB4
MYRIAVLPGDGIGPEVIEEGLKVLKAVEEKYGLRFDIKKYPFGGEAIDKYGEPYPEETRNGCLSSDAVLLGAVGGPKWDGLEGDKRPEAGLLALRKSLGVYANLRPAVLYPSLKDASPLKNELLEKGLDILVVRELTGGIYFGPRGKEAIGYGFRAYDTEVYETQEIERIAVIAFEAALRRRKKITSVDKANVLESSRLWRKTVEEVAKRYPEVELNHMYVDNCAMQLVKNPFQFDVILTNNMFGDILSDEAAQIVGSIGILPSASLRGDRVGLYEPIHGSAPDIAGKKIANPLATILSVAMMLQYSFGEEEAAQDIRKAVERALEEGFRTADLGKGIVLSTEEMGDKVVEYIKG

SEQ ID NO: 38240 - protein, 382 aa, Xanthomonas axonopodis pv. citri str. 306
MPLTTKLPKVGTTIFTVMSQLAAEHGAVNLGQGFPDFAVPQRLVDELSKAMAAGHNQYPPMTGVATLRQAIAGKAQRCYGAQVDADTEITVTSGATEAIFNAIHAVVRAGEEVIVLDPAYDCYEPAIDLAGARAVHVALHPQTFAVDWDALRAAITPKTRLLMINSPHNPSGAMLSAEDMQTLTELLRGTEIFLLSDEVYEHIVFDGRRHESVLRWPALRERAFVISSFGKTYHCTGWKIGYAIAPPALTAEFRKVHQYNTFTSFGPAQHAFAAMIRDEPEHDEQLGAFYQAKRDRFREQLLATRLKPLPVPGGYFQLVDYSAISDLPDTEFVKWLTIENGVAAIPLSPFYENAPAGQRLARLCFAKNDATLDAAIERLRRL

SEQ ID NO: 38241 - protein, 486 aa, Glycine max
MVEKSSRTNLGHHQDFGMEAYSIDGVSSQSESKFYDDDGHVKRTGNVWTTSSHIITAVVGSGVLSLAWAMAQMGWVAGPVVMIFFSAVTLYTTSLLADCYRCGDPVTGKRNYTFMDAVQSILGGYYDTFCGVVQYSNLYGTAVGYTIAASISMMAIKRSNCFHSSGVKNPCHVSSNPYMIGFGIIQILFSQIPDFHKTWWLSIVAAIMSFAYSTIGLALGIAKVAETGTFKGSLTGVRIGTVTEATKVWGVFQGLGDIAFAYSYSQILIEIQDTIKSPPSEAKTMKKSAKISIGVTTTFYMLCGFMGYAAFGDSAPGNLLTGFGFFNPYWLIDIANAAIVIHLVGAYQVYAQPLFAFVEKWASKRWPEVDTEYKVPIPGFSPYNLSPFRLVWRTVFVIITTIVAMLIPFFNDVLGLLGALGFWPLSVFLPVQMSIKQKRTPRWSSRWIGMQILSVVCLIVSVAAAVGSVASIVLDLQKYKPFHVDY

SEQ ID NO: 38242 - protein, 791 aa, Rhodobacter sphaeroides 2.4.1
MSIKDIMESMDYGPAPEAATDAKAWLAARGHALGHYIDGAFTGAETAAIEVENPATGEILARIPAAGEAEIEAAVAAARAAFSGWSQLPGFERARYLYAIARGLQKRERFFSVIETLDNGKAIRETRTADVPLAIRHFYHHAGWAAVLGEEFPGHEPLGVCGQVIPWNFPMLMLAWKIAPALAAGNTVVLKPADLTPLTAVAFAEMLEEIGLPRGVVNIVHGGAETGALLVRHPGVAKVAFTGSTAVGREIRRATAGSGKSLTLELGGKSPFVVCADADLDAAVEGVVEGVWFNQGEVCCAGSRLLLQEGIAERFLAKLRARMEKIRVGDPLDKSTDMGAIVSARQKARIEELIAGAAREGYRLEQAACPLPAAGHFVAPGFFADTEPAATVAQVEIFGPIAVTTTFRTVDEAVALANNTPYGLAASVWSENINAATELAARIRAGVVWINASNLFDAGAPFGGMKESGFGREGAREGLGAYLRPRTPRGPEALVAPVDFTAHTGTGGSLTGLIDRTMKNYIGGAQVRPDGGASYVVRGPKGEALGLAPVSGRKDIRNAVEAALKAKGWAASAHGRAQVLFFLAENIAARAEDLAAALVQGGAGRSEAAAEVRSLIERVFFYAGMADKDDGRIHATKPRHLTLSVKEPLGVVGVLAPDEAPLLSLMSLILPLIAAGNRVVAVPSPAQALLAQPLTQIFDTSDLPGGVVNLVTGDRDLLARTLAEHDAVDGLWYHGSAKGAAEVEALSAGNLKQVWTNGGRALDWNADAVACGRSWLDRATQIKTIWVPYGA

SEQ ID NO: 38243 - protein, 427 aa, Bordetella parapertussis
MVCRPGRTIPQETAMNMPAPAATRRDRIEDELGAHNYQPLDVVLARGSGVWLYDTAGRRYLDCLSAYSAVNQGHCHPRILAAMVEQAQRLTLTSRAFRHDQLAPLYEDLARLTGAHKVLPMNSGAEAVETALKAVRKWGYEARGVPAGQAEIIVCANNFHGRTLGIVGFSTDPDARGGYGPFAPGFTVVPFGDFAALQAAVTPRTVAFLVEPIQGEAGVILPPPGYFRQVRKLCSERDIVLILDEIQTGLGRTGAFLAEAHEGIEADVTLIGKALSGGFYPVSAVLSNQAVLGIFQPGQHGSTFGGNPLACAVARAALRVLHDEGMIDNAREQGAYFMQRLRALPGPVREVRGRGLMLALELEPDAGPARAYCERLMARGMLVKDTHGQTLRLSPPLIVTREQIDWACAQLAHVLAHSAPGSSGGPS

SEQ ID NO: 38244 - protein, 571 aa, Corynebacterium glutamicum
MHYAHLRTKDLRGLQQRLSSVGATRLTTTEPAVQARLKAARNVIGAFAGEGPLYPPSDVVDAFEDADEILDEHAEILLGEPLPDTPSCIMVTLPTEAATDIELVRGFAKSGMDLARINCAHDDETVWKQMIDNVHTVAEEVGREIRVSMDLAGPKVRTGEIAPGAEVGRARVTRDKTGKVLTPAKLWITAHGSEPVPAPESLPGRPALPIEVTPEWFDKLEIGSVINVPDTRGSRRAFTVTRVFDGAVLAEGPQKAYISNGTLLEHNYDRSRVYGIPAVVQRINLKVGDRLILTDEELTYDPSLGSGRTPRISCTLPQAVDAIKVGHRVLFDDGAIAAVCIDKASTTDGFNDVELEVTRARPQGVNLAAYKGINLPDSELPLPSLTEEDLQHLRFVVQYADIAAISFIRNVADVEYLLQALADIGDPAAVERLGLVLKIETIPGYEGLAQILLTGMRHENFGIMIARGDLAVELGFDRMAEVPQLIMALAEAAHVPTILATQVLENMAKNGLPSRAEITDAAMALRAECVMLNKGPHINDAIKVLTKMSRKLGASQRKSRLLLRKVKSWEE

SEQ ID NO: 38245 - protein, 514 aa, Vibrio angustum S14
MDITKNNNATPLLDIIVIGGGINGAGIAADAAGRGLNVALYEANDFASATSSASSKLIHGGLRYLEHYEFRLVSEALAEREVLLKKAPHVAEPMRFRLPHRPFLRPAWMIRSGLFLYDNLGKRTTLPASKKINLAQSGLLKPEMKVGFEYSDCWVDDARLVLLNIMAIEENGGEVANYCKVESAVREGDIWRVTMVEQRTGEHFERRTKALVNAAGPWVKQFFDNGLETPSPRNIRLIKGSHIVVPKIHNEEQAYILQNKDNRIVFVIPYLDDFSIIGTTDLEYKGDPRHVAIDETEIDYLIDIVNQHFVDQLDREDVVWTFSGVRPLCDDESNSPQAITRDYTLELEQELDQAPLLSIFGGKLTTYRKLSESAMKHLEPFFPQMGKSWTANQALPGGNFSCSRKQLAESLQSRYPWLSDKQALRYVKQFGSYCFRMLADVTCIDDMGIQFADGVYQKEIDYVIANEHVKTVDDFLWRRTKLGLYLTDEQQLQVKEYIDANAPSNNIVSFHKVG

SEQ ID NO: 38246 - protein, 126 aa, Photobacterium profundum SS9
MDLKPIHTGQCHCGAVKFTVKLPNGLEKLRRCDCSMCRRKGAIVASVTLSNLTITAGEDVLRLYQFNTHTAKHYFCSNCGIYTHHQRRSDPTEFGINVGCLEGINPYELGEVPVSDGVNHPADRKS

SEQ ID NO: 38247 - protein, 340 aa, Bacillus cereus ATCC 10987
MTKITVVGAGSWGTALAMVLADNGHDVRIWGNRSELMDEINTKHENSRYLPGITLPSTIVAYSSLEEALVDVNVVLLVVPTKAYREVLQDMKKYVAGPTTWIHASKGIEPGTSKRISEVIEEEIPEDLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNLLGKGHSLEEVLESMGMVVEGVRTTKAAHELAEKMEVEMPITAALYDVLFNGNNVKDAVGSLMGRVRKHEVEAIPDLL

SEQ ID NO: 38248 - protein, 764 aa, Chlamydomonas reinhardtii
MKRNTSNVDTGGVPAPLNSTPSTRLIQNGYGDSKYETERMEFPFPEDPRYHPRDSVKGAWEKVKEDHHHRVATYNWVDWLAFFIPCVRWLRTYRRSYLLNDIVAGISVGFMVVPQGLSYANLAGLPSVYGLYGAFLPCIVYSLVGSSRQLAVGPVAVTSLLLGTKLKDILPEAAGISNPNIPGSPELDAVQEKYNRLAIQLAFLVACLYTGVGIFRLGFVTNFLSHAVIGGFTSGAAITIGLSQVKYILGISIPRQDRLQDQAKTYVDNMHNMKWQEFIMGTTFLFLLVLFKEVGKRSKRFKWLRPIGPLTVCIIGLCAVYVGNVQNKGIKIIGAIKAGLPAPTVSWWFPMPEISQLFPTAIVVMLVDLLESTSIARALARKNKYELHANQEIVGLGLANFAGAIFNCYTTTGSFSRSAVNNESGAKTGLACFITAWVVGFVLIFLTPVFAHLPYCTLGAIIVSSIVGLLEYEQAIYLWKVNKLDWLVWMASFLGVLFISVEIGLGIAIGLAILIVIYESAFPNTALVGRIPGTTIWRNIKQYPNAQLAPGLLVFRIDAPIYFANIQWIKERLEGFASAHRVWSQEHGVPLEYVILDFSPVTHIDATGLHTLETIVETLAGHGTQVVLANPSQEIIALMRRGGLFDMIGRDYVFITVNEAVTFCSRQMAERGYAVKEDNTSSYPHFGSRRTPGALPAPSSQLDSSPPTSVTESTSGTPAAGTYSSIGGAVPAVAGHTAAGNGGSHSPSAQPGVQLTTTGSQRQQ

SEQ ID NO: 38249 - protein, 629 aa, Oryza sativa Japonica Group
MAQVVAAAGTAAAVAAVGRPLGGGGSGADALRPAARLSFAPRWCGGSAGAARARRESAVTSVISRAPRLDAEVLPVSADDDADVKEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKSYTEYDVLMLECFFAVYASSGGIGPEVRSGDLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQVRKQNLRPDDNTTLALLASFNCELKIV

SEQ ID NO: 38250 - protein, 367 aa, Yarrowia lipolytica CLIB122
MFIGGLNWETTDESLTNYFAQFGEVLECTVMRDHFSGKSRGFGFLTFRDPKCVNAVMAKEHYLDGKIIDPKRAIPREEQDKTSKIFVGGVGSDVTEEDYKQFFEQYGTVIDAQLMIDKDSGRPRGFGFVTFDSEQAMNTILAQPLLILKDKPIEVKRAENRSKGAGASAVANAVAGPSHGGGNHNYNNNHSHGGTADAAAAPAQNSYGGMTPQAMTQWWQQYMQYMQQVQQMQGGAAADPEAQQAMMAQMMAQMQQQQQPQGQSHQQRDNHHQQSRERDHHNDESSDDNEMRRVDRGRDDRSGRRGRGYNQSDRRSRSPGVPTGPRDGRQRGRRHGGGRGRDRRDGGRAPGYHPYGGSRDRQQGRRD

SEQ ID NO: 38251 - protein, 346 aa, Prochlorococcus marinus str. NATL2A
MTNTQAPQESTSAVPSDRLWLRSELMGTQVITRDTGRRLGLVGEVVVDIDRREVVALGLRDNPLTRFLPGLPRWLPLDQIRQVGDVILVDTIDSLSENFVPERFNKVINCQVITESGDQLGRVLGFSFDIETGELLTLVMGALGVPLLGEGVLSTWEMPVDEIVSSGPDRIIVYEGAEEKLKQLNSGFLEKLGVGNSGWEESERERYRVNLVPVENQLTSGESVNDDQRLLEQSQEIFEEEEMEYVELQDSEEQQYNKELRYLDEPNQSSIYSEIDEDVVNYSESNFKKRTDDFQAKFSSKNTKNKSKIIRDEEPMDVEPLEDLTINNSQDMISNDNQLIDIEDPW

SEQ ID NO: 38252 - protein, 355 aa, Methylobacillus flagellatus KT
MSDILKGCRDQIDAIDEQLLELINARAALAREIGELKGEGPIYRPEREAQVLRRLLEKNTGPLSAEAVTAIFRSVMSNCRALERELSVAFLGPQGTYSEEAAIKQFGGLNNPKPCMSIDEVFRMVESGNADYAVVPVENSTEGAVGRTLDLLTTTSLHICGEVALPIHHCLLRRRHADGEIRRIYSHAQSLGQCHEWLNLNLGGVERVSTGSNAQAAELAAQDAFAVAIAGRRAADIFGLDILAENIEDDPKNVTRFLVLGKHEAAPSGQDKTSLLLATKNVPGAIVGLLTPLAEHGVDMTELGSRPSKLGIWDYVFFVDIKGHYQDPAVARALHELEQRASMFKILGSYPVAVI

SEQ ID NO: 38253 - protein, 256 aa, Oryza sativa Japonica Group
MDAVMSAADDAGAASGREDPPPAVVLVSAGASHSVALLAGNVLCSWGRGEDGQLGHGDAEDRLVPTVLSGFDAAAPGITSVICGADHTTAYSEDEQQVYSWGWGDFGRLGHGNSSDVFTPQPVKALQGIKIKQIACGDSHCLAVTMAGEVQSWGRNQNGQLGLGTTEDSLLPQKIQSFEGVCVKMIAAGAEHTAAVTEDGDLYGWGWGRYGNLGLGDRNDRLVPEKVSSVENMFLKIPSLYATGLYCQSVTISLLS

SEQ ID NO: 38254 - protein, 197 aa, Zea mays
ANITADLVFFQNGLLDPWFKSKGLVGANQVLAYFAVSKVGEPPVDGITDTNPEGLTAAFGSWAPAVAARLQNGGLTCKVLEKEAFQKQMLEKLIWISAFMLVGARHPGATVGVVEKNYRSEVASLIAELASAAAAEEQLTFAEGMEDRLCAYSRAVAHFPTAVKEFKWRNGWFYSLTEKALAAGKPDPCPLHTAWLE

SEQ ID NO: 38255 - protein, 476 aa, Pseudomonas putida KT2440
MTTSHYIAGHWVEGQGSDCISVNDPALGQPFAELMAASVSQVDQAVAAARSALPAWKSTCASERAAFLRGFAEQLGQRREALVTVQMRNNGKPRHEAEIDLDDAIATFGYYAELAEQLPSKNRTVPLAAPGFTARTRLEPVGVVGLIVPWNFPLVTSAWKLAPALAAGCTVVLKPSEVTPLIEQAYGQIADALGLPAGVLNIVNGKAETGAALSNHNGLDKLSFTGSNSVGSQVMRSASAQCRPVTLELGGKSAIVVFDDCDVDQAVEWIVAGISWNAGQMCSATSRLLVQDGIADALLPRLQAALENLRVGNPLTEEVDMGPLTSQAQWLKVASYFATAREEGLQCLAGGHALDREGWFVSPTLYTDVPKDSRLWTEEIFGPVLCARRFATEEQAIAEANDSRFGLVATVCSADLERAERVADALEVGHVWINSVQAVFVETSWGGTKGSGIGRELGPWGLSAYQSIKHVTRCLG

SEQ ID NO: 38256 - protein, 534 aa, Oryza sativa Indica Group
MFPLVRSLRRLGPAAADGRLLLPVAPLSSKAAAPPPEYEMPSVTWGVIQGRKERLVSRVLALDFLRSAGVSDPAGELEAVELPSSLEVLQERLDFLLRLGLSTDDLSAYPLLLACSLRKNAIPVLSYLEKIGVTRARLAAFVRAYPACLHASVAVDLAPIVKSLRGLDVDRQDLPRVLERYHDILGLKPDGTISTSVAYLVGIVGVAPRDIGPMVTHFPFFLGMRVGTTIKPLCEYITSLGLPMRILARILEKRPYILGYDLEETIKPNVEALLSFGIRREMLPLVIAQYPPILGLPLKTKLAAQQYFFNLKLQIDPDAFARAIEKLPQLVSLHQNIILKPVEFLRGLESRIKPRYMRVATKGIRCSLDWFLNCSDQRFEERMRGDFIEGDAPGLSLLMDWIGMDKMDWILIWLALDWGEWVDAVNGLIWWRIIPKIFRDVLLTVSCTQAIPSLSVNSCLVVRICKLKFANHAGILNCKMKKALALMEHSHTNRGHWSAGLSNSSKGLTKVADVLRDSLWALVMCDFETKTGDS

SEQ ID NO: 38257 - protein, 398 aa, Pseudomonas putida KT2440
MPHDGSLLQATVVFLLAVVLLVPLAQRLKMGAVPGYLLAGILIGPSVFGLLGNPDNVARLSEMGVVMLLFVIGLELSPKRLWTMRRALFGVGSLQVGLTAVLLGLLAFWLFDQSKPAAIVLGLGLALSSTAFGLQVLAERKDLGKPHGRMAVAILLFQDIAAIPLIAVVPLLGGDVSTADEGAWPLLAVVVGIGVLIVFGRYLLTPIFKWTVGSGLPELSTATALLVVLGTAWLMEHVGVSMALGAFLAGVLMAESPFRHELETQIEPIKGLFLGLFFVGVGMSADLRLLFGMPLMVLGLTLLLVAIKLPLLYGLGRTMGGLNKSQALCLGVVLASGGEFAFVVFKLALEHQVLTQAVHDLLVLAITLSMAVVPLVMMALARQLHDDSPVQASPETGQ

SEQ ID NO: 38258 - protein, 852 aa, Arabidopsis thaliana
MSRTRTAASEAHDSMESEERVDLDGDNDPEEILEEEVEYEEVEEEEIEEIEEEIEEEVEVEEEEEEEDAVATEEEEEKKRHVELLALPPHGSEVYLGGIPTDATEGDLKGFCGSIGEVTEVRIMREKDSGDGKGYAFVTFRSKDLAAEAIDTLNNTDFRGKRIKCSTTQAKHRLFLGNVPRNWMESDIKKAANRIGPGVQIVELPKEPQNMGRNRGFAFIEYYNHACAEYSKQKMSNPSFKLDDNAPTVSWAESRSGGGGDSSASQVKALYIKNLPRDITQERLKALFEHHGKILKVVIPPAKPGKEDSRYGFVHYAERTSVMRALKNTERYEIDGHMLDCTLAKPQADQKTNTNTVQNVQKSQLQPNYPPLLSYGMAPSPFGALGGFGASAYSQPLMHAGGHAAGGMSMMPIMLPDGRIGYVLQQPGLAAMPQPPPRHSPPYRGGSGSSSSSGSKRSSDNERLKYDYNTGKANAITTMRNQGFTKEDRMNQLPEDLILRILSFLPTELVIATSVLSKQWRSLWKLVPNLEFDSDDYERIAFARHLRELVLYVAPKQTFTFPSSLCICNTLETLKLILGIHVDIPCPVLLKSLRTLHLDSVSYKDEESIRNLLSSCPILENLVVYEYWYNVVNFDIEVPSLKRLEICDVLHKKEFRRYTINVPCLKYLRIEGLNKDFELCLNAPELVEAYFTKGSLIIADKFLGSLKSAKRLSLDILALKMHTRREEWWNLLTVMLDSSPKLQVLKLIDHTQDVSKDNVVSEKWNEPKYVPECLLSHLETFVWIRYDWEREEEKEVATYILRNARWLKKGTISTNPIESKDLEKLEERRKMLNELDSVVRASNSCNLVFEFE

SEQ ID NO: 38259 - protein, 325 aa, Kineococcus radiotolerans SRS30216
MSTTAALDVVTMGRVGVDLYPLQDDVGLEDVETFGKYLGGSATNVAVAAARHGRATAVVTRTGNDAFGRFVHRALAGFGVSDRFVSGVEGLNTPLAFCEIYPPDHFPLLFYRQPTAPDLQIRAEELDLDAIRDAGVFWTTVTGLSEEPSRGAHHAAWAARARKPLTVLDLDYRPMFWASPQEATEQVRRALPHVTVAVGNREECEVAVGETEPRRAAEALLAAGVEVAIVKQGPKGVLGATRNPDGGTAFVEVPPTPVAVVNGLGAGDGFGGALCHGLLAGWDLERTLRFANAAGAIVATRRECSTAMPFTSEVEALLEEVAARA

SEQ ID NO: 38260 - protein, 490 aa, Kineococcus radiotolerans SRS30216
MSTTPGRSAAPGGGVHDALPPLTDGPHRRRLGVVALIATFGGLLFGYDTSVINGALEPMVRELGLTTLTEGVVTSSLLFGAAVGAISGGRLSDAWGRRRSILLMSLFFFGGALVCVFTPNFEVMVVGRVVLGLAVGAASTVVPVYLAEMAPYEIRGSLSGRNEMMIVVGQLAAFVVNAIVGNVWGEHAGVWRIMLAFVTLPAVALFVGMLRVPESPRWLIDHGHYDEALAVLRTLRSEERAEAEARQIAGLTHEDSKRVPMDWRSVLSHRWLRRILLIGTGLGVAQQLTGINSIMYYGQSILGEAGFSSSAALIANVAPGVIAVVGAFIALRIMDTFSRRRTFVLGYSLTTACHLLIGIGSVLLPVGNPLRPWVILFLVVAFVGSMQTFLNVATWVTLSEIFPQRMRAFGMGTSVFVLWITNALLGLWFPTLVSALGITGCFFGFAVVNLLALVFVKTQVPETRGRSLEQLEEAVTSGAIHDRAVRDGLA

SEQ ID NO: 38261 - protein, 269 aa, Crocosphaera watsonii WH 8501
MTPTAVITGASAGIGQATAILLAQKGYNLVLAARTNDRLEAVAQQAIELGSQVLAIPTDVTDVKQVNNLVEKALDTYTQVDILINNAGICMTAPMSQTSLEDWQKILNVNLWGYIYPIHALLPHFLSRQQGTIVNVGSFGGKMPLPNMTAYCTSKYAVTGLTETLRLELEPKGIHVCGVHPSVTNSDFLERAVFRGPQETYSEQMRASMKDILNSPLASQPQDVAKAIFQIIEHPQREVVVGTGAIATSLYSLAPSLSQWLLQQSQGKS

SEQ ID NO: 38262 - protein, 357 aa, Oryza sativa Japonica Group
MGGGSGVGDEEAEAEAAAAAEVTGRGGARGDVGGGGGGAGEAAAAVRTGGERRRRCGRVGGVEIPGGVGSQLAANSEVNDSVVPANSEVRLRFQVACLSGSVSTGMPALKGHSRGLLFSPQIPNLSSPKLSPTPMAGRYYTPQTHPPPPPENTLDVFMDGDTIPIHTTITSSHSLAAQFINEIARERPQGGLIVGIDTEWRTDHLPNGKTCYKVAVLQLCVGRRCLLFQIYQAGNMVPHELAEFLADPSVRFVGVAVNNDMQRLANDCNLRVACAVDLRYAAAAVLGQPELARAGLKRLALTVMGAHMEKEKNITKSRWGEPTLTWEQVNYACIDAYVSYEIGRRLLSGEPILAAPL

SEQ ID NO: 38263 - protein, 207 aa, Glycine max
YTYPYLRSYLLYFRVYLCPETSQYSSPGGQVSALSPTLYGPVNRSCVIDAISDPTAPKHAIQAFHLLSTSREAQAVVASLACDPNVWNAVMENSAVSSFFQSQQSVAGFGAAENSEEVDKLSSCASETVESPEKLEGSAESHPGNMFDDFMGLLQNVKLTVIELVSRLSGFLQNIFPTPDAMREKIMGGTFIGLAVLVIMVIVTKRA

SEQ ID NO: 38264 - protein, 467 aa, Vitis vinifera
MVMKSDSTVSIYDCSSSKEIRSFAVPNMSAATMSPCGTYLQTFQRPSTPQEKNVILWKTETGAPVYQHFQKNMTKTTWPSVQFSSDEAIACRLATNEIQFFDARDFSKEIIYRVRIPGIAAVELSKAPGSHVAAFIPESKGIPASVQIFACGENSMSQPVARRSFFRCSTVQLSWNRGSTGLLVLVQADVDKTNQSYFGESKLNYLTTNGTHEGLVPLSKEGPVHDVQWSYSGSEFAVVYGFMPAKATVFDKKCNPLVELGTGPYNTIRWNPKGKFLCLAGFGNLPGDMAFWDYKEKKQLGTTRAEWSVTSEWSPDGCYFMTATTAPRLQVDNGIKIFHPNGSLYFKTMFDKLYQADWKPESPDRFGEIAELAQSIDSLKVGETKQQGQGSKSSVAPNKATSANPPTQKPAAYRPPHAKTAAAIQTKLFGGSSTEEMSKNAAKNKKKREKQREKKAAEAATAANNGA

SEQ ID NO: 38265 - protein, 276 aa, Penicillium camemberti
DVSTSELDQFEFWVQYAAASYYEADYTAQVGDKLSCSKGNCPEVEATGATVSYDFSDSTITDVAGYIAVDHTNSAVVLAFRGSYSVRNWVADATFVHTNPGLCDGCLAELGFWSSWKLVRDDIIKELKEVVAQNPNYELVVVGHSLGAAVATLAATDLRGKGYPSAKLYAYASPRVGNAALAKYITAQGNNFRFTHTNDPVPKLPLLSMGYVHVSPEYWITSPNNATVSTSDIKVIDGDVSFDGNTGTGLPLLTDFEAHIWYFVQVDAGKGPGLPF

SEQ ID NO: 38266 - protein, 237 aa, Bacillus cereus ATCC 10987
MQQSKEERVHDVFEKISDKYDVMNSVISFQRHKAWRKETMRIMDVKPGSKALDVCCGTADWTIALAEAVGEQGKVVGLDFSENMLSVGKQKVEALQLKQVELLHGNAMELPFEDNTFDYVTIGFGLRNVPDYMHVLKEMTRVVKPGGKVICLETSQPTMIGFRQGYILYFKYIMPLFGKLFAKSYKEYSWLQESASTFPGMKELANMFEKAGLERVQVKPFTFGVAAMHLGMKPESK

SEQ ID NO: 38267 - protein, 345 aa, Oryza sativa
  misc_feature (274)..(274): Xaa can be any naturally occurring amino acid
  misc_feature (295)..(295): Xaa can be any naturally occurring amino acid
MLLAKPHLSSSSFLPSTRVSSPAPGPNHAKPIAASPAPRRCLRLAVTSAAAPAASSAEAAAALSRVDVLSEALPFIQRFKGKTVVVKYGGAAMKSPELQASVIRDLVLLSCVGLHPVLVHGGGPEINSWLLRVGVEPQFRNGLRVTDALTMEVVEMVLVGKVNKHLVSLINLAGGTAVGLCGKDARLLTARPSPNAAALGFVGEVSRVDATVLHPIIASGHIPVIATVAADETGQAYNINADTAAGEIAAAVGAEKLLLLTDVSGILADRNDPXGSLVKEIDIAGVRQMVADGQXVAGGMIPKVECCVRALAQGVHTASIIDGRVPHSLLLEILTDEGTGTMITG

SEQ ID NO: 38268 - protein, 484 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERVDMPVLSTPRLRETTSALTRYEKV

SEQ ID NO: 38269 - protein, 200 aa, Methylobacillus flagellatus KT
MAVLVGKPAPDFTAAAVLGDNSIKEDFNLYEHIKGKPAVIFFYPLDFTFVCPSELIAFDHRLEEFKARGIEVIGVSIDSHFTHLAWKNTPVDKGGIGKVGYPLVADIRHEIAKAYDVESDGGVAYRGSFLINKEGIIVHQVVNDLPLGRDIDEMLRMVDALQFFEAHGEVCPAGWKKGKAGMSASPEGVAKYLAENAASL

SEQ ID NO: 38270 - protein, 307 aa, Rickettsia conorii str. Malish 7
MQENLKLVWQNASNLKNKEVDSISSLNNIAIIKNIIKCSSELKNQAIVLKLPATIIIDDKLFTAFIESVRLLEMCGAKIYIVHDHIDLRSSSLISQIDENFSQKISKISDYSSLNNPIIMEILSSYVNKLIVTKLSSIGCYAVGISGKDANLLQAKKSKLSYRKIVNHDVINIGFLSEPIMINPEILLNFADNNIIPVIAPFASDDQEKTHLLNVNLTLATIASALSAEHLILPYEILQVSETFPYNIKIRDINLLKSMLDDSNNFIEEALIKIAVNALENNNGYVHFVNSEAPNSILSTMFDININ

SEQ ID NO: 38271 - protein, 371 aa, Yarrowia lipolytica CLIB122
MSNNLASLINEELQRATPTPAQRLNVIEQAISRRVEAEYKDDIIAHMATMQQQTLPEASMMDLQPELEWHMRPYLLDFIVETHVTLRLQPQTLFLAINLIDRYCSKRVVYKKHYQLVGCTCLWIAAKYEDKKSRVPTISDLKHMCCGAYEEDMFCQMEGHVLNTLEWTVGHPTTDSYLDLFLGPESQQVTQTIRHVSRYLCEIALYPRTFFSFAPSLVASCARTLAYHILGIPCPNPNMHSSIYPSSAGGNSAEMHCLSTLAQHMQQPSRAVQKKYSRQSYCNAAQIVQSFVSQAANSNPTAIPNPATPPPTLSAPHSPASSIHTTFSEASTPSSAYFPISQQNSPANVKQHFSPQVYSMSNLSNVSVNYR

SEQ ID NO: 38272 - protein, 588 aa, Azoarcus sp. BH72
MHHFSASRYRMDHEAFPFLKETILFLALSGVLIPLLARLRINPVLGFLAVGTALGPYGLASFVPAHPWLAYVTFPRQEEVETLAELGVIFLMFMIGLELSVDRLWSLRRQVFGLGTLQVALTAALIGGIAHLFGNTTEASVILGLVLSFSSTAIVMQLLIQRGELGGPLGQAAFAILLLQDLAVVPLLVLLSILGAGNSEGSFALLLGTAAAKGLVTVGLIYLIGRRLVRPVFHQITVSRQPDTFMALTLLTTLGVAAMTWAAGLSMALGALLAGLIIAETEFRHEVEVTIEPFKGLLMGLFFLSVGMGIDLRALLAEPLWIPLAVAGLMIIKGAVVFALLRLFGLSWGRAVEGGFLLGQGGEFAFIVIGLALSFKLLPRDVGQFMLLAVGLSMLATPVVARLGRELGAAMDRRQPPAAQEDAEFGTLRGHVLIAGYGRVGQMVGQMLAEQGVPHVAVETDAKLVAGQRKTGAAVIYGDASRPELLRKLHLDRALAVVLTMDHTAAAVHAVKGIRQSNPHVRIIARARDEKHALTLREAGASVVVPETLESGLKLTGSVLETLGVPADAASRLLEQERDRRIVAFRES

SEQ ID NO: 38273 - protein, 212 aa, Pseudomonas syringae pv. phaseolicola 1448A
MTLRLGDIAPDFEQESSEGRIRFHEWLGDSWGVLFSHPADFTPVCTTELGFTAKLKDEFAKRGVKAIALSVDPVDSHIKWIDDINTTQNTQVNFPILADADRKVSDLYDLIHPNASDTLTVRSLFVIDPKKKVRLTITYPASTGRNFHEILRVIDSLQLTDNYKVATPANWVDGDDVVIVPSIKDEAEIKERFPKGYKAVTPYLRLTPQPNR

SEQ ID NO: 38274 - protein, 362 aa, Mesorhizobium loti MAFF303099
MLNRQKIRTTAGRGRLFDSILDTVGDTPVIRVNNLGPAHATVYVKAEFFNPAASVKDRLALNIIEEGERSGALKPGQTVVEATSGNTGIGLAMVCAQKGYPLVVTMADSFSVERRKLMRMLGAKVVLTPRAEKGFGMYKKAVELAEANGWFLARQFETAANAAIHEATTAREIINDFAGSRLDCFVTGYGTGGTVVGVARVLRRERPDTRIVLSEPANAQLIGSGKAQQRGAHGAPAASHPAFEPHPIQGWTPDFIPNVLQEAIDASLYDEVMPIAGPEGIKWAKALAQKEGIFTGISGGATFAVARQVAEKAPAGSVILCMLPDTGERYMSTPLFDGIEAEMDAEEMALSRSTPGGQFPAA

SEQ ID NO: 38275 - protein, 598 aa, Candidatus Protochlamydia amoebophila UWE25
MALIRTKIVCTIGPACNSLEKIIELINVGMNVARLNFSHGTQEEHLRTINLLKEARCQLNLPLAIMLDTKGPEIRLGKIRDGQIFLTVGQKWRLVKKEVLGDESQVSIFPLNILDQLPVGTTILFDDGYIASRVIENSSEGVLVEINNSGMIRSSKGVNIPNTSLNLPAVTEKDIDDIRFGCSQDIDLIAASFVRSAEHVLEIKRLLADEKKTDILVIAKIENSEGVQNFDSIVQAADGIMIARGDLGVEVPLSHVPRLQKMMIRKSYLAGKPVVTATQMLESMINNPRPTRAETSDVANAIYDSTSAIMLSGETAIGRYPVETVNVMRSIVEEAEADFNYSTFFDQHAPLVYHDVPSAVTLATVKTAYSSSAKAIFAFTKAGTTARLLSRLRPKMPIIAMTAKEKIFHQLAFNWGVIPFLSEPCNSLDKSLKKISDFALGSQHVSYGDLVVITAGTPFGFSGTTNMMIVENIGDVLVRGHSGYGIRVHGNVVIVLAPQSKAPYAVKDQVLVIAKCDESYLSLMKEASAIILQNHINDFASEKYAKKIALSLGKPILLRADAACQILKEGQLVTLDPEKALVYKGVVLDQLLASGEFS

SEQ ID NO: 38276 - protein, 182 aa, Pseudomonas syringae pv. syringae B728a
MTFDQSNFKSLIRPVVDFPKPGVVFRDITPLFQSPKATRQVIDSFVQRYIDAEFSHIGVMDARGFLIGSVVAYQLNKPLVLFRKQGKLPADVLSEAYQTEYGEAYLEVHADSLCEGDSVVMFDDLIATGGTLIAAANLIRRMGAEVYEAAAIIDLPELGGSKRLNDLKIPTFCLTEFALDEQ

SEQ ID NO: 38277 - protein, 416 aa, Prochlorococcus marinus str. NATL2A
MNNLVKNIAEKSRNDFPLFNGDINKNLIYLDHAATSQKPKQVIDSLKKYYSFQNANVHRGAHQLSALATEKFENSRKLTANFINSKNEKEIIFTRNATEAINLVAYTWGNYELQENDEILISLMEHHSNIVPWQLIAKAKKCKLIYINIDKNGELDFDDFKKKLSDKTKIVSLVHVSNTLGCCNPIEEISSLAHQKGSLVLLDACQSLAHKQVDIKKLGIDFLAGSSHKLCGPTGIGFLWGREEILKKIPPFLGGGEMINEVFKDNSTWAELPHKFEAGTPAIGEAIGMGTALQYLQSIGLNEIHNYEKELTKYLFEKLEEIDDLKILGPSPLIQPDRGPLATFYIKGIHSNDVAELLDNSNIYIRSGHHCCQPLHRFYGIKSTARASLSFTSTPSEIDSLAEELKSVISFLKKNS

SEQ ID NO: 38278 - protein, 404 aa, Bacillus pumilus SAFR-032
MSGNKGVVYKGAGNVAVEDIGYPDLILRDGPGVPKANVGRKCEHGVILKVVTTNICGSDQHMVRGRTTAPAGLVLGHEITGEVVEVGRDVEFIQKGDLVSVPFNIACGRCVMCKEQKTHVCLNVNPDRPGSAYGYVDMGGWVGGQSEYVMVPYADFQLLKFPDKDQAMEKILDLTMLSDIFPTGFHGAYTAGVKPGSTVYIAGAGPVGLAAAHSAQLLGASTVIVGDLNEQRLEQARSFGCETINLRKHDRIGEQITNILGEPEVDCAVDCVGFEASGHGDQGEAPATVLNTIMDITKVGGKLGIPGLYVTEDPGAVDADAKVGSLKVRIGLGWAKAHTFVTGQTPVMQYHRSLMKSILSGRAQIAKAVNATVINLDQAPQGYSDFDSGVAKKFVIDPHGMISR

SEQ ID NO: 38279 - protein, 178 aa, Triticum aestivum
  misc_feature (51)..(51): Xaa can be any naturally occurring amino acid
  misc_feature (64)..(64): Xaa can be any naturally occurring amino acid
MAAAGDAGEKKMITLKSSDGEEFEVEEAVAMESQTIRHMIEDDCADNGIPXLPNVNSKILSKVXIEYCNKHVQAKPADGAAAGAGAGASDAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 38280 - protein, 570 aa, Pseudomonas putida KT2440
MPQPTRFDWQRWLPGLVTLLHYKAAWLPKDIAAGLVLTTMLVPVGIAYAEASGVPGIYGLYATIIPLLAYALFGPSRILVLGPDSALAAPILAVVVQYAASDPQRAIAIASMMALVAGAFCVIAGLLRLGFITELLSKPIRYGYMNGIALTVLISQLPKLFGIKVDSEGPLRDLWYLGQALYAGQGHWPSFVVGAGSLALILLLKPFKRLPGILIAVVLATLAVSVFNLDQMGVKVLGQLPQGLPGFVFPWVSDIDLVEVLLGGIAVALVSFADTSVLSRSYAARLKMRVNPNQEMFGLGVANVASGLFQGIPISSSSSRTPVAEAAGSQTQLTGIIGALAVTLLLLVAPNLMQHLPNSALAAVVIAAALGLFEFADLKRIFRMQQWEFWLSFTCFVGVAVFGAIPGICIAVAVSVIEFLWDGWRPHYAVLGRADGLRGYHDIQRYPQARRIPGLVLLRWDAPLFFANAEQFQNTVMAAVDASPTPVQRVVIAAEPVTSIDITSADMLAELDRALEARGVELQFAEMKDPVKDKMRQFELFEHMGEKAFHPTVGAAVDAYLEESGVDWQP

SEQ ID NO: 38281 - protein, 366 aa, Pseudomonas putida KT2440
MGFNCGIVGLPNVGKSTLFNALTKSGIAAENFPFCTIEPNSGIVPMPDARLAALAEIVKPNRILPTTMEFVDIAGLVAGASKGEGLGNKFLANIRETDAIAHVVRCFEDENVIHVSNSVDPKRDIEIIDLELIFADLDSCEKQLQKVARNAKGGDKDALAQKAILEKLIPHFTEGKPARSLMKHMADDEKAVIRGFHLLTSKPVMYIANVAEDGFDNNPHLDVVKAIAEEEGAVVVPVCNKIEAEIAELEDGEEKDMFLEALGLEEPGLNRVIRAGYELLNLQTYFTAGVQEVRAWTVRVGATAPQAAGVIHTDFEKGFIRAEVVAYDDFIQFKGEAGAKEAGKWRLEGKDYIVKDGDVMHFRFNV

SEQ ID NO: 38282 - protein, 522 aa, Gibberella zeae PH-1
MGKVLDTDKLGSVFGTRPDILTGIQKAADSPARIDLFNEIATHVYDQLLSGSAEPAHKKRRVDLQQANGAANGTKPATKVQTNAADESVLLEIKEISVSVPQRKKFELCFTDGHIYARAPNTTAPIPAITYAWSDIEYAFYLPVPEKNQVQHNYILFPRGTCLPSKTNPPTEEPLVFTVPATPPKQGTIGGPDAGSAAAVSDNYKSLFHWALNRHLKPIGVDITASNPNKFQSMVRQPHRPSEKAVHVKAFRGSKDGYLFFLETGILWGFKKPLMFIPLNRIAATSFTNILQRTFNIAIEVFAGEGDATEEVEFSMIDQEDYGGIDDYIKNKRLQDRSMAEQRKAKLELAENRAKKTGEEGEEVEAAAGGDISELAKAQLDAEQALQDEEDEDEEDYDPGSDADSDGSGESDDDDSDDDDEDDEDDEDDEGEENPEEEGDEGDDQAEEEEEEEEVKPEVKPKKEVKPKVKEVKKEVKAEPARSPPKPVQQPTVKSGWAALRSVPRAPAPESMDLDEEKFDVV

SEQ ID NO: 38283 - protein, 313 aa, Pseudomonas putida KT2440
MSKMMVFTGNANPDLARRVVRQLHIPLGDVSVGKFSDGEISTEINENVRGKDVFIIQPTCAPTNDNLMELVVMADAFRRSSASRITAVIPYFGYARQDRRPRSARVAISAKVVADMLTVVGIDRVLTVDLHADQIQGFFDIPVDNIYGSPVLVDDIEDQRFENLMIVSPDIGGVVRARAVAKSLGVDLGIIDKRREKANHSEVMHIIGDVEGRTCILVDDMVDTAGTLCHAAKALKEHGAAKVYAYCTHPVLSGRAIENIEKSVLDELVVTNTVPLSAAAQACDRIRQLDIAPVVAEAVRRISNEESISAMFR

SEQ ID NO: 38284 - protein, 519 aa, Welwitschia mirabilis
MATALMSISALVLLLLALNCICSGGQGQRESFGGSQRRDACRRVLDQGLSPRDPEQFPYRSRSEGGYFEYATPREFNDLDCAGVAIIRETIEPNALSLPRYTNTPHLAYVTHGRGLFGLVIPGCPPNFRDPFSSEQEQQRGRSERGADQESPDTCQKIRRVQQGDVVSVFAGATFWWYNDASNEQLRLVAIADVSNNQNQLDRDYVTFLVTGQAPIRQTSRRRGEEEETREGGDSGDVAQGIFGTFSARFLARTLHTSNDTISRIQQQQQQQGQGLHVRLQDKREEGLDIPYPRRRGDESESEVRRGRESTSKEGKRMANGVAEETVCSMRMRHFLDNPNDAEVYVAGGGRMNTVNRQKLASLRFVKLAADRVSLRPGAMFAPSWVTNAHRVIYVTRGRGFVQIIGDNGNQVFSGEVREGQFLVIPQQCPAVKEASSNDNFEWVAFLTHDTPVREKLAGVTSLIDGLPREVLAAAFGVDEAQAEEFKRESYRRREYGPILSSVSSSASYGGRALPSFEA

SEQ ID NO: 38285 - protein, 361 aa, Medicago sativa
MKALILVGGFGTRLRPLTLSVPKPLVDFANKPMILHQIEALKATGVTEVVLAINYQPEVMLNFLKDFEAKLGITISCSQETEPLGTAGPLALARDKLIDDSGEPFFVLNSDVISDYPLKEMIEFHKSHGGEASIMVTKVDEPSKYGVVVMEETTGQVEKFVEKPKLFVGNKINAGIYLLNPSVLDRIELRPTSIEKEIFPKIAAEKKLYAMVLPGFWMDIGQPRDYITGLRLYLDSLRKKSSSKLAGGSNIVGNVIVDETAKIGEGCLIGPDVAIGPGCIVESGVRLSRCTVMRGVRIKKHACISSSIIGWHSTVGQWARVENMTILGEDVHVCDEIYSNGGVVLPHKEIKTNILKPEIVM

SEQ ID NO: 38286 - protein, 275 aa, marine gamma proteobacterium HTCC2143
MIKSFENKTIIITGASAGVGAACARLFANHKAKLVLVARGEAALNIIADELRSQCEVLTVVMNVANNDDCLTLLEKAEATFGAVHVLINNAGMHARGNLETVAPLDVAAMVDINLRAPLLLSGAAIPYLQRAGEGAIVNVGSLAGRAPLQGAATYSATKAGLRAFSYALADELRDSGISVGSVSPGPIDTGFIMDEIDEVEDIVFSQPMSTAQQVAEGIMAVASGDEVEVVLPAASAKLTHISYLFPKLRRRLRPKLYEQGRKNKEKYRNRQTDK

SEQ ID NO: 38287 - protein, 333 aa, Rhizobium leguminosarum bv. viciae 3841
MTQKRPIFAVAPMIDWTDRHCRYFHRQISREALLYTEMVVADAIIHGPRDRLLGHDAAEHPLALQLGGSDPAKLAEAVKIAEPYFYDEINLNVGCPSDRVQSGTFGACLMLTPEMVAECIAAMKRVATVPVTVKCRIGVDEQEPEQALPELITRVLDAGADAIWIHARKAWLKGLSPKENREIPPLDYEIVYRMKQRWPDVFIGINGGIRTLDEAATHLAHVDGVMLGRAAYQNAAILADIDQRFFGAPASEPDWEALRDRMMAYAERHIASGGRLQHVARHMVGLFTGLPGARRYRQILSTDAAKSGAGPEVLAAAFAAVDFSGTEQEAVSA

SEQ ID NO: 38288 - protein, 372 aa, Yarrowia lipolytica CLIB122
MSFRNVSLRGSQLLGKLDSRGWGWYVAKKWNIGLVYTMCKVFLRCKKVDIKGLDNLLEAHRQARLEGRGLLTVMNHTSVLDDPVVWGMLPNDNGWIPYLMRWATGAKDICYKNKLYSLFFGAGQVLPITRFGIGGPFQPGMDMCVRLLNPNNKIKYSAKYTPYLVHTNATSYPFWRESNWVHFFPEGYVHQALEPHEGTMRYFRWGTSRAVLEPVTPPIIVPMFSHGLQKVFQEIPKGYEMEGNNTNKDRTISIRIGEPISETTVAGFRNEWINLCHKENVGLNAETMPDVLKNGQEAKDLRSKVAAYLREEVEKLRLTVPNMNPELPEFKEPEFWSDIDKVHKGVYNHRGKVRMLRNPTKGLIEVVEANKD

SEQ ID NO: 38289 - protein, 198 aa, Physcomitrella patens subsp. patens
MIAAIANYLKYDVYDLELTEVQSNDALKRLLRDTKSRSIIVIEDIDCSLDLAGKRDTEPNSSRSEGVRNVTLSGLLNSTDGLWSCCTDERIIMFTTNYVEKLDQALIRPGRMDMHIHMSYCNFESIKSLAYTYLSIESHPFYDTIRNLLNEGILITPAQVTEHLYANRSDPTAAMQSITAELEQLNDTALRPGVSEPS

SEQ ID NO: 38290 - protein, 351 aa, Methylobacillus flagellatus KT
MKIAVLPGDGIGPEIVAQAVKVLKALDLDLELQEAPIGGAGYEAAGDPLPDATLKLAKEADAVLLGAVGDWKYDTLPRDKRPERGLLRIRKELNLFANLRPALLYPELASASTLKPEVVSGLDIMIVRELTGDIYFGQPRGISTLDNGEREGVNTMRYNESEIRRIAHVAFGIAQKRNKKVCSVDKANVLETTELWRQVMIEVAKEYPDVELSHMYVDNAAMQLIRAPKQFDVMVTGNIFGDILSDEASMLTGSIGMLPSASLDQGNKGMYEPSHGSAPDIAGQDVANPLATILSAAMMLRYTFNDEANASRVENAVKKALEQGYRTADIWTEGTSKVKCSEMGDAVVAAL

SEQ ID NO: 38291 - protein, 348 aa, Erwinia chrysanthemi
MERWFKSLFIIAFFFISTANAADKLPNIVILATGGTIAGSAATGTQTTGYKAGALGVDTLINAVPEVKKLANVKGEQFANMASENMTGDVVLKLSQRVNALLARDDVDGVVITHGTDTLEESAYFLHLTVKSDKPVVFAAAMRPATAISADGPMNLLEAVRVASDKQSRGRGVLVVLNDRIGSARYITKSNASTLDSFRANEEGYLGVVIGNHIYYQNRLDKLHTNRSVFDVRGLASLPKVDILYGYQDDSEYLYDAAISHGVKGIVYAGMGAGSVSVRGIAGMRKAQDKGVVVMRSSRTGNGIVPPDEALPGLVADSLNPAHARILLMLALTRTSDPAVIQDYFHTY

SEQ ID NO: 38292 - protein, 120 aa, Lactobacillus delbrueckii subsp. lactis
MKVGFIGLGNMGSAIARAVAKCDDVSLLLSSHNPEKAGKLQAEIGGQLLDNAQVAAEATVVFLGVKPYQVASTIKEIGENSNNGSIWISMATGVSLETLAKLLPGHDLVRMMPNTPVAIG

SEQ ID NO: 38293 - protein, 458 aa, Aspergillus oryzae
MLQRKIWVRRPGGSATLVPTAHDALVDELRDQVIMKYANSLGKTFDAPDIVVRIAAREGSNKQATPDRMLSPEEPLVTVVDSYFPGGQTIEEALIIEIPPRRTPKPSPRHSIYYEQTEPGEHNEYFPLMPIHPNIPTPPAHASNSSGSASAHPAPSISILTTGMAPPLPSPGSRGNRHTRRPPLTRHTTNSPTVLGQSTSSKEAGAQQTAIPPQPAPQVPTPPVPPPESPQNKSMTPPARGASPRPRQSVKPKKSPAQSLSAAFGGLIEGTVPPINVLIVEDNVINQRLLEAFMKRLSVRWKCAANGEEAVKKWREGGFHLVLMDIQLPVMNGLDATKEIRRLERLNGIGVFPKTASGRSSAASATAMTPPEIDPETHDSLEEEDVLHDLSLFKSPVIIVALTASSLQSDRHEALAAGCNDFLTKPVRFEWLEQKVTEWGCMQALIDFEGWRKWRGRL

SEQ ID NO: 38294 - protein, 236 aa, Pyrococcus horikoshii OT3
MSQDWKEYAKRVLDEWQPRTKLGMLVKEGQITDIHEIFRRGYQIKEPEIIDVLLPEVNARENQEIIDIALTVRMTDSGRRVRFRVLAAVGNRDGYVGLGIGHGREVGIAIRKAINYAKLNIIEIKRGCGSWECRCRRPHSVPFAVEGKEGSVRVRLIPGPRGLGLVIGDVGKKILRLAGIQDVWSQTFGETRTTVNFAKAVFNALYNTNRVVVTPEMIERYGIVVGRAMPTSFTLE

SEQ ID NO: 38295 - protein, 678 aa, Azoarcus sp. BH72
MNAVADLARSDWHHWRIERSPDAILWLWLDRAGASANTLSAAVLDEFEVVLAALEANLPAALVIASAKPAGFVAGADIEEFSALPDPHAARALVERGWRLFDRLAALRCPTLALIRGHCMGGGLELALACRYRLVVDEPATRLALPEVMLGIVPAWGGMRRLPALIGPVAALDMMLTGRSLDARRARRIGLADDCVPPRVMENAARVLVSSGQRPALPGLLARLLNGPLKPLVAARAQRQTAARVSRAHYPAPFAIIDIWARHGGNALAVPAGDPASLETIFASPTAHNLARVFFLRERLKGFGKQAAFAPRQVHVVGAGIMGGDIAAVCALAGLRVTLQDQGVDRIAPAIARAARLFERRLRGDARAQRLALDRLIPDPQGRGVAAADLVIEAISENLDAKRALFADLEARARPDALLATNTSSLRLADIAAGMRTPARLVGIHFFNPVAKMPLVEVVSAAATAAEDAARAAAFVRLLDKLALPVRDVPGFLVNAALAPYMLEALRCVEEGVAPAVVDAALTRFGMAMGPVELVDTVGLDVALAAGKALAAGAEVPPQLAARVAEGKLGRKTGEGYYRWAPQPGGEARIVGRAPVEAVPEGLAERVLAPLLAAVRHSVAEGVVADADLADAGLIFGAGFAPWTGGPLHHAQGRDFRIGASAAKQQTGPAPTTQQVSR

SEQ ID NO: 38296 - protein, 307 aa, Bacillus pumilus SAFR-032
MAVIKDITELIGRTPLLKLSGIGIPEGVEVYAKLEMMNPGGSIKDRLGDMLIREALASGKLRPGGTIIEATAGNTGIGLALSARKHQLRTIFCVPEHFSQEKQQLMKALGAKIIHTPRKEGMKGAINRALELEASLDNAYCVLQFKNQVNPLTYYKTLGPELWSDLQGNIDVFVAGAGSGGTFQGCAAYLKEQHPALKTVVVEPEGSILNGGDPGPHKTEGIGLEFIPDYMESALFDEIYTVSDHDAFRMVKEAAEKEGVLIGSSSGAALFAALEEARKAAPGTVIVTIFPDSSERYLSKGIYEGGK

SEQ ID NO: 38297 - protein, 798 aa, Aspergillus oryzae
MAAAFDDEDLSVPLPSYDHDRRRERASGATSPNSNFAGMTMPPPSRPIGRGGDPSMQSPATTRDMQRLDQYQTVKVLGEGSFGKVKLAIHQPSGRQVALKIISRRKLLSRDMVGRVEREIQYLQLLRHPHIIKLYTVIATKTDIVMVLEYAERELFDYLVKRGRCNDAEARKFFQQIICAVEYCHRHKIVHRDLKPENLLIDSEKNVKIADFGLSNIMTDGNFLKTSCGSPNYAAPEVISGKLYAGPEVDVWSCGVILYVLLVGRLPFDDDYIPALFKKIAAGNFHMPPYISSGAARLIRSMLQVHPVHRLTIPEIRQDPWFQKDLPKYLQPPPEEFIATGVDPNKAIDPRKIAPGKPISVQHKIHQVAIAKLERNMGYGREDIEDALKNPEPSAIKDAFFIIVENEMMQTNSPTDENLMPPTPLPPSDRTSLSSAAAGRTTAAHSQGTRAGPPTRTRSGSQRQPFQLHQPSESDDLETSRVSHVRILPTSLPYVHDQLMEQRERERRARAADRLAEEQARSGSDALEDPHQSGLDGRSLEEQEATAKALKPHSRSIVDLDKLRLEPPEARNAPHQPRKTRKWQFGIRSRNQPYEAMLYLYKAIAAQRGRWEILPAESGTQIGSQSPDEPTPLQSKYPDLPSDYYIPKDPWFIRARLLKEGVKAPGSSGSVHSSRSDISELRRRFNLTGGASSVDEKSHSPSEHWSTSGPSSASQHHSIPRVAYGVWVFVDIQLYQLEENNYMVDFKCDGYQNVIRAESDTEWHPISKRFRNKEKEITSPYPFLDVASDLVAQLAVAS

SEQ ID NO: 38298 - protein, 351 aa, Candida glabrata CBS 138
MFCKLFHKTFNWISIFLNLIQSFDLPTDYTETSTTASALKQVHIQQTHKMVSEAEFLASYPQKCPAGSLPGTPGNTDEAQEGALKQLRSELEAAGFKERLDDSTLLRFLRARKFDVALAKEMFENCEKWRKEYGTNTIMQDFHYDEKPLVAKYYPQYYHKTDKDGRPVYFEELGAVNLTEMEKITTQERMLKNLVWEYESVVNYRLPACSRAAGYLVETSCTVMDLKGISISSAYSVLSYVREASYISQNYYPERMGKFYLINAPFGFSTAFRLFKPFLDPVTVSKIFILGSSYQSELLKQIPAENLPSKFGGKSEVDEAAGGLYLSDIGPWRDAKYIGPEGEAPEMFSMK

SEQ ID NO: 38299 - protein, 429 aa, Pseudomonas aeruginosa PAO1
MRAELNQGLIDFLKASPTPFHATASLARRLEAAGYRRLDERDAWHTETGGRYYVTRNDSSLIAIRLGRRSPLESGFRLVGAHTDSPCLRVKPNPEIARNGFLQLGVEVYGGALFAPWFDRDLSLAGRVTFRANGKLESRLVDFRKAIAVIPNLAIHLNRAANEGWPINAQNELPPIIAQLAPGEAADFRLLLDEQLLREHGITADVVLDYELSFYDTQSAAVVGLNDEFIAGARLDNLLSCHAGLEALLNAEGDENCILVCTDHEEVGSCSHCGADGPFLEQVLRRLLPEGDAFSRAIQRSLLVSADNAHGVHPNYADRHDANHGPALNGGPVIKINSNQRYATNSETAGFFRHLCQDSEVPVQSFVTRSDMGCGSTIGPITASQVGVRTVDIGLPTFAMHSIRELAGSHDLAHLVKVLGAFYASSELP

SEQ ID NO: 38300 - protein, 352 aa, Triticum aestivum
MCVEGFEDAQIERPADFAMERVCENTVSIDFKQAKMVTAMGESWHNFVPAIRSGDWSDIGGRDYMEDAHVCIPNLAKNFGYNMVDDEVISFYGVFDGHGGKDAAQYVRDNLPRVIVEDAAFPLELEKAVRRSFMQTDSQFAEKCSLQDGLSSGTTALTAMIFGRTLLVANAGDCRAVLSRRGATIEMSKDHRTCCLNERKRVESLGGYVDDGYLNGQLAVTRALGDWHLDGLKEMGKPGGPLSAEPELKMITLTKDDEFLIIGSDGIWDYFSNQNSVDFARRRLQEHNDLRRCCKEIVEEAIRRGATDNLTAVMVSFHQEAPPQIRVNRAGRVERSISAEGLHSLRVLLEGQ

SEQ ID NO: 38301 - protein, 219 aa, Schizosaccharomyces pombe 972h-
MSLVPEHGNVYVLNQTNQLKGLFTIIRDKTKPRSEFIFYANRIIRLIVEEGLNHLPVSSAKVTTAQNAEYEGVMFDGRICGVSIMRAGESMEQGLRECCRSVRIGKILIQRDEETHKPVLHYIKLPEDISKRYVLLLDPMLATGGSAICAMEILINMGCKQEQIIFLNVIASPEGLKNVHDRFPNIRIVTAVIDEGLDNNGYIVPGLGDFGDIYFGTKA

SEQ ID NO: 38302 - protein, 369 aa, delta proteobacterium MLMS-1
MSFAQFDFDATLTANIAACGYQAPTPIQTQAIPEIRRGRDIMGLAQTGTGKTAAFVLPLLQKLSAGPRGRVRAVIVAPTRELAEQIHVNIGELGRQTGIRSVAVYGGVSKFGQLKAFKAGVEIIVACPGRLLDHLDSRDVNLGAVEMLVLDEADMMFDMGFMPAIKKLLKYLPAKRQNLLFSATMPAEIRHLADSILKDPARVQINHTQPTALVAHKLYRVEKQGKGALLKQVMQESAFSSALVFTRTKHAAKKLALNLEKAGHRAVALQGNMSQNKRKAAMEGFKQGRFNIMVATDIAARGIDVAGISHVINYDMPATVEAYTHRIGRTGRAERNGEAYTFATAEDKVIVRQIERAIGSRMITLETPR

SEQ ID NO: 38303 - protein, 433 aa, Crocosphaera watsonii WH 8501
MREVAEQLQAKVLYGEKRLNNLVFNYLIAAMQMQHAITQLNDNDLVVTPSDRGDVIMGALQAHHSTNYPNLAGILLTTECHLENSIAQLIAGLSHPLPILWVDTYTYPTASRLQTIYSSLEAGDMEKINWSIELFDKYVNLSILEHLIDEIEIDGITPKMFTYNLIQTAKANKRHIVLPEGKDNRILKAVATLTSQDIVDITLLGERNRIERTIQSYGIQLDIDKLNIIDPIKSPKLEQYTQTLYKARKNKGVTLENAKDMLMDVSYFGTMMVYAGDADGMVSGAINTTGNTIRPALQIIKTKPEYKQVSSVFFMCLEDRVLVYGDCAINANPTAEQLAEIAIISAETSQTFGVFPRVALLSYSSGNSGIGEDVERVKQATIVAKKRHPDLLFEGPIQYDAAVDRTVAAQKMPDSKVAGEATVFVFPDLKYRQ

SEQ ID NO: 38304 - protein, 425 aa, Pseudomonas putida KT2440
MAFLALGINHKTASVDVRERVAFTPEQLVDALQQLCRLTSSREAAILSTCNRSELYIEQDHLSADAVLQWLADYHRLSIDELRASAYVHEEHDAVKHMMRVASGLDSLVLGEPQILGQMKSAYAVAREAGTVGPLLGRLFQATFSAAKQVRTDTAIGENPVSVAFAAVSLAKQIFADLGRSQALLIGAGETITLVARHLHEQGVRRIVVANRTLERASILAEQFGAHAVLLADIPQELANSDIVISSTASQLPILGKGAVESALKQRRHKPIFMVDIAVPRDIETEVGELDDVYLYTVDDLHDVVAENLKSRQGAAQAAEELVSVGAEDFMLRLRELAAVDVLRAYRQQSERLRDEELQKALRLLANGGNPEDVLAQLARGLTNKLLHAPSVQLKKLSAEGRLDALAMAQELFALNEGSTDKSPQ

SEQ ID NO: 38305 - protein, 468 aa, Kineococcus radiotolerans SRS30216
MTVTEQSVPQTAPGAPGPARAARDHLWMHFARMGAYQDRPAPVIVKGEGAHVWDDRGHKVLDGLSGLFVVQAGHGRAELAEVMAKQAETLAFFPVWGYATEPAVQLAERVASYAPGDLNRVFFTTGGGEAVESAWKVAKQYFKLTGKPMKHKVISRATAYHGTPQGALAITGLPAMKQAFEPLTPGGFRVPNTNIYRAERMGAPTDPVAFGAWAAARIEEAILFEGPETVAAVVLEPVQNSGGCFVPPPGYFQRVREICDRHDVLLVSDEVICGFGRHGTMFACEKFGYQPDIITCAKGMSSGYGPIGAMIASDRIMEPFLEGKNFFPHGYTFGGHPVSAAVSLANLDIFEREGLNQNVLDNEQALGDTLRRLLDLDIVGDVRGDGYFWAVELVKDKATKETFDLAERETLIKQFLPGALFRNGLYARPDDRGEPVIQVAPALTTGQAEFDEMEQVLRATLTEAMRLV

SEQ ID NO: 38306 - protein, 447 aa, Xanthomonas axonopodis pv. citri str. 306
MSSSAQPHKQTRQTIVRLLSSMASAKEISQYLKRFSQLDAKRFAVVKVGGAVLRDDLDALTSSLSFLQEVGLTPIVLHGAGPQLDAELSAAGIEKHTINGLRVTSPEALAIVRKVFQASNLKLVEALQQNGARATSITGGVFEAEYLDRDIYGLVGEVKAVNLAPIEASLQAGSIPVITSLGETPSGQILNVNADFAANELVQELQPYKIIFLTGTGGLLDADGKLIDSINLSTEFDHLMQQPWINGGMRVKIEQIKDLLDRLPLESSVSITRPSDLAKELFTHKGSGTLVRRGERVLRATSWDELDLPRLKSLIESSFGRTLVPDYFDTTTLLRAYVSENYRAAVILTDEGQFGAGRLTYLDKFAVLDDAQGEGLGRAVWNVMREETPQLFWRSRHNNQVNIFYYAESDGCIKQEKWKVFWYGLENFEQIQHCVAHCATRQPTLLG

SEQ ID NO: 38307 - protein, 343 aa, Xanthomonas axonopodis pv. citri str. 306
MSLKHFLNTQDWSRAELDALLTQAALFKRNKLGSELKGKSIALVFFNPSMRTRTSFELGAFQLGGHAVVLQPGKDAWPIEFNLGTVMDGDTEEHIAEVARVLGRYVDLIGVRAFPKFVDWSKDREDQVLKSFAKYSPVPVINMETITHPCQELAHALALQEHFGTQDLRGKKYVLTWTYHPKPLNTAVANSALTIATRMGMDVTLLCPTPDYILDQRYMDWAAQNVVESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALASQAGIGNRE

SEQ ID NO: 38308 - protein, 478 aa, Kineococcus radiotolerans SRS30216
MSAEREVDREVDVVVVGAGPVGENVADRAARTGLEVVVVEKELVGGECSYWACMPSKALLRSGQALAAARRLPGAAEAVTGALDAAKVLERRDRFTSGWDDSGQAGWLESAGLGLVRGTARLDGPRRVVVETGEGAVTLTARRAVVLATGSVPVLPGVPGLAESRVWTSREATSAQAVPGRLVVLGGGVVGCELAQAWARLGSRVTLLARSGLLTGQEDFAGELVAAALRADGVDVRFGAQLSRVSRDDAGVHVVLADGSTVDADEFLVATGRRPTTSGIGLETVGLEDGGALEVDDTGLVAGVEGSWLYAAGDVSGRPKLTHQGKYGGRVVGDAITARASGALIGDAPAWSRWTTTADHAAVPQVVFTDPEVAQVGLTAAQARERGIDVKVVDYEIGDVAGASLVADGYTGKARMVVDEQRRVVVGVTFVGQDVAELLHSATIAVVGEVPLDRLWHAVPSYPTISEVWLRLLETYGL

SEQ ID NO: 38309 - protein, 94 aa, Crocosphaera watsonii WH 8501
MSIYVGNLSYDVTDADLEQVFAEYGTVKRVQLLTDRETGRPRGFGFVEMDTETEEESAIEALDGAEWMGRALRVNKARPREDRRSQGRGSTHRY

SEQ ID NO: 38310 - protein, 349 aa, Thermoanaerobacter tengcongensis MB4
MKALLLAGGLGTRLRPLTDDLPKPMVPIMGKPLLERIILNLKKSGVDEVVISTHYKSDYIENYFKGKSKELGVKIHYVTEETPLGTGGAIKNAEKFFDDTFLILNSDIVSDIDYADLVKYHKRRRAQVTIASIEVRDTSQYGVIEFDSKGFITAFKEKPKPGESNSKYINAGVYVFEPEVLKEIPANTQVSVERETYPLLLSKGYKMAIYKFTGYWMDIGTVDKYKKVHEDILKGKSRFVAGLSTRGIILGENVKIHPTASVIGPAYIGDNTEVDAYATVGPYTVIGSNCRIGQESKVSNSVLWDNIKVRRFARLENSVVTSECVVEVNMEIKNTVFTANKLADITLTP

SEQ ID NO: 38311 - protein, 306 aa, Methylobacillus flagellatus KT
MALKHFLQFNDLNADELAHIFERTRWIKEQFKAYQQYWPLTDRTLVMIFEKASTRTRLSFEAGMQQLGGSAIYLNTRDSQLGRGEPVEDAAQVISRMSDIVMIRTFEQEIIERFAANSRVPVINGLTNEYHPCQILADIFTYIEHRGSIKGKTVAWIGDSNNVCNTWLQAAEVLDFNVHVSTPPGYEVEPERANLYGTDHYEEFTDPMEAARGADLVTTDVWTSMGFEAENEERRRDFHDWQVDADMMRVAGKDALFMHCLPAHRGEEVTADVIDGAQSVVWDEAENRLHVQKALMEYLLLGKVQV

SEQ ID NO: 38312 - protein, 392 aa, Methylobacillus flagellatus KT
MSEHLMNTYARQPVTFTRGEGVWLWDTEGKRYLDALAGIAVNGLGHAHPRLVSAISEQAGRLIHVSNVYGIDEQARLAERLCEVSGMDKVFVCNSGCEANEAAIKLARLYGHGKGVESPEIIVMERAFHGRTLATLSATGNRKAQAGFEPLVSGFIRVPFDDLDAVRQVARHNKNVVAILLEPIQGEGGINLPRDSAAYLTGLREICDANGWLLMLDEVQSGMARTGTWFAFQHTDVKPDVMTLAKGLGSGVPIGACLAHGPAAEIFTYGKHGSTFGGNPLACSAALATLDIIESEGLLAHAEKLGNDIREAFTVSLQGVAGVTVIRNAGLMIGIELDRPCAELVGQALEAGLLINVTAEKVIRLLPPLIMSEQEAQQVVDILTPLIKKLLA

SEQ ID NO: 38313 - protein, 361 aa, Zea mays
MKALILVGGFGTRLRPLTLSFPKPLVDFANKPMILHQIEALKEVGVTEVVLAINYRPEVMINFLKDFEDKLGITITCSQETEPLGTAGPLALARDKLADGSGQPFFVLNSDVISEYPFAELIKFHKCHGGEATIMVTKVDEPSKYGVVVMEEATGRVERFVEKPKIFVGNKINAGIYLLNPSVLDRIELRPTSIEKEVFPQISADQQLYAMVLPGFWMDVGQPRDYITGLRLYLDSIRKKSAAKLATGAHVVGNVLVHESAKIGEGCLIGPDVAIGPGCVVEDGVRLSRCTVMRGVRIKKHACISNSIIGWHSTVGQWARIENMTILGEDVHVCDEVYSNGGVVLPHKEIKSSILKPEIVM

SEQ ID NO: 38314 - protein, 378 aa, Pseudomonas syringae pv. phaseolicola 1448A
MTKPAILALADGSIFRGEAIGADGQTVGEVVFNTAMTGYQEILTDPSYAQQIVTLTYPHIGNTGTTPEDAESDRVWSAGLVIRDLPLVASNWRNKLSLGDYLKANNVVAIAGIDTRRLTRILREKGAQNGCIMAGDDISEEAAIAAARGFPGLKGMDLAKEVSTKDTYEWRSSVWNLKTDSHPEIAASELPYHVVAYDYGVKVNILRMLVERGCRVTVVPAQTPASDVLAYKPDGVFLSNGPGDPEPCDYAIKAIREVLQTEVPVFGICLGHQLLALAAGAKTVKMGHGHHGANHPVQDLDTGVVMITSQNHGFAVDEATLPGNVRAIHKSLFDGTLQGIELTDKSAFSFQGHPEASPGPNDVAPLFDRFIEAMAKRR

SEQ ID NO: 38315 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILVLIKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTAIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDAPQNLVEQAKLTAATNAKQ

SEQ ID NO: 38316 - protein, 210 aa, Bacillus pumilus SAFR-032
MRSKPVVIGIAGGSGSGKTSVTNSIYEKFKGHSILMLQQDLYYKNQSHMPFEECLLTNYDHPLAFDNDLMFEHLEQLLRYESIEKPIYDFKLNTRSEETVHVEPKDVIIVEGIFALEDERLRDLMDIKLYVDTDADLRIIRRILRDTKERGRSIDSVIEQYVSVVRPMHNQFIEPTKRYADIIIPEGGQNHVAIDLMVTKIQTILQSRAE

SEQ ID NO: 38317 - protein, 458 aa, Bacillus anthracis str. A2012
MGYVMNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRCPEGLTEEQYDDFMIEEFKNFFISEVAPETIAAVVMEPVQGEGGFIVPSKKFAQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCTEANKRGLLLLSAGTYGNVIRVLMPLVITDEQLEEGLTIIEESLQICYEKANTARV

SEQ ID NO: 38318 - protein, 362 aa, Dehalococcoides ethenogenes 195
MQNLRIPGPTPCPEEVLTAMGQQMINHRGPEMAAIMKEVAEKLKYFFQTKNDVLVLTGSGTGGLEAAAVNFLSPGETVLSVSIGVFGERFAKIASIFGAKIIALNFEHGKAADPALVKKALAEHPEIKAVLITHNETSTGITNDLKSLASVVKGAGKLLMVDAISSLSSIDLPVDEWGCDVVVSGSQKGWMVPPGLAFISVSPDAWKANAESKMPRFYWDLAKHKASIEKGQTPWTPCVSVIVALHKALAMMEKEGMQNIFKRHQKIADFTRKGVKELGLTLLAEEKYASNTVTAVLATEGLDPKKLLKVMREEYNTVLAGGQGPLEGKIFRIGHLGWVTENDIKVTLDNLKLALPKAGFRS

SEQ ID NO: 38319 - protein, 490 aa, Ipomoea setosa
MRINPTTSGSEVSAVEKKNLGRIVKIIGPVLDVAFPPGKMPNIYNALVVQGRGNEQTNVTCEVQQLLGNNRVRAVAMSDTDGLMRGMEVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 38320 - protein, 124 aa, Streptococcus uberis
NKKAKAIFANGLTPIICCGESLETYEAGKAVEFVGAQVSAALAGLTEEQVSSLVIAYEPIWAIGTGKSATQDDAQNMCKAVRDVVAADFGQTVADKVRVQYGGSVKPENVASYMSCPDVDGALV

SEQ ID NO: 38321 - protein, 124 aa, Streptococcus uberis
NKKAKAIFANGLTPIICCGESLETYEAGKAVEFVGDQVSAALAGLTEEQVSSLVIAYEPIWAIGTGKSATQDDAQNMCKAVRDVVAADFGQTVADKVRVQYGGSVKPENVASYMSCPDVDGALV

SEQ ID NO: 38322 - protein, 1288 aa, Ustilago maydis 521
MRITHAFMERGGRYRRLLSIGLAWVALILVLFVLLTASLSAAVPVSTTAERTEGTGNEAQSHFDGEEIDHRKLLRKRHEQISSGSVATGFAHPTHLYRRDADALPPPDKAYNMSVTQGIISPDGFERLGFLMNGNFPADPFVWDENDDVEINVINNGPVPFAIHWHGIHQIGSPEMDGVPGLSQWNIYPGESYTYRFKLVNQYGGYWYHSHERGYYADGLRGTIYIRPKPGRQKPWSYISTDQDDIEQMEAAEHDSQIMSLSDHWHINHTEMLLVVHETGVPPACFDSLHINGRGRQYCVNNWSKVISPIQASLLRNFSSTNPEGITSKGCISLVPPKSGYTVKGTLDERYGGVCQNTTAPLTVFSAAKAIKKGRRWLNLQVVDTATNWYYGISVDSHKMWIVAVDGHYIQPMQVDWAQITIGSRLSVMIQLDPALDGNMFPIRLTGARALQPIEGHAFLSYIDDVDGTWNPGQEEDFGYLMRTLTTAHVPMSGFVSDPSVVKWKQNLSVPFDPINQVPQTSNMTLHAVASQNSLNVWQVATMPLDTARLADDRPILFNATDGNATLNQMTPYASIPFGTVVDVIMENNIYSIVGGPNSPHPFHMHSRRFWIIGSGAGPFPADTVAEAQGQGILFNLETPPLRDGFDIDSNSWVVIRYVADHAAANILHCHIDDHAIEGMAAVLLEGLEKIPAGGNFSDTIKARPSKWVETKNDELGQVLEASWATGSANAKYVAPAPTDTVDPWGDPRSLAQSIQLYASSNSVLKAITSSLVSEMGEVKATATGVVTAITATVSDHLTTFTGVAASSSVFATTTASVTLATVTENAVASASSTAIVATATESASASVASAQSLAAVASTTTALTLAVETLTSVLSVSASQVINTVVSATDTSAAAVATSNTVTSINTAQSTLFAIAFTTEVVTASAAETPTVKSSVETPAIITSSSTVYVTVLATVAPTLSLSSLAAQSTKSSSSAAIKTTNASSTRVSLASQTTVAAVSTASLVSLLPYTTLYATVPASTALFSTGTSTLLKLDGQTAAATTTKTATSPSLSTQSASRTDADSGIEDDDVVTEETDNIGASATTSLSSQSMSSSASLRVASANLVLTTSVVAADSTSTAQASSTVVIERAGTTTIASLNRAASTHVSASTTSARAVLTEVATTSATQTPHTTISESQASRATSQSTSTGSEAASPTANAANYGTHSAATTFLAYSTSVETSEAALTSSSATVSEDEPAYDNPVFPSSTGAVSTSTTTAATKPTNSFTSSGTGNEGESGGYDTQADG

SEQ ID NO: 38323 - protein, 233 aa, Xanthomonas campestris pv. vesicatoria str. 85-10
MRSRFRCGERAPPPRNSQRMRILLARHGETPWNAEGRYQGQIDIPLSPVGEGQARALGERLHTLQIDRAVASPLSRAQATAKAALGASRQALLQTDADLQEIAHGEWEGLLASEINDKDPARLRAWREEPDTVLMPGGESLRQVLDRSWRGLVRATDGLGAHDTLLVVAHDAVNRVILCKILGLPLSKLWSFRQAPTTLNLLEGDDVEHLEVVRLNDCAHHTPFFGEAKHRAL

SEQ ID NO: 38324 - protein, 221 aa, Oryza sativa Japonica Group
MSRRGDWVYENNGGTCVAIAGADYCVVAADTRLSVGYNILTRDHSKICELADKCALASSGFQGDIKALHKNLAARELLYQHQHNKRMSCPAMAQLLSNTLYYKRFFPYYAFNVLGGLDSEGKGCVFTYDAVGSYERTGYSAQGTGSALIMPVLDNQLKSPSPLLLPARDAVTPLSETEAVDLVKDVFASATERDIYTGDKLEIVVINKAGTKREYIDLRKD

SEQ ID NO: 38325 - protein, 243 aa, Salmonella typhimurium
GIDKLSDPLMFAAAMVSAGEADVCIAGNLSSTANVLRAGLRVIGLQPGCKTLSSIFLMLPQYAGPALGFADCSVVPQPTAAQLADIALASADTWRAITGEEPRVAMLSFSSNGSARHPNVANVQQATELVRERAPQLLVDGELQFDAAFVPEVAAQKAPDSPLQGRANVMIFPSLEAGNIGYKITQRLGGYRAVGPLIQGLAAPLHDLSRGCSVQEIIELALVAAVPRQADVSRERSLHTLVE

SEQ ID NO: 38326 - protein, 596 aa, Oryza sativa Japonica Group
MAMQTMQTEQQQQQRRKGSPEMDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGLSELTAPLTTEMYLVNGYRLTA

SEQ ID NO: 38327 - protein, 414 aa, Physcomitrella patens subsp. patens
METDNVATTNGAAAPAIAAAPPSQTSRTNDRLAESLKLEHQLVKVPFEHLKKAMRLSTRFVEKEVNAVYAGVADAIDKDMSKEEAVQRLTTLVSRLQGLKRKLDESNKGEQVQVQRCRARIDHLSMLQGENGKENELQWNNTRVQRILVDYMLRNSYYDTAFRLAEMKNIQELVDIDIFLEARKVIEALRNRDCTEALTWCSENKSKLKKSKSKFEFKLRLQEFIELVRAERMMDAIMYSRKHLAVWGSTNMKELQQAMATLAFKSNTDCAAYKILFDTQQWDNLTQEFKQEFYKLYGMTHEPLLNIHLQAGLSALKTPFCYEEGCTKEDPLSQEIIRKLADPLPFAKHIHSKLVCYITKEPMNDNNPPLVLPNGYVYSTKAMEQMAMRNQGKIVCPRTGAVYNFSELAKAYIS

SEQ ID NO: 38328 - protein, 77 aa, Vibrio angustum S14
MSNIEERVKKIIVEQLGVDEAEVKNESSFVDDLGADSLDTVELVMALEEEFDTEIPDEEAEKITTVQAAIDYVNSAQ

SEQ ID NO: 38329 - protein, 399 aa, Oryza sativa Japonica Group
MDGPDESHAYSRRSPPPPSRRTIAGDDLLPGIHPQAGQPLVRPQAALRLPVILRQCPGGGGAAHRRRGLANADIYVEVDRLPLVGETVAARAGRSLAGGKGANQAACGGRLAAGPTYLVARVGNDANGRLLEGALGDAGGVRLDRVARAPGAPSGHAVVMLMPGGQNSIIIVGGANMEGWASGVGSDDLDLIRRAGVLLLQREIPDWVNVQVAQAAKGAGVPVILDAGGMDAPVPGELLSLVDIFSPNETELARLTGMPTETFEQISRAAGACHKMDNCNMRNCIKGVKEVLVKLGSQGSALFIEGGEPIRQPIIPATEVVDTTGAGDTFTSAFAVALVEGKPKEECMRFAAAAASLCVQVKGAIPSMPDRKSVMDLLESVQPPFILNNGARGQIRRIQ

SEQ ID NO: 38330 - protein, 123 aa, Cryptococcus neoformans var. neoformans
AAQIAFFFVFEDTFHYWAHRALHYGPLYKHIHKLHHEFSAPIGIAAEYAHPLEVLILAQGTISGPFLYAVFRNDLHILTVYIWITLRLWQAVDAHSGYDFPWSLRHFLPFWAGADHHDFHHAT

SEQ ID NO: 38331 - protein, 173 aa, Populus trichocarpa
MAMVGGNQVHNVFVYGSLLADDVVRALLSRIPQSSPAILNGHHRFSIKGRVYPAILPVENKEVTGKVLQGITDLELYILDEFEDVEYERVTVDVSLMDSSNKSQAFAYVWSDKNDPNLYGEWDFEEWKRTQMSDFVKMSAEFRKDLELPESKTRIATYESYYQQDGSDSPLAP

SEQ ID NO: 38332 - protein, 244 aa, Vibrio angustum S14
MSLEGKVALVTGASRGIGRAIAEILVERGATVIGTATSESGAEAISAYLGDKGKGLALNVTSPESIESVLKQIKADFGDVDILVNNAGITRDNLLMRMKDDEWQDIIDTNLTSIFRLSKAVLRAMMKKRNGRIISIGSVVGTMGNAGQTNYAAAKAGLLGFTKSMAREVASRGITVNAVAPGFIETDMTKALNDDQRAATLANVPAGRLGDPREIAAAVAFLASDDAAYVTGETLHVNGGMYMI

SEQ ID NO: 38333 - protein, 123 aa, Cryptococcus neoformans var. grubii
AAQIAFFFVFEDTFHYWAHRALHFGPLYKHIHKLHHEFSAPIGIAAEYAHPLEVLILAQGTISGPFLYAVFRDDLHIFTVYVWITLRLWQAVDAHSGYDFPWSLRHFIPFWAGADHHDFHHAT

SEQ ID NO: 38334 - protein, 218 aa, Oryza sativa
MDMDSWERLAADARLQGSCFDALIGMEEAEGSEGEEEAAEVACPFCDEEFDGFGLCCHIEDEHQAENRAGVCPICYDAVGMDLVSHITSEHPSFFKGKWRNRRVSHGSHSSTRATLKKDAAYLQYRYGGSTRAASHNTDPDPLLSSFVGNFTDTDLPKDVQQEFRDETDEKSDSLVQKEQKPVESADEPLLPEVKEERTRRSQFVQGLVLSLMFDDIL

SEQ ID NO: 38335 - protein, 395 aa, Bacillus cereus ATCC 10987
MKLAKRVAALTPSATLEITAKAQALKAEGHDVIGLGAGEPDFNTPEHIMDAAHKAMLEGHTKYTPTGGLQALKQEIVKKFTRDQGIAYDPSEIIVCNGAKHALYTLFQVLLDEGDEVIIPTPYWVSYPEQVKLAGGKPVYVEGLEDNEYKITAKQLREAITEKTKAVIINSPSNPTGMIYSKEELQQLGEVCLEHDILIVSDEIYEKLIYGGAEYTSVAQLSNALKEQTLIINGVSKSHSMTGWRIGYAAGNKQLIKAMTNLASHSTSNPTSIAQYGAIAAYAGSQEPVETMRQAFEERLNIIYDKLIQIPGFTCIKPQGAFYLFPNVKEAVALSGYETVDDWAKALLEEEKVALVPGTGFGAPNNVRLSYATSLEQVEKALERIHTFMKSKVQA

SEQ ID NO: 38336 - protein, 572 aa, Prochlorococcus marinus str. NATL2A
MLRLEKISKIYPTGEVLKDVSWEIRNGERIGLVGVNGAGKSTQLKIIAGLEEATDGSLISEGDPSIAYLKQEFDVDLSRTVREELFVAFKEASDLLHSQKLVQENMESELASKDLDYLDLLIKELSVIQSKFESINGYDLESKVEKLLPTIGFNQNEADRLVGDFSGGWQMRIALGKILLQSPDLLLLDEPTNHLDLETIEWLENYLLNQKIAMVIVSHDRSFLDKVCTRIVNTERGKSKSYIGNYTSYLQQRDFELESTKVAYEKQQKDIQVQKAYIERFRASATRSTQAKSREKLLDKVEKIEAPENNLKGPNFKFLEAPRAGRDILNIKDLTHSYEDNILFLGAFLELEPGERIAFLGPNGSGKSTLLRLIMGLEEPDEGSITIGKYNIIPSYFEQNQAEALELEKTVIETISQSVPDWTQTEIRSLLGSFGLTNDSVFKEVSQISGGEKARLALALMIIKPSNLLILDEPTNHLDIPSKQMLEQALSNYNGTALIVSHDRYFISKVANTIVEIRDGQLIKYQGDYKYYKEKKIEEAQEKEKELQLAERERKRLANREKQRRKKKTKQK

SEQ ID NO: 38337 - protein, 123 aa, Cryptococcus neoformans var. neoformans
AAQIAFFFVFEDTFHYWAHRALHYGPLYKHIHKLHHEFSAPIGIAAEYAHPLEVLILAQGTISGPFLYAVFRNDLHILTVYVWITLRLWQAVDAHSGYDFPWSLRHFLPFWAGADHHDFHHAT

SEQ ID NO: 38338 - protein, 108 aa, Zea mays
PSLQKYKRMVDAWGGWSLFQALLETGRKVSLKHGVTISTVAVKYILNQTSVAGSMVGVRLGLSEHIKDTNAIFSLELDEEDMNIITEVSKRGRNLIDIIGDCGDEYRA

SEQ ID NO: 38339 - protein, 452 aa, Pseudomonas syringae pv. syringae B728a
MRLDRTSFAKRLGSYAESISLPAQPVVEGRLLRMVGLTLEAEGLRAAMGSRCVVINDDSHHPVEVEAEVMGFSGGKVFLMPVGSVAGIAPGARVVPLADTGRLPMGMSMLGRVLDGAGRPLDGRSPIKAEDWVPMDGPTINPLKRDPISQPLDVGIRCINGLLTVGRGQRLGLFAGTGVGKSVLLGMMTRFTEADIIVVGLIGERGREVKEFIEHILGEEGLKRSVVVASPADDAPLMRLRAAMYCTRIAEYFRDKGKNVLLLMDSLTRFAQAQREIALAIGEPPATKGYPPSVFARLPKLVERAGNAEKGGGSITAFYTVLSEGDDQQDPIADSARGVLDGHIVLSRRLAEEGHYPAIDIEASISRVMPAVVSPEHMARAQHFKQLWSRYQQTRDLISVGAYVAGGDRETDMAIALHPVLVRYQRQALRENESMQGSSEALASIFAPAPGG

SEQ ID NO: 38340 - protein, 336 aa, Bacillus anthracis str. A2012
MRGFEFEMIDNFWRDLPRPFFVLAPMEDVTDVVFRHVVSEAGRPDVFFTEFTNSDSYCHPEGMKSVRGRLIFTEDEQPMVAHIWGDNPEYFRQMSIGMAELGFKGIDINMGCPVPNVASRGKGSGLILRPDVAAELIQAAKAGGLPVSVKTRLGFKELSEWEDWLTHIFKQDIANLSIHLRTREEMSQVDAHWELIPEIKKLRDRIAPNTLLTINGDIPDRKTGLELAEKYGIDGVMIGRGIFKNPFAFEKEPREHSSKEHLDLLRLQLDLQDQYAEVLPRSITGLHRFFKIYVKGFPGAAELRNQLMSTKSTDEVRALLNKFEESVNVVEGSETV

SEQ ID NO: 38341 - protein, 366 aa, Pseudomonas syringae pv. phaseolicola 1448A
MGFNCGIVGLPNVGKSTLFNALTKSGIAAENFPFCTIEPNSGIVPMPDPRLAALAAIVNPKRILPTTMEFVDIAGLVAGASKGEGLGNKFLANIRETDAIAHVVRCFEDENVIHVSNSVDPKRDIEIIDLELIFADLDSCEKQLQKVTRNAKGGDKDAVVQKGLLEQLIAHFSEGKPARSLMKSMSNDEKATIRGFHLLTTKPVMYIANVAEDGFENNPLLDVVRAIAEEEGAMLVPVCNKIEAEIAELDDGEEKDMFLEALGLEEPGLNRVIRAGYEMLHLQTYFTAGVEEVRAWTVRVGATAPQAAGVIHTDFEKGFIRAEVVAYDDFIQFKGEAGAKEAGKWRLEGKEYIVKDGDVMHFRFNV

SEQ ID NO: 38342 - protein, 311 aa, Pseudomonas aeruginosa PAO1
MRALTALSRFVSASFPFWVLLFAILAFFRPAWFLPLTAAIAPLLGLVMFGMGLTLKGEDFREVARHPIRVLIGVLAQFVIMPGLAWLLCRLLQLPAEIAVGVILVGCCPGGTASNVMTWLSRGDVALSVAITSVTTLLAPLVTPALVWLLASAWLPVSFAAMFLSILQVVLVPIALGLLAQRLLGERTRQVAEVLPLVSVFSIVVIIAAVVAASQARIAESGLLIMAVVMLHNGFGLLLGYLTGKLTGMPLAQRKALAIEVGMQNSGLGAALANAHFSPLAAVPSALFSVWHNLSGSLLAALFRRLDDTPR

SEQ ID NO: 38343 - protein, 236 aa, Kluyveromyces lactis NRRL Y-1140
MNTSHSQEPKDRSVKISKALAYLLRHGAVKENLPIDSDGYIALDRILQHNRLKSLKATSTEIQHIVASNDKQRFHIKTDPNTGIMYVCATQGHTLKQIAPSQHVLKPITNIEQLSSKLVHGTNVSNCISILHSGFIKKMSRNHVHLSPGITGKDTDVISGMRSSSNVYIHIKRIQEMLDSLNLVKSLNNVYLTSQDIPLKFIDFIQVRKGRSAASSEQLQQLKKLATEMKVPIEII

SEQ ID NO: 38344 - protein, 309 aa, Ralstonia metallidurans CH34
MSKAMNADNPEPATKSVAAIAPSLKAEILAEALPYIRKFHGKTIVVKYGGNAMTEEKLKHGFARDVILLKLVGMNPVVVHGGGPQIDEALKKVGKVGTFIQGMRVTDEETMEVVEWVLGGEVQQDIVMLINQYGGQAVGLTGKDGGLIRAKRLQMPDRENPGTFIDIGYVGDIEAINPAVVKALQDDAFIPVISPIGFSDDGQAYNINADVVAGKMAEILKAEKLVMMTNIPGVMDKKGNLLTDLSAREIEELFADGTISGGMLPKISSALDAAKSGVHSVHIIDGRIEHSLLLEILTEQAFGTMIRSH

SEQ ID NO: 38345 - protein, 532 aa, Triticum aestivum
MGMIYVPVFILMFLICFCNSEDSLTPTKPLSPGDRLISDGGIFALGFFSPKNSSANSYIGIWYNNIPERTYVWVANRDSPISSSSSDSKGSTLWTTTNKITTEAAGSAAILLDSGNLVIRLPNGTDIWQSFHHPTDTILPNMSLPLGNNNLFMHLVAWRAFDDPSTSDYSLGGDSSLQILVWNRTRPYWRRAALDGVLVSAMHRNSGPIMLQTTFNRGGEFYFTYTVSDGSPRTRMILHYTGMVKFLAWNSNSLSWEVFFERPGSSCDRYASCRPFGYCDATQTVATCKCLDGYEPGGLNFSLGCQRKKEMHCGQGDRFITLLNMKTPDKFLFIRNRSFDQCAEECSRNCSCTAYAYANLSSLSMTVDQSRCLVWMGELVDTEKRGDGRGENLYLRIPSSSGKHQTKGPMNFAMIEQLDNSDGLYDENSKILWISFKDIVPATDGFSDSNVLGRGGFGVVYKGTLEGGKEVDVKRLTKCSDHGMGHFRNEVVLIAKLQHRNLVRLLGYCIHGAEKLLSYEYLPNKSLDYFLF

SEQ ID NO: 38346 - protein, 315 aa, delta proteobacterium MLMS-1
MSVNEMKIFAGNASPALAESICSHLQTPLSKAEVRRFSDGEIFVELGENVRGRDVFVVQPTCPPVNDHLMELMIIVDALRRASARRITAVMPYYGYSRQDRKVAPRVPITAKVVAEMLMVVGVRRVLTMDLHAGQIQGFFNIPVDNLYAAPVLLDYMHRDLDVSRVVMVSPDAGGVERCRAYAKRLNTTLAIVDKRREKANECEAMSVIGDVKGKIAVMLDDMVDTAGTLCSAAKVLKESGASEVIACCSHGVLSGPAIERLEKSQISQLVITDSVPLRGAARECAKIKVLSVSKLLAEAIRRIHSEDSVSSLFV

SEQ ID NO: 38347 - protein, 476 aa, Candida glabrata CBS 138
MSLSGNNFENPQNNGTSRLLKNVQRLALNNVTNTTAGPHVGFLGSQSQDNSALRSFKSSIANLKGDSVPTYKVNPLSRPALVNNERDLTKTKLGIQEEKETRNYEENKENHGPQKGHFTQYDERVEDKNQSESTVSSQTTTESTQITTSNGDDDQTEEENSEDADSKKKRPISTIVEQDIPKKFKSCNRFGTEEYEWEDLDAEDANDPFMVSEDVNDIFEYLHQLEIVTLPRKEDLYKHRNICQNRDILVNWLVKIHNKFGLLPETLYLAVNLMDRFLCKELVQLDKLQLVGTSCLFIASKYEEVYSPSIKHFASETDGACTEDEIKEGEKFILKTLEFNLNYPNPMNFLRRISKADDYDIQSRTLAKFLLEISLVDFRFIGVLPSLCAAAAMFLSRKMLGKGQWDGNLIHYSGGYTKNQLAPVCEMIMDYLVSPVVHDEFHRKYQSRRFMKASIISVQWALKVRKNGYDIMSLHE

SEQ ID NO: 38348 - protein, 236 aa, Desulfococcus oleovorans Hxd3
MADITYTLDKEVAVVSLNTGENRFNLDFVDTFISVFDELETKTEARTIVVTSSHEKIFSNGIDLDWLSGLIQAGKADEVKQFLYRQNDMFKRVATCPMITIAAISGHAFAGGAILACAFDFRVMRSDRGFFCFPEVDLGIPFLPGMLALLESAIPLYKMNEMQYLGLRMTAEECEKHHIVTRACHKDDLMNEAMAFAKKFNKDRKTIGEMKRRMNRNIVAAMDNEDGAYIERGRLV

SEQ ID NO: 38349 - protein, 532 aa, Crocosphaera watsonii WH 8501
MAQAPVSPVVLVILDGWGYRPTEEDNAVVMANTPVMDCLWTTYPRTLIKTSGKEVGLPQGQMGNSEVGHLNLGAGRIVPQELVRISDAVEEGAIYENKALVSLCEEVASRKGKLHLIGLCSEGGVHSHLDHLFGLLNLAQKQNLQDVCVHAITDGRDTNTTDGVKAIARIEDHIEKLGIGRIATVSGRYYAMDRDRRWDRVKLAYDVITQDGDGDGRSALELLKDFYSQDKTDEFIPPTRIAPGAIEAGDGVIFFNFRPDRARQLCSALTVPNFDGFERELITPLSFVTFTQYDPKLPVKVAFEPQNLNNILGEVVAREGLKQFRVAETEKYPHVTYFFNGGLEEPLEGEDRELIQSPMVATYDLSPAMSAEAVTKAACNAVDKAVYSLVVINYANPDMVGHTGNTEAAIEAIETVDNCLGKLLSSVSKLGGTVIITADHGNAETMKDENGNPWTAHTTNPVPLIFVEGEQRKIPGHGGLVELRDDGKLADIAPTILQILQLDKPSEMTGESLIKPAEIEIRANRTPVRIGR

SEQ ID NO: 38350 - protein, 472 aa, Oceanobacillus iheyensis HTE831
MQSYKMFVGGKWFGNNLEQIDVINPATNEQIGTIPNGGKEEAKQAVDAAHNALKEWSARTAEDRSNYLVKWHELIKEERETIAKIMTEEQGKPLKEAIGEVDYANGFISWYAEEGKRIYGDIIPASHTNKRIFVQKKPVGVVAAITPWNFPAAMITRKVGPALAVGCTVVIKPATQTPLTAFKLVELAEKAGIPRGVINIVTGSSSQIGKVWNDDGRVRKLTFTGSTEVGKILMKDAANTMKKISLELGGHAPFVVMEDADLDKAVAGVIASKFRNAGQTCVCTNRVYVHESIKDIFQDKLTEAVSKLKVGNGLEEGINIGPLIDQSAVDKVDEQVKDAISKGGRVTFGGKSLRGLYVEPTIVVDATDDMLCMYEETFGPLVPVTTFRDEEEVIARANNSPYGLAAYVFTENIGRAIRISEALEYGIVGLNDGAPSTPQAPFGGFKESGLGREGGYYGIEEFLEIKYISLAF

SEQ ID NO: 38351 - protein, 126 aa, Podospora anserina
MTVHIFETAGQFKEAVAAHPVVVVDAFATWCGPCKAIAPQIAKWAEDPEFKDKIYFCKFDVDHLPELAQELGIRAMPTFIFYKDGDRVDELMGANPPALLNLLRKYLGGSGAGASSGGEHPEPPSL

SEQ ID NO: 38352 - protein, 518 aa, Vibrio angustum S14
MLDFPQKTHQSVKNDVLSGLTVALALVPEAVAFAFVAGVDPMVGLYAAFIVGLITAVLGGRPGMISGATGAMAVVMVSLVAQHGIQYLFAAVMLAGLLQILAGVFRLGKFIRMVPHPVMIGFVNGLAIVIFLAQLGQFKVPSLDGGLEWMHGTQLYIMLGLVALTMFIIHFLPKLTKAVPSSLVAILTVTALVHILGLDSRTVVDFVRTMSGDANATLAGSLPTFALPDVGFNLETLKIILPYSLILAAVGLIESLLTLTVIDEMTNTRGHGNRECVGQGVANVTCSVFGAMGGCAMIGQSMININSGGRGRLSGITAAIGLLLFILFGSSFIEMIPLAALVGVMFMVVIGTFEWASFKMMRKVPKHDFFTIILVTSVTVIADLAVAVLVGVIYSALVFAWNHAKEIYAASHIDDNGAKVYQVNGPLFFGSVSHFLELFDAQNDPKEVIIDFAKSRVADHSAIEAIDTIAERYANRNKTIHLRHLSPECSKLLKKAGSLVEVNVLEDPTYKVASDVLG

SEQ ID NO: 38353 - protein, 399 aa, Candida glabrata CBS 138
MSSMSSSSMDSAQRKPSEDEKMDRPALTNVEVNRALPGGRKAQPLTEQEKKRHPMYRKPSRIRREDSDASYMANSKKRQVFQDNADDDEPTGKDQESRIKRAKVQDRQIKWVDLDSKEKNNIAMVVEYTNDIFDFLYEREKNTIPMHNYLLDRKSKYHLRPATRAVLVDWLVEVHDKFQCYPETLYLGINIMDRFLSQHKVDINKLQLLAVTSLFIAAKFEEINLPKLSEYAYITDGAASKDDIKVSEMFILTELKFSLDWPNPLNFLRRLSKADGYDGECRMIAKFILEYSLCSSKFVGEKPSELAAMAIFLARRILKRESPIWDDTFIHYSGGIDALNDNHFQNLCTIMINEIAQPATKLTALCDKYKSIKGGTIYDKTIKWCKDQMERNYENVFSC

SEQ ID NO: 38354 - protein, 254 aa, Bacillus pumilus SAFR-032
MLHQFSRNELAIGKEGLNILKNSTVAVLGVGGVGSFAVEALARSGVGRIVLVDKDDIDITNVNRQLPALLSTVGQPKVDLMQARIADINPECEVVALKMFYTEETYEQFFEYPLDYVIDASDTIHYKIHLMKECLKRGVNIISSMGAANKTDPTRFKIDDISKTHTDPIAKVVRTRLRKEGIRKGIEVIFSDESPIVIREDVRKEVGNDEAKIRKAQMPPSSNAFVPSVAGLIMGGHVIMQLLKDIPITRVKDK

SEQ ID NO: 38355 - protein, 237 aa, delta proteobacterium MLMS-1
MDKPEEKKKFVKSKFAAISSRYDLLNSVLSLQVDRYWRWVVARQLRPFPQGAVLDLCAGTLPLALELARQAPERTVLAVDFCEEMLRAGLETSRRDRKLARIMALAGDGEQIPAAANSVWGVTVAFGVRNLARTEQGLNEMHRVLKPGGKLLILEFSRPTNFLIKPLYNFYLNRILPRVAGAVSGDRDAYEYLASSIAAFYEPRELMAMMQRAGFATISRRPLTLGIVTVYIGVKGE

SEQ ID NO: 38356 - protein, 346 aa, Desulfococcus oleovorans Hxd3
MSSGQTDLRVAVVGAGSWGTAIAHLLASKGLFPLLWAYEPELCEQIEKGRENTIYLPGIQLAEGISVSNDLGAVVADRDIVVMVVPSHLTRDVAARAADHLDGRTIVVTASKGIENKTHLTMTGVLSEVLPNTPAEKIAVLSGPSFAREVAANLPTVVAVASTSTETALFLQQVFAAPLFRVYTNDDPVGVELGGAVKNVIAIASGVCDGLGLGLSARAAMITRGLAEMRRLGMALGANPHTFSGLAGIGDLILTCTGSLSRNYTVGKKLGEGMTIDEILASMRMVAEGVKTAKSVFNLSNKRNVEMPICHEVYRILYEGLAPGDAVLRLMTRTLKHEIDDEVTAY

SEQ ID NO: 38357 - protein, 335 aa, Xanthomonas campestris pv. vesicatoria str. 85-10
MTQTITVIRGDGIGPEIMDATLFVLDALQAGLTYEYADAGLVALEKHGDLLPESTLASISKNKVALKSPLTTPVGEGFSSINVAMRRKFDLYANVRPAKSFPNTKSRFADGVDLITVRENTEGAYLSEGQTVSEDGETAFSGTRITRKGSERIVRYAFELAKSTGRKKVTAVHKANIIKSTSGLFLKVARDVAAQYPDIEFQEMIVDNTCMQLVMRPEQFDIIVTTNLFGDIISDLCAGLVGGLGLAPGANIGLDAAIFEAVHGSAPDIAGQGKANPCALLLGAAQMLDHIGQPQNAERLREAIVATLEAKDSLTPDLGGTGNTMGFAKAIASRL

SEQ ID NO: 38358 - protein, 396 aa, Desulfococcus oleovorans Hxd3
MKSLKTIDVAGKRVLVRVDFNVPLDDQQQITDDTRIQSAVPTIEYLVGAGAKVIVCSHLGRPKGKPDPVFSLAPTARRLGELLDRPVEMANTCVGPDVVSRIARMAPGDVLMLENLRFHPGEANDDDAFARALAALCDVYVDDAFAVSHRANASVDAVTKYAPVCAPGFLMEKELGAFGKALENPARPFVAIVGGAKVSSKLPALQHLLQEVDRLIIGGAMANTFLAAKGVNVGKSKIEQELIGEARSVIRQAAEKKVELFLPVDVIVAEKIDPDADRQAVSVDRIPADAMALDIGPETSRLFGDALKDAKTIVWNGPMGIFEMEAFAAGTKAVAAAVADSKAFTVVGGGDTVSAVHEAGVADRISYISTGGGAFLELMEGKTLPGVAALERNQPA

SEQ ID NO: 38359 - protein, 591 aa, Neisseria meningitidis MC58
MSIVLHGVAAGKGIAVGCAHLIARGTEEVPQYDVAEADTDAEAERFDAAVKATRKELEQLRSAIPENAPTELGAFISLHLMLLTDVTLSREPVDILREQKINAEWALKQQSDKLAAQFDNMDDAYLRERKQDMLQVVRRIHNNLIGQGNELEVADNLFDETVLIANDLSPADTVLFKEQRIAAFVTDAGGPTGHTAILGRSLDIPSVVGLHNARKLITEGETVIVDGINGVLIIAPDESVLNEYRRRAREYRSHKRDLNKLKKTAAATADGVCIELVGNIESAEDVKPLHNLGADGIGLFRSEFLYLNRDTMPSEDEQYEVYSAIVKKMKGKSVTIRTVDLGVDKNPRWFGKNSTPNGSLNPALGMTGIRLCLAEPVMFRTQMRAILRAAVHGPVRMMWPMITSVSEVRQCLIHLDTAQRQLAERGDAFGKVGIGCMIEIPSAALTVGSILKLVDFISVGTNDLIQYILSVDRGDDSVSHLYQPGHPAVLKMLQHVIRTANRMDKDVSVCGEMAGDTAFTRVLLGMGLRRFSMNPNNILPVKNIILHSNVGQLESDIVKVIRCEDEEKSEKLIKQMNSVSVEEEADFKGRK

SEQ ID NO: 38360 - protein, 432 aa, Desulfococcus oleovorans Hxd3
MHHTQSMLDFDRAHIWHPYTSIGNPLPVYPVKRAEGCTLFLEDGRELIDGMASWWTAVFGYNHPVLNRAVTGQLEQMAHVMFGGLTHRPAVELCRRLLGICPPGLDAVFLCDSGSVSVEVAIKMAIQYWSSVGRPEKQRLAAIRSGYHGDTLGAMSVCDPVTGMHHLFSGILPAQLFADMPRSPFEGPLDDRDVQNLEQLLAAHHREIAALVLEPVVQGAGGMRFYSPAYLAMARQLCDQYEVLLICDEIATGFGRTGKLFACEHAGISPDILCVGKALTGGYMTLAATLASEKVARGISSGDPGLFMHGPTFMGNPLACATAVAAIDLLHTFDWQAAVTGMEARMKQGLGPCADMPGVREVRCLGGIGVVETKEPVDTARAQTLFVERGVWVRPFGRLIYIMPPYIITPEALSRLTTAICEVVALLPDLQS

SEQ ID NO: 38361 - protein, 507 aa, Oceanobacillus iheyensis HTE831
MSGNQEVDVLSGKHEELANKLDDIKLYINGEFMDAEDRGTFDNISPFSNEKINSVASGQAADIDKAVQSAKKAFKGEWGNLKQVERLEYVYKIGDLIEQHTDEIAILESLDTGLPISQTRKQVSRSANNFRFYADTVKSQMYGEVYQVDDEFINYTVRSAVGVAGLITPWNAPFMLETWKIAPALATGNTVILKPAEWSPLTANRMAEIIDQAGLPDGVFNIVHGFGETAGDALVKHPDVQLISFTGETTTGSTIMRNGADALKRFSMELGGKSPIIVFEDADLERALDAATWGIFSFNGERCTANSRLYLHESIADEFIEKLKQRVWNIRVGDPLENNTQIGPLIKTEHYNNVKKYLKIAEEEGCEIISGVIPKELNRGNYVAPTILLNASNEMRVVQEEIFGPVIAVMTFNDETEVIEKANDVRYGLAGYVWTNDMKRGHRVAHAIDSGMLWVNSQNVRDLRTPFGGSKDSGIGREGGHYAFEFYTEQKIIHVAIGDHHIPQFGK

SEQ ID NO: 38362 - protein, 498 aa, Magnetospirillum magnetotacticum MS-1
MKTYSIAAIPADGIGIEVIAAGIEVLDALAEKTGSFRFKFDHFDWGSDYYKRHGVMMPADGREQIKDHDAIFFGAVGAPDVPDHITLWGLRLAICQPFDQYANVRPTRILPGITSPLRHVTGPELNWVIVRENSEGEYAGVGGRVHQGHPNEVATDVSMMTRSGVDRIIRFAFKLAQSRPRKLLTVVTKSNAQRHAMVMWDEIAAEVARDFPDVTWDKMLVDAMTMRMTMKPETLDTIVATNLHADILSDLAAALAGSLGIAPTANINPERTYPSMFEPIHGSAFDITGKGVANPIATFWTACQMLGAPRRERRPADRLMRAVERVTGRSEPAHAAHLRGQGDDPPGHGRGHRTTPSVTTSRPVLRGHHPREPLCPAVPDRRATPRRNSTRPDRIRRNGGRPADGAAGRAGAPAAARPPLNHGSKPGDAARPPGKPQCQSIPARRQMRTITAKGLTTQKHNQKPGTNTHHHTQTRKESPHETTHPYDENKHTHPPRHQ

SEQ ID NO: 38363 - protein, 370 aa, Vitis vinifera
MGSICSRHKHYHEADAEENAQAAEIERRIEQETKAEKHIQKLLLLGAGESGKSTIFKQANKTFAELKSYISVVHANVYQTIKVLYDGSRELAQNTTDSSKYALSIENKDIGEKLSEIGGRLDYPRLTRELANEIETLWKDAAIQETYSRGNELQVPDCAHYFMDNLERLSDANYVPTKEDVLYARIRTTGVVEIQFSGEVYRLFDVGGQRNERRKWIHLFEGVTAVIFCAAISEYDQTLFEDENKNRMMETKELFEWVLKQPCFQKTSFMLFLNKFDIFEKKVIKVPLNVCEWFKDYQPVSTGKQEIEHAYEFVKKKFEELYFQSTAPDCVDRVFKIYRTTALDQKLVKKTFKLVDETLRRRNLFEAGLL

SEQ ID NO: 38364 - protein, 790 aa, Arabidopsis thaliana
MEMGVMENLMVHTEISKVKSQSNGEVEKRGVSVLENGGVCKLDRMSGLKFKRRKVFAVRDFPPGCGSRAMEVKIACENGNVVEDVKVVESLVKEEESLGQRDASENVSDIRMAEPVEVQPLRICLPGGDVVRDLSVTAGDECSNSEQIVAGSGVSSSSGTENIVRDIVVYADESSLGMDNLDQTQPLEIEMSDVAVAKPRLVAGRKKAKKGIACHSSLKVVSREFGEGSRKKKSKKNLYWRDRESLDSPEQLRILGVGTSSGSSSGDSSRNKVKETLRLFHGVCRKILQEDEAKPEDQRRKGKGLRIDFEASTILKRNGKFLNSGVHILGEVPGVEVGDEFQYRMELNILGIHKPSQAGIDYMKYGKAKVATSIVASGGYDDHLDDSDVLTYTGQGGNVMQVKKKGEELKEPEDQKLITGNLALATSIEKQTPVRVIRGKHKSTHDKSKGGNYVYDGLYLVEKYWQQVGSHGMNVFKFQLRRIPGQPELSWVEVKKSKSKYREGLCKLDISEGKEQSPISAVNEIDDEKPPLFTYTVKLIYPDWCRPVPPKSCCCTTRCTEAEARVCACVEKNGGEIPYNFDGAIVGAKPTIYECGPLCKCPSSCYLRVTQHGIKLPLEIFKTKSRGWGVRCLKSIPIGSFICEYVGELLEDSEAERRIGNDEYLFDIGNRYDNSLAQGMSELMLGTQAGRSMAEGDESSGFTIDAASKGNVGRFINHSCSPNLYAQNVLYDHEDSRIPHVMFFAQDNIPPLQELCYDYNYALDQVRDSKGNIKQKPCFCGAAVCRRRLY

SEQ ID NO: 38365 - protein, 464 aa, Arabidopsis thaliana
MMMRAVIRRAASNGSSPSLFAKSLQSSRVAASSPSLLSGSETGAYLHRGNHAHSFHNLALPAGNSGISRSASLVSSTLQRWVRPFSAETGDTVEAVVPHMGESITDGTLATFLKKPGERVQADEAIAQIETDKVTIDIASPASGVIQEFLVNEGDTVEPGTKVAIISKSEDTASQVTPSQKIPETTDTKPSPPAEDKQKPRVESAPVAEKPKAPSSPPPPKQSAKEPQLPPKERERRVPMTRLRKRVATRLKDSQNTFALLTTFNEVDMTNLMKLRSQYKDAFYEKHGVKLGLMSGFIKAAVSALQHQPVVNAVIDGDDIIYRDYVDISIAVGTSKGLVVPVIRGADKMNFAEIEKTINSLAKKANEGTISIDEMAGGSFTVSNGGVYGSLISTPIINPPQSAILGMHSIVSRPMVVGGSVVPRPMMYVALTYDHRLIDGREAVYFLRRVKDVVEDPQRLLLDI

SEQ ID NO: 38366 - protein, 395 aa, Populus trichocarpa
MEQYEVLEQIGKGSFGSALLVKHKHEKKKYVLKKIRLARQTDRSRRSAHQEKELISRIRNPFIVEYKDSWVEKGCYVCIIIGYCEGGDMAEAIKKANGVHFPEEKLCKWLVQLLMALDYLHMNHILHRDVKCSNIFLTKGKDIRLGDFGLAKILTSDDLASSVVGTPSYMCPELLADIPYGSKSDIWSLGCCIYEMTSLKPAFKAFDMQALINKINKSIVAPLPTKYSGAFRGLVKSMLRKNPELRPGAAELLRHPHLQPYVLKIHLKMNSPRQNTLPFQWPEPHYMKKTKFLVPEDNPLKAHREKRYSLSNDRALNPSISAAEQDSVCSTEGIHDTPSYLNRSLSDSSIESSHEGTVICRSIASKPSNIAKTTKPAPTKASVTTRRRTEPVKKT

SEQ ID NO: 38367 - protein, 248 aa, Bacillus cereus ATCC 10987
MVTIKTKNEIDVMHESGKLLASCHREIAKIMKPGITTKEINTFVEAYLERHGATSEQKGYNGYPYAICASVNDEMCHAFPADVPLTEGDIVTIDMVVNLNGGLSDSAWTYRVGKVSDEAEKLLLVAENALYKGIDQAIIGNHVGDIGYAIESYVASEGFSVARDFTGHGIGKEIHEEPAIFHFGKLGQGPELQEGMVITIEPIVNVGMRYSKVDLNGWTAKTMDGKLSAQYEHTIAITEDGPIILTKL

SEQ ID NO: 38368 - protein, 123 aa, Cryptococcus neoformans var. grubii
AAQIAFFFVFEDTFHYWAHRALHFGPLYKHIHKLHHEFSAPIGIAAEYAHPLEVLILAQGTISGPFLYAVFRDDLHIFTVYIWITLRLWQAVDAHSGYDFPWSLRHFIPFWAGADHHDFHHAT

SEQ ID NO: 38369 - protein, 506 aa, Azoarcus sp. BH72
MTSASPDYLERILNAQVYDLAVETPLDLATNLSARSGNRIYLKREDMQPVFSFKLRGAYNKMANLSPQALQRGVICASAGNHAQGVALSAQKLGVRAVIVMPTTTPQIKIDAVRSRGGEVVLAGESYSDAYAHALELEKAEKLTFVHPYDDPDVIAGQGTIGMEILRAHAKPIHAIFCAVGGGGLIAGVAAYVKRLRPETRIIGVESEGAAAMTESLARGERVSLEQVALFADGTAVKQVGGETFRLCQQYVDEMIVVDNDAICAAIKDVFEDTRSILEPSGALAVAGAKEYARRHQLSDRSLVAVASGANMNFDRLRFVAERAELGEQREAVLAVTIPEQPGSFRKFINILGNRDITEFNYRYADSERAHIFVGVTVRSRDEATRLVEMLGQHDLPALDLTDDELAKSHVRYMVGGRAPQVANELVYRFVFPERPGALLNFLSNLRSDWNISLFHYRNHGADFGRVLVGMQVPPQDIDAFEAFLQRLGYEYAAETENPAYRLFLA

SEQ ID NO: 38370 - protein, 422 aa, Pseudomonas syringae pv. phaseolicola 1448A
MSDLKTAALEYHANPRPGKLSVELTKPTATARDLALAYSPGVAEPVREIARDPELAYKYTGKGNLVAVISDGTAILGLGDLGPLASKPVMEGKGVLFKRFAGIDVFDIEVDSESPQAFIDTVKRISITFGGINLEDIKAPECFEIEKALIEQCDIPVFHDDQHGTAIVTAAGMINALEIVGKTLDTAKIVCLGAGAAAISCMKLLVSMGAKIENIFMVDRTGVIHSGRTDLNQYKAVFAHATEKRSLTDALDGADVFVGLSGPNLLSAENLKLMAKDPIVFACSNPDPEISPELAHATRSDVIMATGRSDYPNQVNNVLGFPFIFRGALDVRAKRINEEMKIAAANALRELAKLPVPQEVSDAYGGIKLEFGREYIIPKPMDTRLLGLIADAVAKAAIESGVATLPYPKHYPLTSVDDVFKG

SEQ ID NO: 38371 - protein, 139 aa, Lactobacillus delbrueckii subsp. lactis
  misc_feature (135)..(135): Xaa can be any naturally occurring amino acid
GKLKEKYFKDGIAEYQKRLSRFAKVEIVQVPDEKAPESLSPAQMEEVKKREGERILSKIKDKEYVYVLAIKGKERASEEFAKELKDLGTYGHSDITFVIGGSLGTSDAVNKRANDLFSFGKLTMPHQLMRLVLIXQIYR

SEQ ID NO: 38372 - protein, 633 aa, Methylobacillus flagellatus KT
MIQLKNIKLFRGAKCLIEGASFQLHPGHKVGLTGANGAGKSSIFAMLRGELHPESGELDIPAHWTIAHVAQETPALADAAIEFTLDGDVELRQIEAALREAEAAGEGEKVGELHARLGEIDGYSARARAAELLHGLGFGPADLGRPVSDFSGGWRVRLNLARALMCRSDLLLLDEPTNHLDLDAVIWLENWLKDYRGTLLLISHDRDFLDAIVNHIAHIEQQTLTLYRGGYSDFERQRAERMAQQQANYERQQREVTHLQKYIDRFRAQATKARQAQSRIKMLERMELISAAHVDSPFSFSFREPLAAPDPLLVLDQADAGYASTLILQRIMLTLRPGERVGLLGRNGAGKSTLIKLLANAMPPLQGKRVEGKDLRLGYFAQHQLEQLRPDESPLQHMLRLDPETREQEHRNYLGGFDFRGDMATSAVGAFSGGEKSRLALALLIWQRPNLLLLDEPTNHLDLEMRHALTMALQDYQGGMVLVSHDRSLLRATCDRFLLVADGKVQEFDGDLEDYRHWLNKQRLRDKAKEEKDKPEAAPNARAQNKAERHARLQERRPLLKELEQIEKKMAVWQPEKNQLEQALAAPELYQEADKTRLYSLQKRQAELEQQLAQAEERWLTLQEQLEALPDIH

SEQ ID NO: 38373 - protein, 76 aa, Archaeoglobus fulgidus DSM 4304
MDVPRNENSSDFPIRCFSCGAVIGHLYDEYKQKLSEGKSPKEALDELGIERYCCRRMFITHKSVIKELSRFHGAVG

SEQ ID NO: 38374 - protein, 366 aa, Archaeoglobus fulgidus DSM 4304
MAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 38375 - protein, 170 aa, Bacillus pumilus SAFR-032
MDLKQYVTVVPDYPKEGVQFKDITTLMDKGEVYRYATDQIVEYAKERDIDLIVGPEARGFIIGCPVAYALGVGFAPVRKEGKLPREVVKVEYGLEYGKDVLTIHKDAIRPGQRVLITDDLLATGGTIEASIKLVEELGGVVAGIAFLIELTYLDGRKKLDGYDILTLMQY

SEQ ID NO: 38376 - protein, 189 aa, Leptospira interrogans serovar Lai str. 56601
MNIHKTAFIHPLATAIGLVEMGPYSSLWPGTVVRADMNRIVLGKGVNIQDNSTLHTDSSRGITIGDYTLVGHNTMLHGCKIGRGCLIGIGSIVLDEAEIGDGAMITAGCMIRGGKKIPPGAMVIQKNGELKILEGKSKPILSVAGCLEYIALSDRFRKGIFGPFTLEEEIEFQNQAKTVLKEMGIPFKE

SEQ ID NO: 38377 - protein, 967 aa, Candida albicans SC5314
MNGIGSSKVINNTAQLAAQFNDFYLEITSPKISQIGNYKIIKEIGEGAFGKAYLATHILLNINVVLKCGLIDDPNIVREIYYHKQLKHKNIVSLYEVIKTENHLWIALEYCQGGELYYYIYEKKRLELDECRNIFFQIVLGVKYVHSLNLSHRDLKLENILLADQKRTIVKLTDFGFIREFNPQSRKFLSTICGTTVYMAPELLTGQKYSGFVIDIWSMGVILYTMLNGMLPFDDDDEMKIQHKVINTEPMFYDHVPIDVNQLISKMLSKDPNQRPSLNEILNSSYLIDVYNKYLEKGTKRNSSGSGDAESIISINQHYNTVDRPFEAKIEKDLLRKLQRISFDTEELKATMYNNEINSLTAFYELLLTQEYSKKKQKYMREKKRKLYEAKKSLKKSRKRVKSVLSLSDQASGSQPLERIMSSLSIASNKNSSRHTSTIARKSLDKNDTTQIPPSPKSSQTSRLNIEIPSPRATNTSIALPPRSRRGSREISTTTAASSITADLNTPLRRTVSFVPDGRRLSQVISSEPKETIKKTNKSGKILHKLQFWKKNKGDEYQDDTISHYSTKSNHSKSTNDVMIESDGENPLELIVKGGNNSPIKFDNTMNSHQKMNTVPPEVLEQQRLDRFHKNDATRRQRENSNSDGQSGKLERPQQLQLQHHRQLSQSQSLNTGLSTSGIDSPHTPPSAENSRFARTRPSSMISQISQLSKLSQMSTMLSESELDILDETDTMDDDDDYDDEVYESSINTSQDNKLTGPNATPSSSNQGVKTSSKKRPTYRRGVASDTSITSTPSASGGGAGGGSGIISTIPKKKNSLSKLRSNSSEDISEDSYRFNDENMPMGRSGSPDLGKKRSFRALQQPIPLVNGTTSTSIAEKLNDATKMPYVRAPSPPIGFKYNAKANKKMMTTAINGNNNNNNNNQQQPPGYQDTKQVEDWIHNGTTGNTTTFTKSTIYQPVINEEEEENV

SEQ ID NO: 38378 - protein, 145 aa, Saccharomyces cerevisiae
MKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 38379 - protein, 178 aa, Leptospira interrogans serovar Lai str. 56601
MVHPWHDISPGDQNPEIVNGVIEIKRGSRAKYEVDKEYGILKLDRVLYSSFYYPANYGFIPQSYCGDQDPLDILVLSQVELEPLCLVKAKVIGVMRMLDSGEEDDKIIAVAANDMSVNHINDISELPPHFTLELKHFFEDYKKLENKTVVIEEFQNAILARKIVLDSLELYKKTFPKK

SEQ ID NO: 38380 - protein, 420 aa, Oceanobacillus iheyensis HTE831
MVEVKLHDIGEGMTEGDILTYFIQEGDQVEEDQPIVEMQTEKMVAEITAPAKGTVKEIFIAEGTTISVGTTIMTIESEDAMEKTKSSEIQRAEGNQATQLSASDNQHTETKQKNGPKRIKASPYTRKVARELDVDIELVEGTGKDGRIMIEDVQQFSQNRESAATKVKPEVEQLQNQFFQETEEQVDAKEEEAEIIPFKGRRKQIAKKMTTSIYTIPHVHHMEEVDMTELLEFRKEIKSDADISVAAFFIKALTIALKEYPIFNAKLHEEKEEIRLEKGIHMGIATDTEEGLIVPVIQSADIKSIRTIHREMKELMKKAKENTLSLKEMTGSTFTISNVGPMGSIGATPIINYPEVALMAFHKTKKAPVVNDNDEIVIRSMMNVTLTFDHRVTDGGNAIAFTNKFKALIENPRLLLIELR

SEQ ID NO: 38381 - protein, 216 aa, Zea mays
  misc_feature (87)..(87): Xaa can be any naturally occurring amino acid
MQRAVQAVRSHGNVLKYAVLQHISAPKPAMLPAAFSRFMSVSSARLEDRGFETATVADVLKSKGKSADGSWLWCTTEDSVYDAVKSXLPFGTLNFLQMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 38382 - protein, 297 aa, Oryza sativa Indica Group
MEGEEIGLVLARASDLRSRISACVAAAGAREPPEGEGEGGEAVKRLCDGEEGEEEEEVESLVGISNALESLERQLASLQDLQHQQRYERETILSQIDRSRGCLLNKLKEYKGQDCEVIHEAASFAGEKIEHDDGLMLPPYSNHVTNSFVLDDLYPPSYLAKLKCMHNGLGSGGTNQDVTKTNRLENRNGSMPNGNSQGGIRSFVGWLAKTAVMVVGAVSIMKAAGYEPVIGRHSIKLDMAGLFSKEATSGKDQATVQCPPGKVMVLEDGRAHCVVKERVEIPFDTNLASPNASYGLG

SEQ ID NO: 38383 - protein, 282 aa, Magnetospirillum magnetotacticum MS-1
  misc_feature (19)..(29): Xaa can be any naturally occurring amino acid
MSSSRESHSASPCIISGEXXXXXXXXXXXITPDLARTLVRTNNTVIGALAVRRGESDALICGLEGRFETRLRVIRDVIGLSPDLLDFAAMSLIVTKKGAFFLADTHVRQDPSAEEVADVAIACAGHVGRFGLTPKIALLSHSDFGQSDSPSARKMRRALELIQARAPHLQADGEMQADCALSELIRDRVLPGSNWKGAANILIFPNLDAANIAFQFAKVLADALPVGPLLIGPAKPAHILTPSVTARGIVNVTAAAVVEAQAGASQEAAAPEGEPGTGPLSE

SEQ ID NO: 38384 - protein, 472 aa, Zea mays
  misc_feature (229)..(229): Xaa can be any naturally occurring amino acid
MLRSALFRSAPGLRRSPATAHLSTAAAAAAAWLSNGPASAPSRVRLLIGGEFVESRADEHVDVTNPATQEVVSRIPLTTADEFKAAVDAARTAFPGWRNTPVTTRQRVMFKFQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELXAMEAGLPKGVLNIVHGTNVCLFGSNPALPMQDVVNNICDDEDIKAVSFVGSNTAGMHIYSRASAAGKRVQCNMGAKNHAIILPDADRDATLNALIAAGFGAAGQREDELVKRASGLVVSSGMVNDADLGPVISRQAKDRICKLVQSGVDSGARILLDGRKIVVPRYEDGNFVGPTILADVKSDMECYKKPKVAGHSVVIARCTYIRQRHCGGLAMILLALIDLAHHNISRPSTNSLSSSWNDG

SEQ ID NO: 38385 - protein, 340 aa, Oceanobacillus iheyensis HTE831
MTKENKVYLITGAAGFIGHFLSRRLLDQGFNVIGLDNVNDYYDVNLKETRLKLLQPYNNFTFIKGDISDKELVLSIFEEYKPSIVVNLAAQAGVRYSIENPDVYMQSNVIGFYNILEACRHHLVDHLIYASSSSVYGANKKVPFEETDFVDNPVSLYASTKKSNELMAHTYSHLYGIPATGLRFFTVYGPMGRPDMAYFGFTNKLFHGEPIQIFNNGDFENDLYRDFTYIDDIVEGIERLIPHSPVGEVQHKVYNIGNSNPEKLMVFIETLEKCLSNSLGEKVEFEKHFEPIKPGDVPATYASTKQLYDAVGFRPQTSIEEGLQQFTDWYVEYYGVKVEV

SEQ ID NO: 38386 - protein, 452 aa, Oceanobacillus iheyensis HTE831
MKKISVAGTGYVGLVTGVCMAENGHNVTCVDIDEQKVQMMRDGRSPIYETGLEALMVKNIEAGRLHFTTDYQSAYKDAEAVFIGVGTPEREDGSANLSYLATVARQVAESIKNDCLVVVKSTVPVGTNDKVEQFIKDFLIKDVRVEIASNPEFLAQGSAVKDTLEADRIVIGTETEWAEKILTDIYEPFGLPIVSVNRKSAEMIKYASNDFLALKISYMNDIANLCELVGADVQDVARGMSFDDRIGSKFLNAGIGYGGSCFPKDTKALEYIARQNGYELKTVKAAIDVNNQQKSMLYKKASKRLITFSGLKVAVLGLTFKPGTDDLREAPSLENIPMLLSEGADIYAYDPVGAENFAKVHPEGKHGNGSITYVSNPEHALEDANVCFIFTEWGEIKEVSPQKFADLMRTPLVYDGRNIHPVKEMVEASVEYYSVGRPSTVDTRVKEMEIVD

SEQ ID NO: 38387 - protein, 527 aa, Rhizobium leguminosarum bv. viciae 3841
MEPTHLFELVIAMFLAIIALHYAAHRLGLPPSVALLTGGALLAFVPGLPAISVDPELVLVIFLPPLLMDGAWSIAVARLRRHVIGIASLAVGAVLFTCAVVAVVAHLIFPSIPWAACAALGAIVAPPDAVAARAVLQRVRLPRRLQILLEGESLLNDASGLVLFRFAVAAAATGAFSAAEAGGSFLVLALGGAVVGIVVGTAWFKLVRLLGDEYLIIAASVLLGWIAYLAGEQLHVSGVIATVTAGLIMSWHQHTVLSAAMRMRGTSFWTVMIFLMEAAVFILIGLSLRDVVERGGGLTTVIATMGLPMLAILVALVLARFAWVFACDFAVRFCAALGFAQARPLGVGGATVLSWAGVRGVVTLALALSLPEGFPGRDFILVTSFAVILGTVLIQGTTLGRVIAWARLVEPESERARLTMSQAEAAMAQAQVEVVQNLAYDAEGKLIHPQLLERYQRRATSIVDYAEKTEQYMPVLHAHFDVILEAVAIGRRELIRLHRAGEIDDETLLELERDLDLEELSAISAKA

SEQ ID NO: 38388 - protein, 329 aa, Bdellovibrio bacteriovorus HD100
MRIYSDITKTIGQTPLIEMQRIGKGLPGRLLLKLEFFNPLGSVKDRIGLAMIEDAERSGQLKPGMKIIEPTSGNTGIALAFVAAAKGYDITLTMPETMSQERRTLLLMLGAKIILTPGPLGMKGAIAKAMELLEQTPNAWMPRQFDNPANPAIHKETTALEIWNDTDGKVDMVVSGVGTSGTITGVGTVLKAKNKNIKIIAVEPAESPVLSGGKPGPHKIQGLGAGFVPSVMDRSVVDGVEQVSSEESIKVAREVIKKEGIPVGISSGAAISAGLRQAAKEENRGKNIVVIIPSTTERYLSTLLAEQERAEALSLPVATVDENYLSKVK

SEQ ID NO: 38389 - protein, 461 aa, Oryza sativa Indica Group
MPRTVAVVGAGAAGLVAARELLREGHAVTVFERSARVGGTWAYDPRSDPDPPCLDTAAPGAAAVHGSLYASLRTNLPRELMGFSGFALAGRVFAGDPRTFPGHREVLAFLDAFAVESGVAGRVRLRAEVVRVGPLAGHGERWTVAWRGEGGVEEEEEEVFDAVVVCNGHCTVPLVPKLRGIGNWQGKQMHSHNYRTPEPFQDQVQDAVSVTVSIVVVVGLGASGVDIAREISNVAKEVHIASRYTEDRLGKVDTFQNTWLHSEVDCIQDDGQVRFSEGSASIAADTFLYCTGYRYHFPFLDVEGVTVDGNRVGPLYKHVFPPKHAPNLSFVGLPVKTIMFQSFELESRWVARALSGRAELPGEEAMAAAVEEDYRRMDAAGKPKRHTHALMPDWLTVFRPLVAATIDERQVEYMDWVAAQVGEPPMEARRREIYEKALRCIWSLDDSYRDSWEEEEEEENR

SEQ ID NO: 38390 - protein, 336 aa, Candida albicans SC5314
MPSFELDSLPYLNPNVDRRIAFITGGSSGLGFYSVLQLYLHGYTVYIAGRSKSRCLKSIKELKNKAIDIRSEYTSSQLNERFLGDLRFLEVDLSNLNSVISAVENFKKLEDHLHILINNAGAMALPYTLTIDKFEIQLQTNFVSPLVLTTKLLPILQKTADKFPKLPTPRIIYLGSFGHQFALPYFNLSNNLNHYPNFIFTWIRYGMAKVAGIHFMKMLTLRNPKVLFLTVHPGLVMNTNLFSYWTRLPIVGIIFWFAFYLFGYFFGVTSKEGADVVIKCALDENLTVENDNGKYFGPDGKESQPSSIATNMDYAARTWIWTIKELSQRGIDIPNP

SEQ ID NO: 38391 - protein, 492 aa, Oryza sativa Indica Group
MGWWPPAAWRRWGVVVVVVAALMAVSATAAVEEELGGRERGVVAAAAQGRWPRHRHAYAAMMYMGTPRDYEFYVAVRVMMRSLARIGADADRVLIASADVPADWVRAMREEDGMRVVLVENMKNPYESNLGGINRRFKLTLNKLYAWTLVDYERVVMIDSDNIFLQKTDELFQCGQFCAVFINPCYFHTGLFVLQPSMDVFKGMLHDLEIGRANSDGADQGFLVGCYPDLLDRPMFHPPENGSKLNGTYRLPLGYQMDASYYYLKLHWHVPCGPNSVITFPSAPWFKPWYWWSWPILPLGLSWHKQRWDDLGYAAEMPVILMEILMYAVIITITRLAKPGMTKLCYNRRPEKQNAMVQGLIKMSAIVAMLIAYAIPFFIIPRTVHPFMGWSMYLFGALALGVLVSNAFLLPLLAVLTPWLAIIGMFFVMAFPWYHGGIVRVLAIFGYAFCSAPFLWASLVRVMDSLQTMLEREPFFPRLGEPAQETEFSKLF

SEQ ID NO: 38392 - protein, 368 aa, Candida glabrata CBS 138
MSFYNVLKNGDDMLREYPRRSIIWRILSYGTCLFTYGVSRMILSTLYNFKVFNFERLENAMKRSKAENRGVLTIMNHMSMVDDPFVWATFPIRFYSSVDRFRWCLGAENICFQNAALSYFFSLGKTLSTRRFGAGPFQDSIDATVRLFSTDETLLKDKDPNYKPPVRQKSPPWVHIYPEGFVLQLQPPHSNSMRYFRWGVARTILESTVPPIIVPIFSTGFEKIASEEAKGMMRQLMPRNYGSKIKVTIGEEISDEIIFRYRKEWQVLVEKYKDCNNPDEMPDELKYGEEAEDLRSRLAAELREHVAKIRHDECHFPEEDPRFKSVSWWKKFNCSEGESDPDVKIIGKNWAIKRLQTHLKNNENTKDH

SEQ ID NO: 38393 - protein, 407 aa, Archaeoglobus fulgidus DSM 4304
MMIDGLPTLDDIPYRGKHVLLRVDINAPIVNSTILDTSRFESHIPTIEALEDSKLVLLAHQSRPGKKDFTSLESHASTLSKLLGKRVEYIDEIFSKGVLRRIKEMENGEVILLENVRFYSEEQLNRSAEEHAECHMVRKLSTAFDLFVNDAFSASHRSHASLVGFVPVLPSVVGRLVENEVTALSKPLKGEGRKIFVLGGAKIKDSVKVLKNVLENNIAEKVVLTGVVANYFLMLKGYDIGEVNRKVVEDNKEDVSDEEMINILKKYSDKIILPIDLGIEKDGVRVDIPLEKFDGKYRIMDIGLETVNQLSEIIPKYDYVVLNGPAGVFEDERFSLGTYEILRAATRAGYSVVGGGHIASAARLFGLSDKFSHISTAGGACIRFLSGEKLVALEVIKEYWAKKWGKS

SEQ ID NO: 38394 - protein, 329 aa, Neisseria meningitidis MC58
MKITVIGAGSWGTALALHFSQHGNRVSLWTRNADQVRQMQEARENKRGLPGFSFPETLEVCADLADALKDSGLVLIVTSVAGLRSSAELLKQYGAGHLPVLAACKGFEQDTGLLTFQVLKEVLPDNKKIGVLSGPSFAQELAKQLPCAVVLASENQEWIEELVPQLNTTVMRLYGSTDVIGVAVGGAVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 38395 - protein, 297 aa, Zea mays
MDVQPGDHVLPIFTGECKECPHCLSEASNMCDILRINTERGGMLHDGHTRFSKDGKPIYHFLGTSTFSEYTVVHVGQVAKINPEAPLDKVCVLSCGMSTGFGATVNVAKPKKGGSVAVFGLGAVGLVAAERARVCEASRIIGIDLNPNRFEEAKKFGCTEFVNPKDHNKPVQEVIAEMTGGGVDCSIECTGSTQAMVSAFECVHDGWGVAVLVGVPSRDDSFKTHPIHFLNERTLRGTFFGNYKPRSDIPGVVEKYMKKELELDKFITHSVPFLDINKAFEYMLRGEGLRCMIRMDA

SEQ ID NO: 38396 - protein, 379 aa, Populus trichocarpa
MASMYNPETSAVQDQQQYQQNPTLLYDALYCSEENWVEEVREDCFQDELEGESYCSNNSNKLNTFPIFLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYGIDNIEPSLAAEYQSQLLSSLGIDKDKVEDCSKFLMEFALRDHFKLLSNKRKFCSLPGSPSGVVDVSFSSDSSNDSWSVASSVSSSPKPLSKKSRALQSLNNATTSDFSQHSSLVP

SEQ ID NO: 38397 - protein, 356 aa, Vitis vinifera
MELPTSVSSLLRSPNSLPPFKCFESYSSSRNINRLRMGRRGVVPSSASVKMVSNGYVRRDSYSGYSNRIYKRVDSCLVIPPPKGKKPTAIIEFLGGAFIGAVPEVTYSYLIELLANEGFLIISVPYNVTFDHAQATREIYERFNSCLDTILTSGLPDASLSASELACLPLYSVGHSNGALLQVLKGSYFSEKIPKANAIISYNNRPATEAVPYFEQMGPLVRQVMPIVEASPAYSLAQNASDAWKGLLDMAGTMILDNDQETLVSLTNFVDQLPSVMNQVTQGISEFRPTPSENRECFKNSYNVQRTLLVKFNIDAIDETDLLEEILKPRVESIGGTLEKVSLNGNHITPCIQVFM

SEQ ID NO: 38398 - protein, 686 aa, Arabidopsis thaliana
MEKVVLRVHDHPLLPFERFYFGRCSGCSREGYFYGGYRCNELACFAVFHKECAESKPEISHHAHPKHLLKLGNRRQRCHLCERPVGIGYFCSICDFGMHLVCAKSPPLSLQPQLSSIENYKVHEHPLKPFKTAWLAETGNCKGCNYIIGNGDSAPFYECRRCKLYIHVTCLELFFTTDARHNSHLKHPLKYLKNGPPSYADHKCLLCGREFEDQQGQKYELYHCDVCNFSICISCQGNPPPLVVVTPKTHEHQLHLIPRLLDFTCNACGTQGDRSPYFCLQCNFMIHRGCIDLPRIININRHDHRISYICHLGQGNLKCGVCRKTVDGFYGAYSCSKCSSYVVHSLCATRKDVWDMVELEGTPEEEEIAPFEVVDENTIKHMSHDHDLIFNNDGINLHESKLCEACVSQINTDPFYSCELCGFILHQTCANMPRKKRHVLCNIPFSLQTDDSKDSSRLRRKCSLCLQHFTGFAYNLHIAYNSRTEVMDIRCGSIFEPFVHERHPHPLYYKFFTFSAVAKCDICHITRRHLLCCEECDFRLDFRCATLPKKVMKQRYDDHPLFLSYGENNVDGEYWCDVCEKRVDAKTWFYTCDACGVTLHVSCVVGDFSYHMPGPLSTVVSEYKMVPPAVVSLYKVVPNTSICRPLCSRCHTRCKLPCILETSEDGVNVYFCSNDCHKNPWESSYY

SEQ ID NO: 38399 - protein, 295 aa, Oceanobacillus iheyensis HTE831
MRTIKKAIIPAAGLGTRFLPATKAMPKEMLPIVDKPTIQYIVEEAIESGIEDIIIVTGKGKRAIEDHFDHNFELEDNLVKKEKFDLLDKVNHASSVDLHYIRQKEPKGLGHAVWCARKFIGNEPFAVLLGDDIVRADTPGLRQLIEQYEETQSSVVGVQQVPDTETHRYGIVDPSMIEGRRYKVNHFVEKPAQGTAPSNLAIMGRYVFNPEIFQFLDKQQIGAGGEIQLTDAIQMLNEIQPVYAYDFLGKRYDVGEKLGFVKTTIDLALENAEIKDELFSYLEEKVTEKAIKTNY

SEQ ID NO: 38400 - protein, 551 aa, Streptococcus pneumoniae R6
MYQALYRKYRSQNFSQLVGQEVVAKTLKQAVEQEKISHAYLFSGPRGTGKTSVAKIFAKAMNCPNQVGGEPCNNCYICQAVTDGSLEDVIEMDAASNNGVDEIREIRDKSTYAPSLARYKVYIIDEVHMLSTGAFNALLKTLEEPTQNVVFILATTELHKIPATILSRVQRFEFKSIKTQDIKEHIHYILEKENISSEPEAVEIIARRAEGGMRDALSILDQALSLTQGNELTTAISEEITGTISLPALDDYVAALSQQDVPKALSCLNLLFDNGKSMTRFVTDLLHYLRDLLIVQTGGENTHHSSVFVENLALPQKNLFEMIRLATVSLADIKSSLQPKIYAEMMTVRLAEIKSEPALSGAVENEIATLRQEVARLKQELSNVGAVPKQVAPAPSRPATGKTVYRVDRNKVQSILQEAVENPDLARQNLIRLQNAWGEVIESLGGPDKALLAGSQPVAANEHHAILAFESNFNAGQTMKRDNLNTMFGNILSQAAGFSPEILAISMEEWKEVRAAFSAKAKSSQTEKEVEESLIPEGFEFLADKVKVEED

SEQ ID NO: 38401 - protein, 298 aa, Legionella pneumophila str. Paris
MNKQVIDKYTQRHELYLEQLLNEIIIPAPKIRSALHYALFSGGKRIRPILVYLAGDLIDVDQGVLDIIAAALELTHCYSLIHDDLPAMDNDDLRRGKPSCHKAFDEATAILVGDGMQALAIEVVLTRLSPLLPAAQVVAITQVLVNASGISGMVSGQSLDLSELAKLSVTEEQLREIHLLKTGKLILACFEMVLAAQNEVSEQIKSALKTYGKHIGLVFQMQDDYLDLYAPTQILGKGRSSDQANQKTTFATLFNKQQLEEEIAVHYQIAMDSLRLFGSKAAALIELTKQLQNRSNLS

SEQ ID NO: 38402 - protein, 408 aa, Streptococcus pneumoniae R6
MLDVEAIRKDFPILDQIVNDEPLVYLDNAATTQKPLVVLKAINSYYEQDNANVHRGVHTLAERATASYEAARETIRKFINAGSTKEVLFTRGTTTSLNWVARFAEEILTEGDQVLISVMEHHSNIIPWQEACRKTGAELVYVYLKDGALDMEGLRAKLTDKVKFVSLAHASNVLGVVNPIKEITQLAHQVGAIMVVDGAQSTPHMKIDVQDLDLDFFAFSAHKMAGPTGIGVLYGKEKYLEQMSPVEFGGEMIDFVYEQSASWKELPWKFEAGTPNMAGAIGLATAVDYLEKIGMDAIEAHEQELIAYVYPKLQAIEGLTIYGSQDLAQRSGVIAFNLGDLHPHDLATALDYEGVAVRAGHHCAQPLLQYLEVPATARASFYIYNTKADCDKLVDALQKTKEFFNGTF

SEQ ID NO: 38403 - protein, 503 aa, Physcomitrella patens subsp. patens
MEVDAVTEAELKENGFRSTRRTKLVCTIGPATCAPEQLEALAMGGMNVARLNMCHGTRDWHKQVIRNVRSLNSEKGYSVAIMMDTEGSEIHMGDFNGAPSVKAEDGQEWIFTVRTLESLPERTTTVNYDGFAEDVRVGDELLVDGGMVRFEVIEKIGPDVKCKCTDPGLLLPRANLTMWREGRLVRDLNAMLPTISSKDWIDIDFGIAEGVDFIAVSFVKTSEVIKHLKSYINARAPNDSIGVFAKIESSDSLKNVEDIIRVSDGAMVARGDLGAQIPLEQVPSVQQGIVNLCRELNKPVIVASQLLESMIEYPTPTRAEVADVSEAVRQRADALMLSGESAMGLFPEKALSVLRTVSLRMEEWCRENKQHASDRLPELSSALNDRISESICSSAAQMANRLGADAIFVYTRRGYMASLLSRARPDCPIFAFTDTKSMRQRLNLQWGLIPFRLDFSGDMESNLRRTFALLKARGMMKKGDLIVAVSDISTSDFMQSIQVRRIP

SEQ ID NO: 38404 - protein, 688 aa, Bdellovibrio bacteriovorus HD100
MFSESLLISPAIAGVVGLIVALALYLRVKAQPAGNETMNRIASYVREGSMAFLVREYKVLFVYAIVVGLALWFALGGIAAGSFILGAFLSLLAGFFGMKAATYANVRTSQAAAGGSKAAALLVALDGGAVMGLSVAGLGLIGLGGLYVAFQGDAHLGTILHSFAVGASSIALFARIGGGIYTKAADVGADIAGKVVENIPEDDPRNPGVIADNVGDNVGDVAGMGADIYESMVAAIVSAMAIALTIPAEGLSALMTGADAETVRVAGVALPILLSTLGLVISIIVIFAARAFKNGKPATVLRNALIFPPILLTIAAYIILPMFGINQSVTVALAAGAFGGALIGLITEYYTAARPIRLVAEAALTGAGTGVIRGLAVGMESTAIPMLIVVIAAYVADQALGLYGIAMAAVGMLAGTAVVMTVDAYGPIADNAGGISEMSGLGKDVRAITDELDAVGNTTAAIGKGFAIGSAILTVVALFSAFNMEVNHVREGAGLAKMSLDLTSSGVLIGILLGSILPFLVGATTMTAVGKAAQKIVQEIARQFKEIPGLREGKAEPQPAKIVDIATQAALFEMILPGMIAILAPVAVGFLLGPQALAGLLAGGLAVGATMSLFMANAGGAWDNAKKYIEKGGLPGHPKGSDAHKAAVVGDTVGDPFKDTSGPGVAILIKVMSVVSLLIAQLIATIGG

SEQ ID NO: 38405 - protein, 172 aa, Lactobacillus delbrueckii subsp. lactis
  misc_feature (16)..(16): Xaa can be any naturally occurring amino acid
  misc_feature (69)..(69): Xaa can be any naturally occurring amino acid
KSKRAIEDHFDSNPEXEDNLTEKHKDALLKLVRETTMSNTKVNLYFTRQPHPNGLGDAVNRARSFIAGXPFVVMLGDDLMRDKTPLTKQLIDCYDETHASTIAVMKVPHEEVNKYGVIDPIGETAPDLYNVKAFVEKPDIDKAPSDLAIIGRYLLTPEIFDMLDKQKAGAGG

SEQ ID NO: 38406 - protein, 424 aa, Legionella pneumophila str. Paris
MVFVACGLNHKTAPIHVREKVALQPAMQDSLLSSLLDLPEVNEAAILSTCNRTEIYCDTNTPEVLGNWLAHEHQLSEELLSQFLYIHQGKEGIKHTLRVASGLDSMMIGEPQILGQMKQAYQHACRLGTVKTQLRPVFEYIFRASKRIRTRSGIGANPVSIAYAAVQLIGQLFKNYHSLSVFLIGSGETASLVAKYLHQHGVHRFLIASRTLENAQKLAETFGGKTLSIGDIPQYLPLADVVISATACPLPFINKSLVEHALEQRNHAPMFLLDLAVPRDIEGNVNELEQVHLYNVDDLQSMIEKGMDERRNAALQAEQLIESELDNYIRWHRSLRAKDVICDYRNQMHTLAQQELQRALKKISAGQNQQDVLNEFSMRLVNKLTHNPTIGLRQIAWDNREDLLDLARYLFDTTANQSLYEEIS

SEQ ID NO: 38407 - protein, 411 aa, Zea mays
  misc_feature (57)..(57): Xaa can be any naturally occurring amino acid
  misc_feature (83)..(83): Xaa can be any naturally occurring amino acid
FYGSNKAQRARCLISHSLWRLSPNRVTTDELPRKFHPGIFALGDNMFLFFSGRSCRXCFSNSRKTLAPGIDGWEVSLKGMMSXVVLLGLVITSIYWGVYQVCFECPRVRPRVRPSLPKADRKKKKEKPKLGMKESLKVLLSSRYVRDLATLVVAYGISINLVEVTWKSKLKAQFPSPNEYSSFMGDFSTATGIATFTMMLLGRIILRKFGWGVAAMITPTVLLLTGVGFFSLILFGQPLTPMLATMGMTPLLAAVYVGAMQNIFSKSAKYSLFDPCKEMAYIPLDEDMKVKGKAAIDVVCNPLGKSGGALIQQFMILTFGSLANSTPYLGGILLVIVLAWLGAASSLDKQFSSLAKEDLKKDKAAREKVEPSLLKAPAEGSDDVLAEQTNGSVTPQATGTESSPSNSSPIQ

SEQ ID NO: 38408 - protein, 475 aa, Bordetella parapertussis 12822
MSTQYRSFVAGQWQDGGEPVALYNPSDLQEEAGVYMHAPVEMVNQAVRAAEEALDAWRGLHAMARSRLLDGIADGLVGRRDELAMAIAREQGKPLRDALAEATRAADIFRYFASETIRQKGYTYASIRPGVRVEVQRNPVGVVALVTPWNFPVVIPAWKAAAALAYGNTVVMKPSEIAPCGAWILADVMREAGLPAGVFNLVLGAGQAGAALVAHEAVAAVSFTGSVATGKRIAAAAAGKRIQLEMGGKNPLIVLDDADLDTAVACAIDGAFLYAGQRCTASSRIIVTEGIHAAFVKRLLAQTASLAVGHALDEATVIGPVVNAEQFEKNRRYADLARQEGGTVAGGRALSRPTRGHYFEPCLVTGLDNSATVCREEVFGPFACVLTARDYEHALAIANDTPFGLSSGLCTTSMKHAQHFKAHTKSGLASINTSTSGVDFHVPFGGNGASSYGPREQGEFAIEFFTTLRTVYIGD

SEQ ID NO: 38409 - protein, 320 aa, Oryza sativa Japonica Group
MTRRFWSSHHGSTKLCHCHYSGNFSRYLIAIAISVGLPDSVGGVLSGPVSNVATRWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGDITVWLGDLNYRLQGISSIPARKLIEENRQSKLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 38410 - protein, 380 aa, Alnus glutinosa
MSSTAGQVIKCKAAVAWEAGKPLVIEEVEVAPPQANEVRVKILFTSLCHTDVYFWEAKGQTPLFPRIFGHEAGGIVESVGEGVTDLKLGDHVLPVFTGECKECRHCKSEESNMCDLLRINTDRGVMLNDGKTRFSINGKPIYHFVGTSTFSEYTVIHVGCLAKINPAAPLDKVCVLSCGISTGLGATLNVAKPKKGQSVAVFGLGAVGLAAAEGARIAGASRIIGVDLNPARFEEAKKFGVTEFVNPKDHDKPVQEVLAEMTDGGVDRAVECTGSIQAMISAFECVHDGWGVAVLVGVPSKDDAFKTHPMNLLNERTLKGTFFGNYKPRTDIPGVVEKYMNKELELEKFITHSVPFSEINKAFDLMLHGKSIRCIITMGA

SEQ ID NO: 38411 - protein, 409 aa, Bacillus cereus E33L
METIVQKFGGTSVGSVERIQHVTNLIIEEYERGHSIVSVVSAMGKSTDELVALANAITENPSKREMDMLLSTGEQVTISLLTMALQAKGYNAISLTGWQAGITTESVHSSARITEINTDRIQSYLTKGTIVIVAGFQGVSEDLEITTLGRGGSDTTAVALAAALNAKKCDIYTDVTGVYTTDPRVVKDAYKLDEISYDEMLELANLGAGVLHPRAVEFAKNHNVILEVRSSMEQENGTIVKGECNMEQQSIVKGIAFEDNITRITVKGLEQGSLSTVFSTLAAAHINVDIIIQSITNEGTVHLSFSIHSNDLRETLEVLEQNQEALHYGSVEYENHLAKVSIVGSGMVSNPGVAANMFTTLKEEDIHIKMVSTSEIKVSVVIDRLHLVTGVEALHQSFMAKIEPLVQMS

SEQ ID NO: 38412 - protein, 298 aa, Thiomicrospira crunogena XCL-2
MNLNKAQAQNIASVLAEALPYIQRFSGKTIVVKYGGNAMTEEALKNGFARDIVLMKLVGMNPVVVHGGGPQIGHLLERVGKQSEFIQGMRVTDSETMDIVEMVLGGMVNKEIVNLIHQHNGNAVGLTGKDGNLIRAKKMEMTAFNEDLNAPELIDLGHVGEVERINTKVLDMLIQDDFIPVIAPVGVDEQGHSYNINADLVAGKVAEALHAEKLMLLTNTPGLLDKQGELLTGLNAESVAALIEDGTIYGGMLPKIQCALDAVQNGVESSHIIDGRVEHAVMLEVFTDEGVGTLITSH

SEQ ID NO: 38413 - protein, 342 aa, Escherichia coli
MAILVTGGAGYIGSHTVLMLLKEQYEVIVLDNFHNSSVESLHRVKEITGSDICIINGDIRDRVILKSIFTENSITDVIHFAGLKSVSDSIQFPTEYYDNNVYGTLVLIEEMISNNIKNLIFSSSATVYGTPEKIPVKETFPVGGTTNPYGTSKLMVEKILHDVSLAYPFFRTTILRYFNPVGAHPSGKIGEDPNGIPNNLMPYICSVASGKYKQLSIYGNDYETKDGTGVRDFIHVMDLANGHIAALKHRDEGSNYKVYNLGTGHGYSVLELLAAFQRITSVNIPYVLVERRAGDIAECWSDPSKAYLELGWKACLGLDEMVRDAWNWQQSNPDGYKFSEKN

SEQ ID NO: 38414 - protein, 191 aa, Triticum aestivum
  misc_feature (47)..(47): Xaa can be any naturally occurring amino acid
  misc_feature (71)..(71): Xaa can be any naturally occurring amino acid
  misc_feature (90)..(90): Xaa can be any naturally occurring amino acid
MKEATASGGGATATANDPRQSATARPYAPPKLSSQDLPVDYAGFLAXVFGALRVLLHYKVSSCIPIIFCAXSLANLETFENDLEELSLAXLLCWPGSGGPTIFRPSPMARPNPFLLPPIAALIHILPYITFLPAPCPHLPWPRSRRTLPTPFSQLTLRTHFIPASHLATRRASTRSCARLPHCPLHLLSSL

SEQ ID NO: 38415 - protein, 409 aa, Campylobacter upsaliensis RM3195
MLIIEDVRAFEVLDSRGNPSVKAEVILSDGSSGSAIVPSGASTGSKEALELRDGEARFGGKGVLKAVSNINENIADEITGLDAFNQTQLDTILRELDGTKNYSKLGANATLGVSMANARAVANSLGMPLYRYLGGANASVLPVPMCNIINGGAHANNSVDFQEYMIMPYGFTSFKEGLRAVCEIYAILKKELANGGHSTALGDEGGFAPNLANNTEPIEFLMTCIKKAGYEKQIKIALDVASTEFHKDGKYHLEGRTFTSDELIARYVELCAKYPICSIEDGLAENDFEGWIKLTKELGNKIQLVGDDLFVTNEEILKEGIEKKMANAILIKPNQIGTLTQTMRTVRLAQRNNYKCIMSHRSGESEDAFIADFAVALNTGQIKTGAPARADRTAKYNRLLEIELENDEI

SEQ ID NO: 38416 - protein, 641 aa, Oryza sativa
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWYFTFFSHPALIFIYDPSMALMNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWEILYSIKPELIDYPSSFKSPVSSGTKTVLLPEARARVFKSNYSQSLGELKILRSSWLVASFSESGKAGFSSFWLLVHFLDFTTTASQNLDQKLDCLGELLIMGEAAAARSSPNRPFVSLYQQPW

SEQ ID NO: 38417 - protein, 577 aa, Bacillus cereus E33L
MNRGRDVMSKFTVASNGSLETTLRGVEILSTPFLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDLSGIEEAFANIGATAENIDLVVVTDGEGILGIGDWGVGGINIAIGKLAVYTAAVGIDPSRVLPVILDVGTNREELLDNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQMPYARKEAEVSEWKENGVIGLAEVVKQVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENLSDNDIKIAVKEAIWEPEYRQIKAVEKVTI

SEQ ID NO: 38418 - protein, 426 aa, Oryza sativa Japonica Group
METVETLVAHIQGLSGSGEELAHLHNLLRQADGEPLRAHSAALLPFLAQLHPSAHSLGFLYLLEAFASSASNLRAQGGGDFLVTTADFLVSCSAEQIRLAPDKFLSVCRVFKNEVMQLNAPIRGIAPLRAAIRKIQTSSEELTPIHADYLLLCLLAKQYKAGLSVLEDDILEVDQPKDLFLYCYYGGMIYIGLKKFTIALDFLHNAVTVPMSSLNAIAVEAYKKYILVSLIQNGQVPSFPKYTSSTAQRNLKNHAQVYVDLSTCYSKGNYSELEEYIQLNAEKFQSDNNLGLVKQVLSSMYKRNIQRLTQTYLTLSLEDIASSVQLKTPKEAEMHVLRMIEDGEIHATINQKDGMVSFHEDPEQYKSCEMVEHIDSSIQRLMALSKKLSSIDENISCDPAYLMKTGRERGGRFDYDDFDSVPHKYF

SEQ ID NO: 38419 - protein, 157 aa, Bradyrhizobium sp. ORS278
MIAQLDQGAALNARDCDGDTALILAADRGHIEVVEVLLARGADVNARNQSGETALLRAAGNGRTAVVKHLLEHNADCNAGDMVKCAPLMRAAYRGHVDVVKALLACQVDLTARNKFGNTAASLAARNGHREIEVLLQQALDGGTVELSSLGSARARR

SEQ ID NO: 38420 - protein, 202 aa, Brassica napus
  misc_feature (186)..(186): Xaa can be any naturally occurring amino acid
MDNYDGTNLAEMRPKRRAGRKVFNETRHPVFRGIRRRNGDKWVCEVREPTHQQRIWLGTYPTADMAARAHDVAALALRGRSACLNFADSAWRLPVPESNHPDVIRRVAAEAAEMFRPTEYGSEITVLPSYGSEVYMGSGSGSEERNVYGYVEEEEEVSTTMMRLATEPLMSPPRSYMEGVTPNGYXKEEMSYEDMSLWSYRY

SEQ ID NO: 38421 - protein, 341 aa, Ralstonia eutropha JMP134
MKVSPRRISVAPMMDWTDRHCRTFHRQLSRHTWLYTEMVTTGALLHGDVPRHLDFNAAEHPVALQLGGSEPADLAVAARLGQQWGYAEVNLNCGCPSERVQRGAFGACLMAEPQLVADCVKAMRDAVSIPVTVKHRIGIDKVEHYGFVRDFVGTVAQAGCETFIVHARNAILKGLSPKENREIPPLRYEVAYQLKQDFPQLEILINGGIVSYDEMASHLENVDGVMIGREAYHQPYVLAEMDGRFYGDAEAPVRSRLDVELAMQRYIGELVERGGYMGAVTRHMLGLYRGVAGGRGWRRVLSDAKRMSAARTHANVDALFEEARSHLHANAPLEPEHRAAA

SEQ ID NO: 38422 - protein, 56 aa, Brassica napus
DWLVEVSEEYKLASDTLYLAVNLIDRFLSNNYIEKRRLQLLGVTCMLIASKYEEIY

SEQ ID NO: 38423 - protein, 448 aa, Oceanobacillus iheyensis HTE831
MTINTVEFKNSLADRLTEKINNKSATLGVVGLGYVGLPLAVEKAKAGYKVIGFDVQLEKIEKLAQGINYIGDVNDEELIQVINKDKFYATNDYSLINNVDVVVICVPTPLDIHKQADISYVESATAKISQYLHKGMLVVLESTTYPGTTEEVLKPLLEESGLKCGEDFFLAYSPERVDPGNKQFNTANTPKVVGGITKSCTKVAATMYRNVLQADIHEVSTPAVAEMEKILENTFRNINIGLANEMAILCNKMGIDVWEVIDAAATKPYGFMPFYPGPGLGGHCIPIDPWYLTWKAREFNYHTKLIETAGEINNLMPDYVINRCMDLLNKEGKALNGSNILVLGVAYKKDIDDFRESPVISILEQLERAKANWNVIDPNVQKFTLLEKEYSTNANITNEILSEADLVLITTDHNSFDYKTIAENTNLIFDTRNAIPSEFVEKSNYYKL

SEQ ID NO: 38424 - protein, 411 aa, Oryza sativa Japonica Group
MAIAARLLSTAPCRSPSSWPLPPSKPYLRFPSAPLLLLLRSPAAASVIHLSPPPVTPLAVACDDRHALPDSDEPRNRNPPDHPAPLLAAAAAAAAAVASPHAALALSGGSMGGCSDTSSSYSSSFSSSSSSDSFSSWSSSSDSWRSSSSSSSSPPKKKKVVVVESADLETHESVGTAASPPPPPPVALTPWEKFWISVAVVLGVGGLVFGLIFLIKRSIPPPRTISVVKLQIALGGVAAAKSFQKDLNRIAERVQGSSRRWYKFILSDTISSLHRHKDYCISTSLSVDIKDSDSWNGHFKKISLEERGKFDEETLSNLEGVKRNKEYSTKMDGSKNEYIVLTILVATDGTMDFPKLITNAADLKVALTKLYSTPETGLEGIHVLWAPQDKDDILSKERMQKDYPYLKPLSV

SEQ ID NO: 38425 - protein, 254 aa, Campylobacter upsaliensis RM3195
MNLDSYLNLALDAAEKASRAILKEKENFKILPKEDGTALTSADLASNEILSEALAKTDLKILSEEKILSYEERRELEYFWLIDPLDGTKGFIKGQDEYCIMISLIHQKRPILALIKSPEKNEVFYAHKKSKVYKNANPLQNDEAFFKKNQYTALLSINHLCKEDEEFAKKYQLKALNISSGLKFTALLEGKAGIYRRKEKLNIWDIAAGDFLLNQNGGFMGKFDKTLLSYNEKDLRADYFIAVSNKAFLQDFGD

SEQ ID NO: 38426 - protein, 179 aa, Bradyrhizobium sp. ORS278
MTFDLDIKNTVRTIPDYPKPGILFRDITTLLADARAFRRAVDELVHPWAGSKIDKVAGIEARGFILGGAVAHQLSAGFVPIRKKGKLPHKTVSMSYALEYGTDEMEMHVDAVQPGERVILVDDLIATGGTAEGAVKLLRQIGATVVAACFIIDLPDLGGAAKLRALDVPVRSLIAFDGH

SEQ ID NO: 38427 - protein, 331 aa, Vitis vinifera
MQHHEKLEGRPNMTMGEVNFIQAEDVRLETTRARFSNVIKRHGQLIERLSRDSDKMIFERLQKEFDAARASQTEEILLDGEQWNDGLLATIRERVHMEADRKAMPGDSSMLPDPLFHGKTTYKVGNKVICCLEGARIGIQYETSFAGEPCELYHCVLESKSFLEKMTVIEHTVPFFLPIREAENDLLSSNAMKFIDHVGELLQAYVDRREQVRLIKELYGNQIEELYHSLPYHMIEFALDDSDCKITVSLRYADLLSVLPTRIRVLAWPMQPSKKIITSTGTIGRKGNSVPARLSYAEDALRTMSLPEAYAEIVLNLPRVLQQNFQHRGSA

SEQ ID NO: 38428 - protein, 357 aa, Arabidopsis thaliana
YLHLFIDDFCICRAKFLPWFISAVARSFLQAISKDEAVAPPLRVVQIEGLAVLKIIKHCKEFSPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGVLALKALKLSDSFMELYRGGNFTGEKLREKNFSWMDIFEEIPIKVSNSALVSAFMTELETDTPVSQGDYDRLHSSTTPFLENNMEFLIKCMDDLSMEQQKFQYYYRNLSRQQAQQQAWLQKRRTENMARKSAGEEPLPEEDPSNPIFKAIPEPSRLESFLITNQVSNFCGQINGVAGQNFSRLYLTKALHDN

SEQ ID NO: 38429 - protein, 251 aa, Zea mays
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLNKDDDVRKYVNTYRRTFTTKNGKKVSKAPKIQRLVTPLTLQRKRARIADKKKRITKKKSEAAEYQKLLAQRLKEQRDRRSESLAKRRSKLSAAAKASAATSA

SEQ ID NO: 38430 - protein, 489 aa, Novosphingobium aromaticivorans DSM 12444
METPYDLAVIGGGVNGAAIARDACGRGLSVLLLERGDLAQGTSSASTKLIHGGLRYLEHREFALVAEALHERETLWRQAPHIIWPMRFVLPIVPEGRPWWMLRAGLWLYDRIGGRKALPPASRVRLDGRMGLQPEIRRGYEYSDCWVDDARLVVLLARDAADRGAEVRTRCPVTALRREGHLWRIEAGGDVFHAAMTVNAAGPQVGEIMDRAHAPRPALLRRVRGSHIVVPRLHDDPRALFLQLADGRIYFAIPWQYAFTLIGTTDSEEGADADPPHATEEEIAYLLDAANHYFRRSLRREDVVWTYAGVRLLADDGSGRPEAATRGYRLEVDRGRDRHSAPMLSVLGGKITTHRTLAEAALERLGVTDNAGWTASAPLPGGDFTPDGLDEADNLAPVEQEIAAQAQQLSRPTIHRLARAYGTEALGFVRGDMGRHIGQGFTEAELDHLTGREWAQTAEDVLWRRSKLGMWFSAEEVAALKAALGEEVR

SEQ ID NO: 38431 - protein, 182 aa, Populus trichocarpa
MASSSMISSAAVATVNRTPVQANMVAPFNGLKSAAAFPVSTRKANDITSIASNGGRVQCMQVWPPTGLKKFETLSYLPDLTEEELAKEIDYLLRSKWVPCLEFELEKGWVYREHHSSPGYYDGRYWTMWKLPMFGCTEASQVLLELEEAKKAYPNAFIRIIGFDNTRQVQCISFIAAKPKGV

SEQ ID NO: 38432 - protein, 157 aa, Oryza sativa Indica Group
MGMDSSGDGGGKAVGAAPSWVEESPAPGPRLRLPLPFPPASAVQQAPLWIQPAVSLYGYTMSMPGDAQPEGSHQSASSAKPALSSCRRNKSENTSFVSDLRDHIQEFIHASPNEHRTCFTKTIKRMFGMSKVVAERSTEAKEPGAESVLPLQTTVSR

SEQ ID NO: 38433 - protein, 415 aa, Chlamydomonas reinhardtii
MATRMVSAFRAAPLSTMASRTLLHRVSITATPSLVRPGAGSRGFRTTTVAALQAGIVGLPNVGKSTLFNALVENGKAQAANFPFCTIEPNVGIVQVEDPRLAQLSAISGSKDLIPATVEFVDIAGLVKGASKGEGMGNQFLTNIRNTDAICQVVRCFEDDDIVHVDPLDDIDVINLELALADLEVISKRQERLRKGKKAADQAERDELELSALDKIQAAIEAGKGARTAQLTKDEAVAVKGLGLLTLKPLIYAANVMEDDLADQGANNTHVQALRKRAVEEGVQVVVVSAKVEAELNELPKEEAKEWLASLGVTDGGLSSLVRATYSTLGLQTYFTTGEKETRAWTIRKGMTAPQAAGVIHTDFEKGFIRAETIAFNDFVKNKGYSGSKEAGALRLEGKEYVVQEGDVLLFRFNV

SEQ ID NO: 38434 - protein, 589 aa, Legionella pneumophila str. Paris
MNQEISNFSTFNFSSALNKALEDMKFITPSPIQAQTIPLILEGRDAIALAQTGTGKTAAFALPILQNLSPEISTTQALILAPTRELAIQVAEQFELLSKYQRNVTIAVLCGGQEYGRQLKQLRSGAQVVVGTPGRILDHIDKGTLLLNNLKTFILDEADEMLRMGFIEDVETILEKLPEKKQMALFSATMPYRIRQIANTYLNDPASIEIRMETATVKSIEQRFLFASVHQKPDALIRVLEVEDYQGVIVFVRTKSSTEEVAELLQQHGLRAMAIHGDITQSLRERIIAQFKQGAIDILVATDVAARGLDVERVTHVINYDMPHDNETYVHRIGRTGRAGRSGVTILFVTPKESRLISSIERHTRQRIEKVQVPNDHMIQMARQQRFMSNITTRLNHEHVYSYKRIVEEYIKEHDVSAVDVAAALALLLHKDMPWRKELNMPKAASAFKEERARVGEKGLDLRGRFKEDRKSSFADRKGARGSKKDFAKDFSNERKKFNDGRKAVNQESVAQDLFRIDVGKIHGVKPGNIVGAIANEAGLQSRYITGLKIHEDHSTVRLPKGMPKEVMKDLTKAWVCGRQLNLTLIGSA

SEQ ID NO: 38435 - protein, 79 aa, Oryza sativa
QKLGANAILAVSLAICKAGAIIKKIPLYQHIANLAGNKQLVLPVPAFNVINGGSHAGNKLAMQEFMILPTGAASFKEAM

SEQ ID NO: 38436 - protein, 292 aa, Bacillus pumilus SAFR-032
MKQLTVGYFGPEATFTHLAVCSCFPADAVQRAYATIPQCMDAVSKGEVDLAVVPLENALEGSVNLTIDYLIHEEALSIVGEMTAPIRQHLLVHPSKAESWETLDVIQSHPHAIAQCHQFLKKQYPDIPHRPVESTGYAAKYISEHPEEAAGAIANEIAAQTYGLTIAKKDIHDYPHNHTRFVILHKDPKASFPMNAGFSSKPKTTIVVSLPKDDQSGALHRVLSAFSWRNLNLSKIESRPTKTGLGHYLFIIDIEKEMDDVLVPGAIQELEAIGCEVKLLGSYQTYELTNEK

SEQ ID NO: 38437 - protein, 376 aa, Mesorhizobium loti MAFF303099
MKADFYETLGVQKGADEKELKSAFRKLAMQFHPDRNPGDHSCEHKFKEINEAYETLKDPQKRAAYDRFGHAAFEQGGMNGGAQGFGAGGFADIFEDIFGDMMGGRQRRSSGGRERGADLRYNMEISLEEAFAGKTAQIRVPASISCTECSGSGAKPGTQPVTCSMCHGHGKVRATQGFFSIERTCPQCQGRGQTIKDPCPKCAGQGRVTEERSLSVNIPAGIEDGTRIRLANEGEAGLRGGPSGDLYIFLAVKPHEFFQRDGADLYCKVPISMTTAALGGSFEVTTLDGTQTKVKVPEGTQNGRQFRLKGKGMPVLRQPNVGDLYIQTAVETPQNLSRRQRELLEEFEQLSSQDNSPQSSGFFARMKDFFESFGER

SEQ ID NO: 38438 - protein, 713 aa, Actinobacillus succinogenes
MSRTFILIPISGGVGLTSVSLGLIRSLEQKGAKIGFMKPISQPSTGEDKIDRTTSIVRTSTQLETAEPVMLSVAENLIGQNQTDVLVETIVAAHQELSKNNEIVIVEGLIPNRKHSYANSINYEIAQALDAEIILVAAPSTETPAQLKERVEASASLFGGKNNPNLLGVVINKFNAPVDESGRTRPDLTEIFDSFQHSHNNSAEVFKLFEQSPIKVLACIPWSADLVATRVIDLVKHLGAAIINEGEMKTRRIRGITFCARSLHHMVEHFHAGDLLVTSADRADVLAAAALAVTNGIELGGILLTGGYKIDNEINKLCQRAFETTGLPIFRIEGNTWQTALSLQSFNLEVPVDDKIRIENIKEYTSRQFDAEFIHQIAGTSARVRRLSPPAFRYQLTELARAAKKRIVLPEGDEPRTVKAAALCAERGIADCVLLANPEDVKRVASAQGVSLDKGITVIDPATVRENYVARLVELRKAKGMTEEAAREQLEDNLVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGAGADVEKVKEATRIAQEKRPDLLIDGPLQYDAAVMADVAKSKAPNSPVAGKATVFVFPDLNTGNTTYKAVQRSADLVSIGPMLQGMRKPVNDLSRGALVDDIVYTIALTAIQATQA

SEQ ID NO: 38439 - protein, 225 aa, Mesorhizobium loti MAFF303099
MSTKTLIAPSVLASDFSKLGDEVEAVAAAGADWIHLDVMDGHFVPNITFGPPVIKAIRNRTKAFFDCHLMIAPADPYLAAFAEAGCDGMTVHAEAGPHLDRSLQTIRNLGKKAGVSLNPATPETMIEYVLDRLDLILIMTVNPGFGGQAFIPGIVDKVRRVKALIGDRPIRIEIDGGVSPETAPLVTAAGADVLVAGAAIFKGGSVEAYRANIEAIRTAADKAAG

SEQ ID NO: 38440 - protein, 447 aa, Bacillus sp. SG-1
MEHGASVASLVIVILAAFITPILLHRLKLNFIPVVIAEIIVGLIIGRSGFDLVQYDVWLETLSTLGFIFLMFLSGLEIDFSAFSNKGKKKEILPNGKPEPNRLKVSMIIFAGIFIVSLALSYMFVLAGLIDNAFLMTLIISTISLGVVVPTLKEAHIMKSGIGQIILLVAVIADLVTMILLAVFVSLYGEGHGNMWLLLLLFGAGVLLYFLGRRFKNNSLMKSLSTGTVQIGTRAIFTLIILLVGVSESVGAENILGAFLAGVLVSLLSPPQEMVHRLDSFGYGFLIPIFFVMVGVELELWSLLSDPKMLILIPLLMLAFLLSKLVPVFLLRKWYDNKTTIASAFLLTSTLSLVIAAAKIAERMEIITAQMSGTLILVAVITCLVTPIVFKKMFPKEAGEEKQIKVAFLGANQMTLPVSRELKSALYVPVLYHTRQDKSNRNISDSL

SEQ ID NO: 38441 - protein, 1118 aa, Arabidopsis thaliana
MNSQQSTRTKQMLQQSSTHLLCGVVLLQLFAAQVDAQRSTSPWQTLSGDAPLVIARGGFSGLFPDSSLAAYQFAMVVSVADVVLWCDVQLTKDGHGICFPDLNLANASNSEEVYPNRQKSYPVNGVTTKGWFPIDFSLTELQKVLFSLIRGILSRSGKFDENGYSISTVQNVATQMKPALFWLNVQHDEFYEQHNLSMSSFLLSTSRTVSIDFISSPEVNFFRKIAGGFGNNGPSFVFQFMGKEDFEPTTNRTYGSILSNLSFVKTFASGILVPKSYILPLDDKQYLLPHTSLVQDAHKAGLKLYASGFANDVDIAYNYSWDPVSEYLSFVDNGNFSVDGMLSDFPLTASASVDCFSHIGRNATKQVDFLVISKNGASGEYPGCTKLAYEKAIKDGSDVIDCPVQMSSDGIPFCSSSIDLVNSTTVGQTHLRNRSIIVPEISSVAGIFTFSLTWHEIQSLTPAISNPFRENGMSRNPNERNSGNLISLYEFLNLAKNSTSLSGILISLENVVYLREKKGLDVVKVVLNRLTETGYIVGTLKVMIQSTTRLVLVDFKNQSTYKTVYKIKETIGNITDSAIEDIKKFANAVVINKASVFPNSDSFLTGQTTNVLERLQKFQLPVYVELFQNEFVSQPFDFFADETVEINAYIFGAGINGTITEFPYTAARYKRNRCLGREEVPPYMLPVNPGGVLTLISTSSLPPAQDPNPIFTHDDVTEPPLPPVIAKSPTSTLGTPSTIAKPLRNFLKVIRIVSWSVAGVVLFLVLLTLVFCFHRKRETRLRQQKLKALIPLEHYTYAQVKRITKSFAEVVGRGGFGIVYKGTLSDGRVVAVKVLKDTKGNGEDFINEVATMSRTSHLNIVSLLGFCSEGSKRAIIYEFLENGSLDKFILGKTSVNMDWTALYRIALGVAHGLEYLHHSCKTRIVHFDIKPQNVLLDDSFCPKVSDFGLAKLCEKKESILSMLDTRGTIGYIAPEMISRVYGNVSHKSDVYSYGMLVLEIIGARNKEKANQACASNTSSMYFPEWVYRDLESCKSGRHIEDGINSEEDELAKKMTLVGLWCIQPSPVDRPAMNRVVEMMEGSLEALEVPPRPVLQQIPISNLHESSILSEDVSVYTEG

SEQ ID NO: 38442 - protein, 1390 aa, Arabidopsis thaliana
MTMPQTDGVEFASRNNLENGDGDQVRSQWVAIERSPTCKRITTALFCKRDEQGKRSQRRVMDVSKLEDLDRRLFIDELIRHVEDDNRVLLQKIRTRTDEVGIDLPKIEVRFSDLFVEAECEVVHGKPIPTLWNAIASKLSRFTFSKQEDKISILKGVSGIIRPKRMTLLLGPPGCGKTTLLLALSGRLDPSLKTRGEVSYNGHLFSEFVPEKTSSYVSQNDLHIPELSVRETLDFSGCFQGAGSRLEMMKEISRREKLKGIVPDPDIDAYMKAASIEGSKTNLQTDYILKILGLTICADTRVGDASRPGISGGQKRRLTTGEMIVGPIKTLFMDEISNGLDSSTTFQILSCLQQFARLSEGTILVSLLQPAPETFELFDDLILMGEGKIIYHGPRDFICSFFEDCGFKCPQRKSVAEFLQEVISRKDQEQYWCHRDKPYCYVSIDSFIEKFKKSDLGLQLQDELSKTYDKSQTQKDGLCIRKYSLSNWDMFKACSRREFLLMKRNSFVYVFKSGLLIFIGSIAMTVYLRTGSTRDSLHANYLMGSLFFSLIKLLADGLPELTLTVSRIAVFCKQKELYFYPAWAYAIPSAILKIPISFLESFLWTMLTYYVIGYSPEAGRFIRQVLILFALHLSCISMFRAIGAVFRDFDVATTIGSISIVLLSVFGGFIVRKPSMPSWLEWGFWLSPLSYAEIGLTSNEFFAPMWRKMTSENRTLGEQVLDARGLNFGNQSYWNAFGALIGFTLFFNTVFALALTFLKTSQRSRVIVSHDKNTQSSEKDSKIASHSKNALPFEPLTFTFQDVQYFIETPQGKKLQLLSDVTGAFKPGVLTALMGVSGAGKTTLLDVLSGRKTRGDIKGQIEVGGYVKVQDTFSRVSGYCEQFDIHSPNLTVQESLKYSAWLRLPCNISSETKSAIVNEVLETIELEEIKDSLVGVPGISGVTAEQRKRLTIAVELVSNPSIIFMDEPTTGLDARAAAIVMRAVKNIAETGRTVVCTIHQPSIDIFEAFDELILMKNGGKIIYYGPLGQHSSKVIEYFMSIPGVPKLKENSNPATWILDITSKSSEDKLGVDLAHIYEESTLFKENKMVIEQTRCTSLGSERLILSSRYAQTSWEQFKACLWKQHLSYWRNPSYNLTRIIFMCFTCMLCGILFLQKAKEINNQQDLFNVFGSMFTVVLFSGINNCSTVIFCVATERNVFYRERFSRMYNPWAYSLAQVLVEIPYSLFQSIIYVIIVYPMVGYHWSVYKVFWSFYSIFCSLLIFNYFGMLLVVVTPNVHIAFTLRSSFYAIVNLFAGYVMPKPNIPRWWIWMYYLSPTSWVLNGLLTSQYGDMEKEILAFGEKKKVSAFLEDYFGYRYDSLALVAVVLIAFPILLASLFAFFIGKLNFQKK

SEQ ID NO: 38443 - protein, 328 aa, Staphylococcus aureus subsp. aureus MRSA252
MKENFWSELPRPFFILAPMEDVTDIVFRHVVSEAARPDVFFTEFTNTESFCHPEGIHSVRGRLTFSEDEQPMVAHIWGDKPEQFRETSIQLAKMGFKGIDLNMGCPVANVAKKGKGSGLILRPDVAAEIIQATKAGGLPVSVKTRLGYYEIDEWKDWLKHVFEQDIANLSIHLRTRKEMSKVDAHWELIEAIKNLRDEIAPNTLLTINGDIPDRKTGLELAEKYGIDGVMIGRGIFHNPFAFEKEPREHTCKELLDLLRLHLSLFNKYEKDEIRQFKSLRRFFKIYVRGIRGASELRHQLMNTQSIAEARALLDEFEAQMDEDVKLEL

SEQ ID NO: 38444 - protein, 440 aa, Davidiella tassiana
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSAAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKAVYAGDNFRTAINL

SEQ ID NO: 38445 - protein, 130 aa, Arabidopsis thaliana
  misc_feature (91)..(91): Xaa can be any naturally occurring amino acid
  misc_feature (103)..(103): Xaa can be any naturally occurring amino acid
CWSQTPRVPDLEEFYAVFRSMVVSPAQATMVCPFNGLKNSDDLPATQQANNDITSISCNGGRVNCMQVCAPHVKKKCETLYYLPDLTEYEXAKEVDYLIHNKXIPYVEFELEHGFVNREHVNSPGYYDGR

SEQ ID NO: 38446 - protein, 273 aa, Bacillus sp. SG-1
MKVGIVGTGNMGGILMEAFLESGAISPSDLNVANRTRAKAEKFKKKFQDITIYNEPANLIKDSDVIFICVKPLDIYDLLKSSQSCFTQDKCIVSITSPISVEQIESLVDCSCMRVIPSITNRALSGVSLFSYGSRCTKEWQDAIWKLLSTISTPVIINENITRVSSDIVSCGPAFFTYLTRKFIQGAVSETEIDESTATILASEMLIGLGELLKKEIYTLAALQEKVCVKGGITGEGISAMEANLGELFHELFRATHKKFEEDLEETKKQFGL

SEQ ID NO: 38447 - protein, 441 aa, Chlamydomonas reinhardtii
MQLNVRSTASGARSSTRSRRMTAVVQAVAQRAGTIDVQRNENFGKLRAGYLFPEIARRRKAHQEKNPDAKIISLGIGDTTEPLPKYIADAMAKAAAGLATREGYSGYGAEQGQGALREAVASTFYGHAGRAADEIFISDGSKCDIARIQMMFGSKPTVAVQDPSYPVYVDTSVMMGMTGDHNGTGFDGIEYMVCNPDNHFFPDLSKAKRTDIIFFCSPNNPTGAAATRAQLTELVNFARKNGSILVYDAAYALYISNPDCPKTIYEIPGADEVAIETCSFSKYAGFTGVRLGWTVVPKALKYANGEPVHADWNRVMTTCFNGASNIVQAGGLACLQPEGLKEMNAMIKFYKENAQILKTTFTEMGFSVYGGDDAPYIWVGFPGKPSWDVFAEILERCNIVTTPGSGFGPAGEGFVRASAFGSRENILEAVRRFKEAYGKRN

SEQ ID NO: 38448 - protein, 489 aa, Nocardia farcinica IFM 10152
MTQSSGDPIQVSHLIGGQWRPASDGATFESRDPHDDSLLAVVPRGTAEDGTAAITAARTAFDEGPWPRLAPKERAAILHAVADAVDAHRDELAELETRDGGKTISQARHAEIPRVAHNLRFFADYAAMAANEAYPAGDLFSYVLYPPAGVVSAISPWNAPLMLATWKIAPALAFGNTAVLKPAPQTPLTAHRFAQLALEAGLPEGVLNVVHGFGGEAVAGPLTSDPRVDRITFTGSSATGVKILQAAAANHTPVSAELGGKSANIVFADADLDVAVPMAIRAIFGGNGQVCLAGSRLLVQHSIMDEFLARFTEEANKLTVGDPKDPATFLGPLIEARHLDKVHGYVELAQDEGGKVVTGGARLTGPDHAAGHYYPPTIITGLTNDSRTAREEIFGPVETVLGFDTEDEALRIANDSPYGLAGMLFTQNLDRAHRMAARWRAGTVWINCFFERDLRLPFGGEGASGVGREGGQYSREFFTEPRAVTLRLR

SEQ ID NO: 38449 - protein, 459 aa, Oryza sativa Japonica Group
MLRRLPVWGCITGGGDTVPSTPFATSHRPRLLLCRSRRRRLFSRLTPTASSLAAPASHRPRLLPCCSRHCCFLSRLTPAASSPAAPPAKLTGPPTHLLSPSPLASTSIAVTHELASLNSTTSPTTANLLLPRLATDRAAMAASASAPPHSLLLAAVALAALASVAAARDENGVYDPCSDTRIQRGDGFSFGIAFATLGAFYSGGSVQLSPCDRRLSLASSGQLAVFRPKVDEISLLTINTTTGFNPNSHFSVTYCHVGPFLHPDIPVEGIGPGFLRANSLHSDIEALFCGYWLCKYATYEYFGDFVILYCGEGSLLVFLSPATAGGYMVAFAGRKYAARSVPTFVSNSSYTVSSFTLVLEFNKGRLQNLHWKKDGCGACAKSSSLVCIGKQTCAFRTQSCKSQGPVDCSIGIQLAFSGTDKHESVLNSWYEVSNLRQYSLYGLYSNLKDTLSGQFNKFF

SEQ ID NO: 38450 - protein, 112 aa, Glycine max
  misc_feature (44)..(44): Xaa can be any naturally occurring amino acid
  misc_feature (94)..(94): Xaa can be any naturally occurring amino acid
MDLYWVRVQHLVVTVLKRAAAKDTGIHPDDSDTVAMSQELLEAXMIPAVRADGGDIEYREFLTAVQGIVTVGVHEACSGCPTWCSDCVISSLEXMLMHYVFRDDKVWTIDLE

SEQ ID NO: 38451 - protein, 341 aa, Populus trichocarpa
MARTSCFQVVLPLTTCSLPSSTLYSKSIKLKPNTIDNLRIKCFASINARNSSSSSNIPMPPINPKDPFLSKLASIAATSPDSLLQDSPVSGSDTPPYLDIFESPKLMATPAQVERSVSYNEHRPRTPPPDLPSLLLHGRIVYIGMPLVAAVTELVVAELMYLQWMDPKAPIYIYINSTGTTRDDGESVGMETEGFAIYDSMMQLKNEIHTVAVGAAIGQACLLLAAGTKGHRYMMPHAKAMIQQPRVPSSGLMPASDVLIRAKEAVINRDVLTELLAKHTGNSVETVANVMKRPFYMDSRRAKEFGVIDKILWQGQEKIMADVLPPEDWDKSAGIKVADPF

SEQ ID NO: 38452 - protein, 355 aa, Botryotinia fuckeliana
MGACMSSNVEDTEQRKRSQMIDKKLEEDSKRLRRECKILLLGSGESGKSTIVKQMKIIHQNGYTIDELALYRLTIYKNLIDCAKALVGAMRQMEIEPENPANKEYGSFLLEYIVDPDPHTPLNPRVGTAVASFWKDGHIDLLLARQSEFYLMDSAPYFFEEAGRIAAHNYIPTEADVLRARTKTTGIYETRFTMGSLSIHMFDVGGQRSERKKWIHCFENVTSIIFCVALSEYDQVLLEESNQNRMMESLVLFDSVVNSRWFMRTSIILFLNKVDLFKQKLGRSPLETYFPDYSGGNDLNRAAKYLLWRFNQVNRAHLNLYPHLTQATDTSNIRLVFAAVKETILQNALKDSGIL

SEQ ID NO: 38453 - protein, 179 aa, Legionella pneumophila str. Paris
MITVGNKFPEFQLKATVANDINNAFQMISNETYRGKWLVVFFWPKDFTFVCPTEIAEFGRLNSEFADRDAQILGGSTDSEFVHLAWRNQHPDLKDLPFPMLADVKRELTANLGILDDEEGVAQRATFIVDPQGITRFVMVTDLNVGRNPAEVLRVLDALQTDELCPCNWKKGEETIHIK

SEQ ID NO: 38454 - protein, 303 aa, Cryptococcus neoformans var. neoformans JEC21
MFKKRSRPTSVRDKSRIEEAEGSGNEEKVASGSGTPIVDEQEDDTGRTVEELLMLKKLKKSQSRQGIDLEKLNRGEEMKRKGKKKEDPAEKYGLQPGRGMGRGDGEKEKDEEMEDEAERAKRLVRVNNFTQQTNALDVDKHMMAYIEAELAKRRGQAADTTDKSAIEDNDPQAELYRIAEKYQFETRKKKADDEGNVTNSLGMLTSIPEVDLGMDNRLKNIEMTEKAKRDMLEQRKQEAAAAAAAAKEAEDPGYSAARSSDIYVNSEKRRTTGVPRQESATDEQVYERFKKRWDKLPRFFFFV

SEQ ID NO: 38455 - protein, 1035 aa, Medicago sativa
MTMEEVSLAGTLPFDRAVEQAIVSIKKGAYLLKCGNRGKPKLCPFRLSPDERNLVWCSGKQEKHLRLSGVTKIVQGEGNIRSQRQNGTEKECHSSSLIYANGEHPLDLICKDKAQAATWFVGLKAVISRCQQPKAFSSLRSCKGVQGCVSSPSGILRRKKNLGLLDDASQFTQVHSVCASPTLSLSERCFSDGLSYKSDFYSSASSLSSIHGITDNSVPSSPYINPDIHSNIKTSRFEKEYKKELSSNRSIMPPASALVGNNVLKDVMIWGGGIGCLVGIVNERFVQNSIYSLVPKLLESTAMLDVQNVALGGNHAAIVTKQGEVYCWGQGKCGRLGQRIDMDISSPKIVDSLSDIRVKKVACGEYHTCALTDSGDVYTWGKDSCSDLVDEGRIRSQWLTHKFSLPVEGISISSIACGEWHTAIVSSCGRLFTYGDGTFGVLGHGNYHSFSSPKEVESLKGLCVRSVACGTWHTAAIIEVSAERFKYNTSTGKLFTWGDADEGRLGHADNVNKLVPTCVSQLVDYDFVQVSCGRMMTLALTNMGKVFAMGSAKYGQLGNPHVKDRAVVVEGMLKQEYVKMISCGSYHVAVLTSSGSVYTWGKGENGELGLGDTENRYTPCFVEALRDRQVDTITCGPSFTVAICLHKPISISDQSSCNGCRLPFGFTRKKHNCYNCGLLFCRSCSSKKVLNASLAPVKSKAFRVCESCFNKKQGSSERSSMDSSKSRNCNNQQIQRHHQNMIGDVTEDRGETNVTNGPLLSLSQTCYRKNMPSGRKVWKIQHESQRDVEDSSSTLGSVIQCGQGQVPYSAQFRINCTENSVVHETETTKSDKLLIEEVQRLRAEAKRLEKQCELKNQEIQECQQKVEESWSVAKEEAAKCKAAKEVIKALALRLHTISGKDNHGLEQKAGLQEFLPNLAPIHTDMNSPRNANTDSLSNSPIIFSSALKSKFGRSILLKKDNNLTKAESQQENALKVEWVEQYENGVYITLTKSPSGEKGLKRVRFSRKRFSQKEAERWWEENQTKVHHKYEIETR

SEQ ID NO: 38456 - protein, 354 aa, Oryza sativa Indica Group
MAGARAIGSLPVPNVQELAKTCNGPDEHIPERYIRPEASSEEVISNYHGEAIPIIDLNKLLSPQSSEECVKLRSACQYWGFFQLINHGVPDEVIANLKRDIVDFFSQPLDAKKEYTQLPNSLEGYGQALVFSEDQKLDWADMLYLQVHPSDSRDLRFWPTSPASFRRSLDAYSSETKSLALCLFEFMAKAVGAKPEALLGIFEEQPQGLRMTYYPPCLQSDKVMGISPHSDVVGLTLLLQVNDVQGLQIKKDGKWLSVDAPNGAFIVNIGDTLEILSNGKFRSVEHRAVINPNKERISASLFHYPCENMVIRPLTEFVKDGKVNYRSISYLDFMTQFFTQQLDGKNRLEMLKLE

SEQ ID NO: 38457 - protein, 450 aa, Botryotinia fuckeliana
MSNLPSEPEFEQAYNELASTLENSTLFEKNPEYRTALKVVSIPERVIQFRVVWEDDKNQVQVNRGYRVQFNSALGPYKGGLRFHPTVNLSVLKFLGFEQIFKNALTGLNIGGGKGGADFDPKGKSDNEIRRFCVSFMRELSKHIGADTDVPAGDINVGGREIGFLFGAYKAIQNKWEGVLTGKGGSWGGSLIRPEATGYGLVYYVAHMIQYAGQGSFQGKRVAISGSGNVAQYAALKCIELGATVVSLSDSQGSLIAEGDAYFTPEDVGKIAELKLKRQSLTAFEHGGKYKYIEGSRPWTHVKVDVALPCATQNEVSKEEAESLVASGARYIAEGSNMGCTQEAIDVFEAERKEKKDKAIWYAPGKAANAGGVAVSGLEMAQNSARISWTQEEVDEKLKDIMKNAFETGLETPKKYVEAKDGEYPSLVAGSNIAGFVKVASAMHNHGDWW

SEQ ID NO: 38458 - protein, 798 aa, Pyrococcus horikoshii OT3
MMLMVEKKEIKLKVASAYQRDVGRGIVRIDRRSMRELGVSPGDVVEIIGTKNTAAIVWPAYPEDEGLGIIRMDGTIRKNAGVGLGDEVTIRKADVKEARKVVLAPTEPIRFGRDFVEWLHERLVGRPVVRGDYIKIGVLGQELTFVVTTTQPSGVVQITEYTDFDISEKPVKEVEKRMTTGVTYEDIGGLKDVIEKIREMIELPLKHPELFEKLGIEPPKGVLLYGPPGTGKTLLAKAVANEANAYFIAINGPEIMSKYYGESEERLREVFKEAEENAPSIIFIDEIDAIAPKRSEVTGEVEKRVVAQLLALMDGLKGRGKVIVIGATNRPDALDPALRRPGRFDREIEVGVPDKQGRKEILQIHTRGMPIEPDFRKEDVLKILEGLKKEGKFRDVIDKAIDRVMKVSEDDIPKVLKELNGELYEEVRTRLVDLLLEELAEVTHGFVGADLAALAREAAMAALRRLIKEGKIDFEAETIPREVLDELKVTRKDFYEALKMVEPSALREVLIEVPNVHWDDIGGLEEVKQELREAVEWPLKYPEAFRAYGITPPKGVLLYGPPGTGKTLLAKAVATESEANFIAVRGPEVLSKWVGESEKNIREIFRKARQAAPTVIFIDEIDAIAPRRGTDVNRVTDRLINQLLTEMDGIQENTGVVVIAATNRPDILDPALLRPGRFDRLILVPAPDEEARFEIFKVHTRSMPLADDVDLRELARRTEGYTGADIAAVCREAAMIAMRKALEKGIIKPGMKADEIKQKAKVTMKDFEEALKKIGPSVSKETMEYYRKIQEQFKQARG

SEQ ID NO: 38459 - protein, 418 aa, Gibberella zeae PH-1
MSLSNKLSIADVDVKGKKVLIRVDFNVPLDADKNITNNQRIVGALPTIKYALENGAKSVILMSHLGRPNGSPNEKYSLKPVVAELEKLLSKKVTFAPDCVGPEVEEIVNKAEDGSVILLENLRFHIEEEGSSKDKEGNKTKADKAQVEAFRKGLTALGDVYINDAFGTAHRAHSSMVGVDLPQKASGFLVKKELEYFAKALENPQRPFLAILGGAKVSDKIQLIDNLLDKVNTLIICGGMAFTFKKTLENVSIGNSLFDEAGSKTVGNLVEKAKQKGVKLVLPVDYITADKFDKDANTGYATDKDGIPDGWQGLDCGEESVKLYKEAIADAKTILWNGPAGVFEFEKFASGTKATLDAVVDAVQKDGKIVIIGGGDTATVAKKYGVEDKISHVSTGGGASLELLEGKELPGVTALSSK

SEQ ID NO: 38460 - protein, 329 aa, Bdellovibrio bacteriovorus HD100
MQAGSVSDVVGHTPLIKLQSLSKITGCEIFAKAEYLNPGGSVKDRTALGIIQSAEKQGLLKPGDTIVEGTAGNTGIGLATLAAQRGYHCVIVMPDNQSKEKYHALEALGVELVKVAPCPFANPNHFYHTARALAESRPNSFWANQFENTANFEIHYKTTGPEIWEQMGQRVDAFVSSVGTGGTLAGVSAYLKEQDPKVFTLLADPMGSGLYSFVKSGKFEAQGSSITEGIGIMRLTENFKKARVDEAVQIHDEQMLSMLYYLAQHEGLLVGTSAALNIFASYQYALQNQGKGLRIATVMGDSALRYQSKVFNPQFLNEKNLKIMPLIHS

SEQ ID NO: 38461 - protein, 1392 aa, Arabidopsis thaliana
MTMSQTDGVEFASRNTNENGHDDDDQLRSQWVAIERSPTFERITTALFCKRDEKGKKSQRRVMDVSKLDDLDRRLFIDDLIRHVENDNHVLLQKIRKRIDEVGIDLPKIEARFSDLFVEAECEVVYGKPIPTLWNAISSKLSRFMCSNQAKKISILKGVSGIIRPKRMTLLLGPPSCGKTTLLLALSGRLDPSLKTRGDISYNGHLFSEFVPEKTSSYVSQNDLHIPELSVRETLDFSGCFQGTGSRLEMTKEISRREKLKGIVPDPDIDAYMKAASIEGSKTNLQTDYILKILGLTICADTRVGDASRPGISGGQKRRLTTGEMIVGPIKTLFMDEISNGLDSSTTFQILSCLQQFARLSEGTILVSLLQPAPETFELFDDLILMGEGKIIYHGPRDFVCSFFEDCGFKCPNRKSVAEFLQEVISRKDQEQYWCHIEKTYCYVSIESFIEKFKKSDLGLELQDRLSKTYDKSQTQKDGLCFRKYSLSNWDMLKACSRREFLLMKRNSFVYVFKSGLLIFIGFIAMTVYLRTGSTRDSLHANYLMGSLFFSLFKLLADGLPELTLTISRIAVFCKQKELYFYPAWAYAIPSAILKIPISFLESFLWTMLTYYVIGYSPEMGRFIRQFLILFALHLSCISMFRAIAAVFRDFVVATTVGSISIVLLSVFGGFIVRKPSMPSWLEWGFWLSPLSYAEIGLTANEFFAPRWGKITSENRTLGEQVLDARGLNFGNQSYWNAFGALIGFTLFFNTVFALALTFLKTSQRSRVIVSHEKNTQSSENDSKIASRFKNALPFEPLTFTFQDVQYIIETPQGKKLQLLSGVTGAFKPGVLTALMGVSGAGKTTLLDVLSGRKTFGDIKGQIEVGGYVKVQDTFSRVSGYCEQFDIHSPNLTVQESLKYSAWLRLTSNISSETKCAIVNEVLETIELEEIKDSIVGIPGISGLTTEQRKRLTIAVELVSNPSIIFMDEPTTGLDARAAAIVMRAVKNIAETGRTVVCTIHQPSIDIFEAFDELILMKNGGKIIYYGPLGQHSSKVIEYFMRIHGVPKLKENSNPATWILDITSKSSEDKLGVDLAQMYEESTLFKENKMVIEQTRCTSLGSERLILSSRYAQTSWEQFKACLWKQHLSYWRNPSYNLTRIIFMSFTCMLCGILFWQKAKEINNQQDLFNVFGSMFTVVLFSGINNCSTVLFSVATERNVFYRERFSRMYNSWAYSLAQVLVEIPYSLFQSIVYVIIVYPMVGYHWSVFKVFWSFYSIFCTLLIFNYFGMLLVVVTPNVHIAFTLRSSFYAIVNLFAGYVMPKPNIPRWWIWMYYLSPTSWVLNGLLTSQYGDMEKEILAFGEKKKVSDFLEDYFGYRYDSLALVAVVLIAFPILLASLFAFFIGKLNFQKK

SEQ ID NO: 38462 - protein, 296 aa, Pyrococcus horikoshii OT3
MRLDVICMGNLNYDITFILERFPEFHEKVNAKEVYTGLGGSAGNTATWLSLLGLKVGFIGSVGNDDFGRLHLEFFKKIGVDTRGIKVVDEPTGVAVMMVIGEDKRIVKYPGANRFKEVREDYLKLARHLHLSSNPLSLVEKAVTLAKNLGLTVSFDPGEMEVPKNIEEKVDILMMNEDEFKRKYGDLKNITKVKSRIAIATLNGGGALVRDQNGKVYEVRGLSAKAVDTTGGGDSFNAGFIYGFLNGWDVVSSAKLGMLLAYLTVQKVGARSAVIPLEEVKKKANELNLDLPFNSS

SEQ ID NO: 38463 - protein, 517 aa, Triticum aestivum
MAASSPPKSQPITMGPLPPLVLALFLLPLLYLFFRGGSKGRSTQGARNAPGPPKQLPVLGNLLQLGGRPHRYFQSLTQKYGPVVQVQLGRVRMVVVASPEAAKEVLRTNDLHCCSRPNSPGARMLSYNFLDVAFGPYSDYWREMRKLLVLELLSVRRVQSFAYARAAEVDRLVSSLAGTPPGTPVDLSEQLYALSDGIIGTVAFGKMYGSESFERTSFQRMMDETLRVLGSFTFEDFFPSSALARWADALTGVASRRRRVFLRIDRFFDAVIDKHLEPGRLAAGVQEDMVDALVKMWRDQDGALALTRDNIKGILMDTFAGGIDTCAVTTIWIMAELMRNPRVMRKAQSEVRAAVGNKSRVYEEDAQGLKYLKMIVKENFRLHPPGPLLIPRETMQSCEIAGYSVPAGTRIHVNVWAMGRDPDIWDRPEEFFPERFEEAHVDFRGLHFELLPFGSGRRACPAIAMGVANVEVVLANLLYCFDWELPEGMKEDDIDMEETGQLVFRKKVALELVAVKR

SEQ ID NO: 38464 - protein, 619 aa, Manihot esculenta
MEAVLQTKGLFSLPPNPKTRASLYPSQGLKHGLFAVKPKTVAGFSLSSNGLPRFPTVVSKPNGFLPKDRNLHICRAEAAAAADGQPLFGEAEKPKLLGIGLSTLKKIIPLGLMFFCILFNYTILRDTKDVLVVTAKGSSAEIIPFLKTWVNLPMAIGFMLLYTQLSNVLSKQALFYTVIVPFIAFFGAFGFVLYPLTNQIHPQAFADKLLNILGPRFLGPIAILRIWTFCLFYVMAELWGSVVISVLFWGFANQITTVDEAKRFYPLFGLGANIALIFSGRTVKYFSNLRKNLGPGVDGWAISLKGMMSIVVLMGLAICFIYWWTNKFVALPTRSKKKKEKPKMGTMESLKFLVSSKYIRDLATLVVAYGISINLVEVTWKSKLKAQFPSPNEYSSFMGDFSTATGIATFTMMLLSQFIFDKYGWGVAAKITPAVLLLTGVGFFSLILFGGPIQPALVQFGLTPLLAAVYVGALQNIFSKSAKYSLFDPCKEMAYIPLDEETKVKGKAAIDVVCNPLGKSGGALIQQFMILTFGSLANSTPYLGGILLVIVLAWLAAAKSLDTQFTALRKEEELEKEMERASVKIPVVSQEESGNGSLMSGSTLNPAAGDSSETIPGKV

SEQ ID NO: 38465 - protein, 254 aa, Oryza sativa
  misc_feature (248)..(248): Xaa can be any naturally occurring amino acid
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSXATVKSA

SEQ ID NO: 38466 - protein, 333 aa, Escherichia coli
SGFYHKHFLKLLDFTPAELNSLLQLAAKLKADKKSGKEEAKLTGKNIALIFEKDSTRTRCSFEVAAYDQGARVTYLGPSGSQIGHKESIKDTARVLGRMYDGIQYRGYGQEIVETLAEYASVPVWNGLTNEFHPTQLLADLLTMQEHLPGKAFNEMTLVYAGDARNNMGNSMLEAAALTGLDLRLVAPQACWPEAALVTECRALAQQNGGNITLTEDVAKGVEGADFIYTDVWVSMGEAKEKWAERIALLREYQVNSKMMQLTGNPEVKFLHCLPAFHDDQTTLGKKMAEEFGLHGGMEVTDEVFESAASIVFDQAENRMHTIKAVMVATLSK

SEQ ID NO: 38467 - protein, 316 aa, Nocardioides sp. JS614
MTTPWRTAATWSLADIPPQDGRTVLVTGTTVGGLGQFTALELARRGARVVLAGRTEQRLEETRAAITTEVPAAALETLVVDLADLASVRRAAVQAAGLGPIDVLVNNAGVMGTPYHRTGDGLELQLATNHFGPFLLTGLLLPQLVASGAGTVVTVSSQMHRVARSAPLDDPRSQHGRYQRWPTYARSKLANLLFTYELDRRARRAELPVRALAAHPGFAATHLAANGQYGRARGGRATILDAAIKAISPNRADEGAWPTLMAATADLPGGTYCGPSGFAEGGGVPHVTTSNKLSHDQAAQRRLWELSEQTTGIRYP

SEQ ID NO: 38468 - protein, 484 aa, Campylobacter upsaliensis RM3195
MQGFISQVLGPVVDVDFDDYLPQINEAIRVDFNNDGKEQKLILEVAAHLGDNRVRTIAMDMTDGLVRGLKAEALGSPISVPVGEKVLGRIFNVTGDLIDEGEEISFDKRWSIHRDPSAFEDQSTKSEIFETGIKVVDLLAPYAKGGKVGLFGGAGVGKTVIIMELIHNVAFKHSGYSVFAGVGERTREGNDLYNEMKESNVLDKVALCYGQMNEPPGARNRIALTGLTMAEYFRDEMGLDVLMFIDNIFRFSQSGSEMSALLGRIPSAVGYQPTLASEMGKFQERITSTKKGSITSVQAVYVPADDLTDPAPATVFAHLDATTVLNRAIAEKGIYPAVDPLDSTSRMLDPQIIGEEHYKVARGVQSVLQKYKDLQDIIAILGMDELSEEDKLVVERARKIEKFLSQPFFVAEVFTGSPGKYISLEETISGFKSILEGKYDNLPENAFYMVGNIDEAIAKAETLREISRGDTCLDNCKVEQKKAN

SEQ ID NO: 38469 - protein, 683 aa, Xanthomonas campestris pv. vesicatoria str. 85-10
MSYLVLARKWRPKRFAELVGQEHVVRALSNALDSGRVHHAFLFTGTRGVGKTTIARIFAKSLNCETGTSADPCGTCPACLDIDAGRYIDLLEIDAASNTGVDDVREVIENAQYMPSRGKFKVYLIDEVHMLSKAAFNALLKTLEEPPEHVKFLLATTDPQKLPVTVLSRCLQFNLKRLDEDQIQGQMTRILAAEQIESDPSAIVQLSKAADGSLRDGLSLLDQAIAYAGGALREDVVRTMLGTVDRTQVGAMLQSLADGDGARLLQVVAALAEFSPDWSGVLEALAEALHRVQVQQLVPSVAFVGDGIDPTPFAAQLRPEVVQLWYQMALNGRRDLYLAPSPRAGFEMAVLRMLAFRPAAAVPAGGSDDGRGATAGGGARSGAAGGQAAAPAAAAPAVVASPAAVTDTMPAAEASLPASATRATPISAAPPVVVLAPQESSPDSRASAASARNDDTPPWAVDDAPVRAQVAPAPDTMAVLAPEAAMAPPAATVELAHPDAIASDAVVEAPASVAVSSLVEPSSLEEPAVVAPPATAGAASDSVTDATALLDDGRIADAEQWLELVTRSGLNGPSRQLAANAAFIGHRDGVLRLALAPGFEYLNSERSIANLAQALAPVLGNPPRIVIETGSADVETLHERANRQKGERQSAAETAFMNDPTVQLLIQQQGARIVPDSIRPYDE

SEQ ID NO: 38470 - protein, 271 aa, Bifidobacterium longum DJO10A
MDHKDLANEVIEQSRAREITDGVHRVLDRITEAESVAGREAGSVHLLAATKTRDVGEILAAIDAGVHRIGENRPQEIIVKAPGLARLLAERGYSLGVVETEGGAAADAAHHIPFHLIGQLQANKIGKVLPAVDTIESVDSIELAEKIARRATMRGITVGVLLEVNESGEESKSGCAPSHAIDLAQRIGAMGGLRLQGLMTIGAHVDDERTIRAGFAHLRRTRDQILASGAEGTADCTELSMGMTHDMAYAIEEGSTIVRVGTAIFGERAFI

SEQ ID NO: 38471 - protein, 571 aa, Oryza sativa
  misc_feature (308)..(308): Xaa can be any naturally occurring amino acid
MAGGGVEDTYGEDRATEDQLITPWSFSVASGYTLLRDPRHNKGLAFSEAERDAHYLRGLLPPSIVSQELQEKKLMHNLRNYTVPLQRYIAMMDLQERNERLFYKLLIDNVEELLPVVYTPTVGEACQKYGSIYRRPQGLYISLKDKGKILEVLKNWPERSIQVIVVTDGERILGLGDLGCQGMGIPVGKLSLYTALGGVRPSACLPITIDVGTNNESLLNDEFYIGLKQRRATGEEYHELLEEFMTAVKQNYGEKVLVQFEDFANHNAFDLLAKYSKSHLVFNDDIQGTASVVLAGLIAALKVVGGTXLADHTYLFLGAGEAGTGIAELIALEMSKQTEIPINDCRKKVWLVDSRGLIVESRKESLQHFKQPFAHEHEPVKTLLEAVQSIKPTVLIGTSGVGKTFTQEVVEAMAAFNEKPVIFALSNPTSHSECTAEEAYTWTKGSAVFASGSPFDAVEYEGKTYVPGQSNNAYIFPGFGLGVVISGAIRVHDDMLLAASEALAEQVSEDNFARGLIFPPFTNIRKISAHIAAKVAAKAYELGLASRLPRPDDLVKYAESCMYTPAYRCYR

SEQ ID NO: 38472 - protein, 128 aa, Zea mays
YLLFRLAGFRWDRQWVVVNGKGRAYTQRVEPKLALVQVELPPEAFAEDWQPTPYDHLVIRAPGMDTLKIPLAAEHTTIDDVSVWEWSGSAYDEGAEVSEWFSTYFGKPSRLVRFKEASETRPTDPYYG

SEQ ID NO: 38473 - protein, 402 aa, Oryza sativa Japonica Group
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 38474 - protein, 416 aa, Mycoplasma genitalium
MLSSNMLNFKTLQAIDFQNKTVVLRSDFNVPMINGVISDSERILAGLDTIKFLVKKNCKIVLLSHLSRIKSLEDKLNNKKSLKPVAELLQQLLPTVKVQFSCKNTGAEVKQKVQALAFGEILLLENTRYCDVNDKGEIVKLESKNDPELAKFWASLGEIFVNDAFGTAHRKHASNAGIAKYVAKSCIGFLMEKELKNLSYLIQSPQKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSYMSLDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQKNS

SEQ ID NO: 38475 - protein, 219 aa, Novosphingobium aromaticivorans DSM 12444
MTPLISPSILSADFARLGEEVRAIDAAGADWIHVDVMDGHFVPNITIGPMVVKALRPHTTKPFDVHLMISPVDGYLQAFADAGADIITVHPEAGPHIHRTVQAIKALGKKAGVSLNPGTPAKMLDYLIDDVDLVLVMSVNPGFGGQSFISSQLRKIEAVRKMIDKSGRDIHLEVDGGVDTRTIRSCVDAGADVLVAGTATFKGGPSQYAANIAALKGLG

SEQ ID NO: 38476 - protein, 338 aa, Zea mays
  misc_feature (35)..(35): Xaa can be any naturally occurring amino acid
  misc_feature (57)..(57): Xaa can be any naturally occurring amino acid
MGKIKIGINGFGRIGRLVARVALQSEDVELVAVNXDPFITTDYMTYMFKYDTVHGQXKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 38477 - protein, 369 aa, Rhodococcus sp. RHA1
MAGWPTKLEGSTIPVTSTAAPGDYLAYTVREPVGVVAAIVAWNFPLLLAAWKLSPALAAGNTVILKPAEQTPLSAALLGDVLREAGIPDGVVNIVQGDGENVGAALSAHPGVDKVSFTGSTEVGRHIVGAARGNLKKVTLELGGKSPNIVFDDADIDAAIEGAAMAIFFNQGEACEAGSRLFIQSTVYDQVVEGVAKIASTLKVGDSLDPDTQMGPVVSEKQLDTVLGYLDSGRAEGATAVTGGGRKGDIGYFVEPTVLVDTTPNMRVVKEEIFGPVVTAIPFDDIDDIVRTANDTEYGLAAGIWTSDVSKAHNVAARIKAGTVWINSYHVLDPALPFGGYKQSGWGREHGAAVFDAYTETKTVILKKG

SEQ ID NO: 38478 - protein, 448 aa, Ostreococcus tauri
MRVARARARATNAVADARRDHARARARAPRTRARAVDQSLNPRVEALRPSKTVALTDLARQLRADGKDVIGLAAGEPDFATPRAASEAGKRAIDAGKTKYSANAGDAELRKAVREKLRRENGLTYDWASEIVLSNGAKQSVAQCVLATCGPGDEVIVPTPYWVSYPEMVTLSGAECVVAETTADEGFLLTPEKLRACITEKSRLLILCSPSNPSGAVYPRETLEALAKIVVEHPRLLVLSDEIYEHIVYAPASHHSIAACDDMWERTLVVNGFSKSFAMTGWRLGYVAAPKHFARAMSMLQSQITSGPNSISQEAALAALQQLGPRGGDAVAEMVRAFERRRDFVSARLCAIDGVKLPRVDGAFYVFPDVSALVGDGASAEGFGPIADVDELCRYLLEKGLVAVVPGSAFGVPNCLRVSYAAADSVLDEALSRIERCLDPSVYTRPSK

SEQ ID NO: 38479 - protein, 324 aa, Myxococcus xanthus DK 1622
MRVLVTGAAGFIAHHVSARLLARGDAVIGVDNLDPSGDVALKQARLTRLGTLPGATGFTFRPVDVTDSPSLRALFEEMRPEAVVHLAARVGVRAPAGTAQAYVDANVSGFLQVLEQASAARVRHLVYASSSSVYGAGSVPPFQEGAAADHPLSVYAATKRADELLAHAYSHLHGLPTSGLRFFTVYGPWGRPDMAPLRFLQAIRDGTELSLHGEGRMQRDFTYVEDVAEAVVRVLDRPLPGAPRHRVLNVGRGEPVSVRAFLSVLERILGARARVKSTPAQPGEMDATWADPSALERETGFRPRVSVEEGLTRLVAWFHEQSGT

SEQ ID NO: 38480 - protein, 623 aa, Manihot esculenta
MEAVLQTKGLFSLPPNPKTRASLYPSQGLKHRLFAAKPKTLSGLSLSSNGFPKFPSVVSKPNGFPPKDGNLHICRAEAAAAAEGQPLFGEPEKPKLLGIELSTLKKIIPLGLMFFCILFNYTILRDTKDVLVVTAKGSSAEIIPFLKTWVNLPMAIGFMLLYTQLANVLSKQALFYTVIVPFIAFFGAFGFLLYPLSNHIHPEAFADKLLNILGPRFLGPIAIMRIWSFCLFYVMAELWGSVVISVLFWGFANQITTVDEAKRFYPLFGLGANVALVFSGRTVKYFSNLRKNLGPGVDGWAISLKGMMSIVVLMGLAICFLYWWVNNFVPLPTRSKKKKEKPKMGTMESLKFLVSSKYIRDLATLVVAYGISINLVEVTWKSKLKAQFPSPNEYSSFMGDFSTATGIATFTMMLLSQYIFDKYGWGVAAKITPTVLLLTGVGFFSLILFGGPLAPVLSQFGMTPLLAAVYVGAMQNIFSKSAKYSLFDPCKEMAYIPLDEETKVKGKAAIDVVCNPLGKSGGALIQQFMILTFGSLANSTPYLGGTLLVIVLLWLAAARSLDTQFTALRREEELEKEMERAAVKIPVVSPEESGNGSLPGGSSLNPAAGDSTSSSSETTPRKL

SEQ ID NO: 38481 - protein, 623 aa, Manihot esculenta
MEAVLQTKGLFSLPPNPKTRASLYPSQGLRHRLFAAKPKTLSGLSLSSNGFPKFPSFVSKPNGFPPKDGNLHICRAEAAAAAEGQPLFGEPEKPKLLGIELSTLKKIIPLGLMFFCILFNYTILRDTKDVLVVTAKGSSAEIIPFLKTWVNLPMAIGFMLLYTQLANVLSKQALFYTVIVPFIAFFGAFGFLLYPLSNHIHPEAFADKLLNILGPRFLGPIAIMRIWSFCLFYVMAELWGSVVISVLFWGFANQITTVDEAKRFYPLFGLGANVALVFSGRTVKYFSNLRKNLGPGVDGWAISLKGMMSIVVLMGLAICFLYWWVNNFVPLPTRSKKKKEKPKMGTMESLKFLVSSKYIRDLATLVVAYGISINLVEVTWKSKLKAQFPSPNEYSSFMGDFSTATGIATFTMMLLSQYIFDKYGWGVAAKITPTVLLLTGVGFFSLILFGGPLAPVLSQFGMTPLLAAVYVGAMQNIFSKSAKYSLFDPCKEMAYIPLDEETKVKGKAAIDVVCNPLGKSGGALIQQFMILTFGSLANSTPYLGGTLLVIVLLWLAAARSLDTQSTALRREEELEKEMERAAVKIPVVSPEESGNGSLPGGSSLNPAAGDSTSSSSETAPRKL

SEQ ID NO: 38482 - protein, 311 aa, Zea mays
IGYLEAGRDSSLSSTRLFDDVSALFHDLDNGMQPISVLFPYLPIPAHKRRDRARARLAEIFATIIKSRKASGQSEEDMLQCFIDSKYKNGRSTSEGEVTGLLIAALFAGQHTSSITSTWTGAYMLRFKQYFAEAVEEQKDVMKRHGDKIDHDILAEMDVLYRCIKEALRLHPPLIMLLRQSHSDFTVTTKEGKVYDIPKGHIVATSPSFANRLPHIYKNPDSYDPDRFGPGREEDKAAGAFSFISFGGGRHGCLGEPFAYLQIKAIWTHLLRNFEFELVSPFPENDWNAMVVGIKGEGMVNYKRRKLVVDN

SEQ ID NO: 38483 - protein, 484 aa, Bacteroides thetaiotaomicron VPI-5482
MNNTTNEGSKLYLYSITSVAILGGLLFGYDTAVISGAEKGLEAFFLSASDFQYNKVMHGITSSSALIGCVLGGALSGVFASRLGRRNSLRLAAVLFFLSALGSYYPEVLFFEYGKPNMDLLIAFNLYRVLGGIGVGLASAVCPMYIAEIAPSNIRGTLVSCNQFAIIFGMLVVYFVNYLIMGDHQNPIILKDAAGVLSVSAESDMWTVQEGWRYMFGSEAFPAAFFGLLLFFVPKTPRYLVLVQQEEKAYTILEKINGKKKAQEILNDIKATAQEKTEKLFTYGVTVIVIGILLSVFQQAIGINAVLYYAPRIFENAGAEGGGMMQTVIMGIVNIIFTLVAIFTVDRFGRKPLLIIGSIGMAVGAFAVAMCDSMAIKGVLPVLSIIVYAAFFMMSWGPICWVLISEIFPNTIRGKAVAIAVAFQWIFNYIVSSTFPALYDFSPMFAYSLYGIICVAAAIFVWRWVPETKGKTLEDMSKLWKKNK

SEQ ID NO: 38484 - protein, 811 aa, Chlamydomonas reinhardtii
MTEQASQEQEALLEDAIALLDSLLVEIGATGGEGEPEQQHHRSNATAAHGDPQGDTALALPPAAASAGVAGDRQFVNAAPAACSAVRAGSGYLLHQPYGGAALSSSPSAAPAHVGLSALSSPAHCSQPQAHNPHQPHQLKVLSQLQQGDGHSTAAALQQGVSQQPHTPPHLAAPTRREPLSHALTEPAPGAAPDHHHHHNEQHHNLNHSNSSAAALTSGTGTGGGGAGVPAGGGAAVPSSAAPATAAPFAPTSITASTIANRGPRWHGALRAGNKSRVEKARLATQDPFWDEFFVFDVAQPAFAVLKIKVYDHRHCWRPAFVGQVRIPVHSIAEFPARFAPPSWHTLRSRAGRGIRGQVQMQLFYTAEWVHRPLRVFAGTWNVGNAQPAADLSPWLQGVSSLQHDLVAIGVQDSNLDCSAYAAASAATTPRSPAPSWAPAWAADASFTTAVKSRGGGVLSDVTAKVGVVGGGEFREVWEERIKEAVGPGYFKVAGVHMGQIRLLLFARNDIYAAVSDGGVGVSLRVWDTTLAFINSHLAAHQDKTRARNAHYRDIVRGLKPLASDPGGVMDALTAPHHVVWMGDLNYRLDWGAQAHTPTESPAPGDFADLVREADQLRKEVGAKRAFLGFTEGPIAFEPSFKVRRRRGHDYNPQRSPAYCDRVLYRSNLPLKQIRCVSYFSPADVASSDHKPVAAELLLLLTAPCIYAGATDAAAWAPFQVQLELHGLPAGTLEGHMRIEPHQQAAAATGGLRGPAGPSRLGPAPSGQPLQQRGAGASARTPPGRDSHGNSNAVSAGLFARLRASLRLLQG

SEQ ID NO: 38485 - protein, 159 aa, Zea mays
  misc_feature (14)..(14): Xaa can be any naturally occurring amino acid
  misc_feature (143)..(143): Xaa can be any naturally occurring amino acid
MALTTIELAGLAAXGQEPCPHIAHKGLPISVHNRTTSKVDETVQRAKVERNLPDYGFHDPASIVKYIQKSREVIMLGKGEAPDDQTIATLAAHLKKGDCIIYGGNERYQNTDRRDKTWRSRGHLYLDMAVSGGQEGGRNRPSXLMPGGSLQAYKDAERH

SEQ ID NO: 38486 - protein, 175 aa, Burkholderia thailandensis E264
MSFSNVPAGKDLPQDFNVIIEIPAQSEPVKYEADKELGLLVVDRFIGTGMRYPVNYGFIPQTLSGDGDPVDVLVITPFPLLAGSVVRARALGMLKMTDESGVDAKLVAVPHDKVCPMTANIKSIDDVPAYLMDQIKHFFEQYKALEKGKWVKVEGWDGIEAAHKEITDGVANFKK

SEQ ID NO: 38487 - protein, 371 aa, Pavlova lutheri
  misc_feature (174)..(174): Xaa can be any naturally occurring amino acid
MRRSRVATPVQRVPQTACTVLMATKTGVKAFVVGVAADSGCGKSTFMRRLTNIFGGKSALLDIGRETNTLVSDKTTVICLDDYHLYDRKGRSANKITALHKDCQKWDLMAEQVAAIKAGNSVMKPIYNHITGELDAPEEIVPTDIVIFEGLHPMLDDKVRSMLDLSIYLDISGXVKFAWKIQRDMQERGHSLESIKASIEGRKPDFDAFVAPQRANADIVIEVLPTQLVNDAEGKFLRVRFIQKAGLDLIKAPFLFDEGSTIEWTPCGKKLTCAYPGIKFRYGTEMYMGSEVTVLEMDGRFDKLDELIYVESALTNTGAKFYGELTQQILKNKDAVGSDNGTGFFQTLCSFKIREAYEKATGKTVDASAAA

SEQ ID NO: 38488 - protein, 383 aa, Guillardia theta
MGTPLASRSSFASPVALRVTNDKEMDVAIQQISMSLASGQKPVVIGLAADSGCGKSTFMRRVTACFGGACKLNPIGRETNTLISDMTTVICLDDYHLNDRQGRKKTGLTALDPRENNFDLMYEQVKALKEGKKVMKPIYNHVNGTLDEAEEITPTPIIIFEGLHPFYDKRVEELMDFKIYVDITPEVKFNWKVQRDHEERGHSIESIKQQIEARKPDFDAYIDPQKNKADCVIQVLPTNLVANDKTHLNVKLIQCKGVDHYAPTYLWDEGSDIEWVPPRNKLASSAPGAGLKIYQKTEKWAGKDAAVIGMDGKYDKIDEMMYVEKQFASTGSKFVGEITKKMLEYEGQPGSNDGTGFLQTITALKVREVYEGIAKVKVPAQAN

SEQ ID NO: 38489 - protein, 411 aa, Lingulodinium polyedrum
MARSRSVVLPLAAAAVALVLLGHVAFVPPAPRPRAARALTAMRGAANSVPTGLVWPSPEAEAKLREEDGIKMYPTHAWTDDMMPIVPATKEGVSPVVIGVAADSGCGKSTFLRRILGALGTEVTPGHTAIGDMMTVICLDDYHTNDRAGRKATGLTALDAKENDFALMGVQIEALKQGKAVYKPIYNHDTGNKDPPELIEPNKVMVFEGLHPIYDKKARDQLDLGIYIDIVNDVKFAWKVQRDVAERGWTEEQVREDIEKRLPDFSAYVDPQKADADVILRYEPSDQGLPYLKVKLIQKKGGAFPPISLKKDLTLTGSKPGATLKMYDDDWFGNAVTVVEMDGEIDMDNMEAQLKEIEDNLEGLPSKTPGELTEAMVKLKSSPGSQNGTGMLQTVIAMKFREVYEKLTGGK

SEQ ID NO: 38490 - protein, 240 aa, Glycine max
  misc_feature (40)..(40): Xaa can be any naturally occurring amino acid
PKHTPRRTFCSINSNSKGSSSIVPDLLHYLNHSWTQFHAXAEAKRQLLAAGFHMLDENHDWHLKPGGRYFFTRNMSCLVAFAIGDKYNVGDGFHVIAAHTDSPCLKLKPKTASCKCNYSMVNVQTYGAGLWYTWFDRDLSVAGRVILRSSHNSYVHKLVKINRPILRIPTLAIHLDRTVNQDGFKPNLETHLHPLLSMKPDDTSLESNSKEKNSALSSKAHHHRLLMQVAVLSILHSSSM

SEQ ID NO: 38491 - protein, 374 aa, Bacillus sp. SG-1
MSKRDYYEVLGVEQGASKDEIKKAYRKLSKKYHPDINKEADANEKFKEISEAYEVLSDDQKRAQYDRFGHTDPNQGFGGGGDFGGGFGGFEDIFNTFFGGGGGRRRDPNAPRAGADLQYTMSVTFEEAVFGKETDIEIPKEEECDTCDGSGAKPGTKPETCKHCQGSGQLNVEQNTPFGRIVNRRVCHHCHGTGKFIKEKCNTCGGNGKVQKRRKIHVKIPAGIDEGQQLRVTGQGEPGVNGGPPGDLYVVFHVRPHEFFERDGDDIYCEMPITFVQSALGDEIEVPTMHGKVKLKVPAGTQTGTKFRLRGKGVPNVRGYGTGDQHIHVKVVTPTKLTERQKELLREFGDITGQVTDEQHESFFGKVKRAFKGE

SEQ ID NO: 38492 - protein, 197 aa, Zea mays
MGKKVAVVVGGSVAGLACAHAVAGAGWEVVVLEKAAAPAAGSGTGAGLGLDAQSMEIISRWIPGWGIDAVTLPLAVDLVSFPVLSGSPALALRLQNIATDSATKAARTLARDEDFKFRAAHWGDLHRRLHEELPPAVTVLWGHQFLSFEAPDDTRGVVATARVLRTGGTVEATGDLLIAADGSTSSVRRSFLPDLKL

SEQ ID NO: 38493 - protein, 474 aa, Ralstonia eutropha JMP134
MSKQFDVLVIGAGPGGYIAAIRAGQLGLNVACCEGNAYDDPKNEPRLGGTCLNVGCIPSKALLASSEEFENAQHHLADHGITVGDVKVDVSKMLKRKDDIVGKMTKGIEFLFRKNKVTLLKGYGKFVGKTAEGFQVEVAGEVVTAKQVIIATGSKARHLPGITVDNDLVSDNEGALKFPAVPKKLGVIGAGVIGLELGSVWRRLGAEVTVLEALPAFLGAADEGVAKEAQKQLTKQGLKFSLGVKVDEVTTGKSGVTVKYTDKDGAAQTLEVDRLIVSVGRVPNTDNLGLEAVGLAADQRGFIEVDDHCATKVPGLWAIGDVVRGPMLAHKAEDEGVAVAERIAGQKPHIDYNCIPWVIYTFPEIAWVGKTEAQLKAEGREFKAGQFPFMANGRALGMGHPEGFVKMLADAKTDEILGVHIVAANASDLIAEAVVAMEFKAASEDIGRVCHPHPSMSEVMREAALAVDKRQLNM

SEQ ID NO: 38494 - protein, 419 aa, Ralstonia eutropha JMP134
MAIVDVKVPQLSESVAEATMLNWKKKPGEAVAQDEILIEIETDKVVLEVPAPSAGVLSQIIKNDGDTVVADELIAKIDTEATAGAAAPAAAAPAPAAAAPAAAAAAAPAAAGAVAMPSAAKLMAEAGLSAGQVAGTGKDGRITKGDVLGASAAPAPAPAAKAAPAPAAAKPALPQVAANVDFAALGDRPEERVPMSRLRARIAERLVQSQSTNAILTTFNEVNMKPVMDLRNKYKDRFEKEHGVKLGFMSFFVKAAVHALKKYPVINASVDGNDIVYHGYFDIGIAVGSPRGLVVPILRNADQMSLADIEKKIAEFGAKARDGKLSLEELTGGTFSISNGGTFGSMLSTPIINPPQSAILGVHATKDRAVVEDGQIVIRPMNYLAMSYDHRIIDGREAVLGLVAMKEALEDPARLLLDL

SEQ ID NO: 38495 - protein, 274 aa, Leptospira interrogans serovar Lai str. 56601
MKSILQWECSKAIFMKLRMLQIDSFAEKVFQGNPAAVCPLQEWISDEWMQKIASENNLSETAFFVLEGESYRIRWFTPLREVDLCGHATLAAAYHLFREGEVIGDKLNFQSLSGELNVFKKENILYLDFPSRKPEKVETPKEILNSFSISPKEVFKSRDYMLLYENENQLKKLEYSVEGVRELNTLGIIATCVGNDSYDFLSRFFAPSVGLYEDPVTGSAHCTLIPFWSERLGKKIMKAYQTSARGGKLFCEDLGERVRIGGTCVPYLDGWIEI

SEQ ID NO: 38496 - protein, 147 aa, Campylobacter upsaliensis RM3195
MEKYNREEFEEVIVDIGRVTKVVKGGRRFRFTALVIVGNRKGLVGVGYGKAKEVPDAIRKAVDDAFKNMVEVKTKGSTIAHDVEVKYNASRILLKPASEGTGVIAGGSTRPIVELAGIKDILTKSLGSNNSANVVRATIKALTMLKG

SEQ ID NO: 38497 - protein, 117 aa, Pelargonium zonale
MAAKKLCIVIFPLVIMFLLLQDNFATSSSITEAPSPQPHSQSNHTMYGITEGSLQPQECGPRCSERCSNTQYKKPCLFFCNKCCAKCLCVPPGTYGNKQFCPCYNNWKTKRGGPKCP

SEQ ID NO: 38498 - protein, 548 aa, Mycobacterium tuberculosis H37Rv
MTSVTDRSAHSAERSTEHTIDIHTTAGKLAELHKRREESLHPVGEDAVEKVHAKGKLTARERIYALLDEDSFVELDALAKHRSTNFNLGEKRPLGDGVVTGYGTIDGRDVCIFSQDATVFGGSLGEVYGEKIVKVQELAIKTGRPLIGINDGAGARIQEGVVSLGLYSRIFRNNILASGVIPQISLIMGAAAGGHVYSPALTDFVIMVDQTSQMFITGPDVIKTVTGEEVTMEELGGAHTHMAKSGTAHYAASGEQDAFDYVRELLSYLPPNNSTDAPRYQAAAPTGPIEENLTDEDLELDTLIPDSPNQPYDMHEVITRLLDDEFLEIQAGYAQNIVVGFGRIDGRPVGIVANQPTHFAGCLDINASEKAARFVRTCDCFNIPIVMLVDVPGFLPGTDQEYNGIIRRGAKLLYAYGEATVPKITVITRKAYGGAYCVMGSKDMGCDVNLAWPTAQIAVMGASGAVGFVYRQQLAEAAANGEDIDKLRLRLQQEYEDTLVNPYVAAERGYVDAVIPPSHTRGYIGTALRLLERKIAQLPPKKHGNVPL

SEQ ID NO: 38499 - protein, 440 aa, Oceanobacillus iheyensis HTE831
MIEMDVAVIGTGYVGLVTGACLAEKGHRVHCIDIDESRVQQLNNAISPIYEEGIEELLKNGINNDNLFFTTDYKEGLHQKDIVFLAVGTPESEDGSADLSYLYKASETMASYVDRDVTVVIKSTVPVGTGEQIGDKLNSLVSPGVNIRMASNPEFLRQGTAVYDTFHADRIVVGANHPDAQKQLEELYHSFQLPIVVTDIRSAEMIKYTANSFLAMKISFINEVANLSEKLGANIESVTEGIGMDKRIGSSFLNAGIGFGGSCFPKDTKAMVQIAESVNMPLSLIEKVISVNEKQREILVDKVKSRFTSLKGLEVAILGLSFKPNTDDMREAASISIIRKLVDDGVKVTAYDPVAMERAKQILPEQVNYTNSIEEAIKGKQATLIVTEWDQIKDFPLDKYVELMTSPVIMDGRNCFDMKEVQKHKIEYHSIGRKTINNLS

SEQ ID NO: 38500 - protein, 294 aa, Oceanobacillus iheyensis HTE831
MSVKKAIIPAAGLGTRFLPATKAQPKEMLPIVDKPTIQYIVEEAVHSGIEDIIIISGRGKRAIEDHFDKSYELEEKLTEKEDYDMLQEIQQISGLANIHYIRQKEPKGLGHAIHCAHTFIGNEPFAVLLGDDIVVSDEPCLKQLINVFEENHQKSVIGVHDVPWEDVSKYGIVKPSKGLDDSSSIHFIEDLIEKPDRDKAPSNLAIMGRYVLTPEVFPILEKLPPGKDNEIQLTDALIELKKVEEMIAYNFQGKRYDVGNKLGFIEATIDFALNRNDLHNDVKHLLKKKLDSME

SEQ ID NO: 38501 - protein, 437 aa, Oceanobacillus iheyensis HTE831
MSLFEKIQNKTEKIAVIGLGYVGLPLAVELAKKYDVIGLDLNKEKLAQYSNGIDVTAEVGNEALKQTTLEFTSDETRLKECKFHIVAVPTPINTDKTPNLKPVIGASESVGRNISKGSIVVYESTVYPGTTEEICIPILEEKSGLKFGQDFKVGYSPERINPGDKVNTLVSITKVVSGSDEDALKEISSLYGSIIEAGVFEAESIKVAEAAKVIENSQRDINIAFMNELSMVFNKMDIDTKAVLEAAGTKWNFLNFTPGLVGGHCIGVDPYYFTYKAEQLGYHSQIILSGRKINDDMGKYIAGNIIKKMIKSKIEIDGARVAILGLTFKENVGDVRNTKVNDIVTELEEYGVNVIVHDPVAEGQEVKKVFGIELAEEDDLQDLDAVVLAVPHQHYKELNVNKINTMYRQDNKKVFIDIKGSLDKNDFYQAGYSYWSL

SEQ ID NO: 38502 - protein, 484 aa, Oceanobacillus iheyensis HTE831
MEKRTTLKKTLKPHWVWAIALGSSIGWGAFVQPAAWMGTAGPLGAMIGFGIGGLLMMLIAVSYGFLIKSFPVSGGEFAYAFISLGRTHAFISGWFLTLGYICIVALNASALALMFKFVFPSVLENFYMYQIADWDVYGMEIIIASIALIIFGYLNIRGGGFTGSAQFIFCIIMVGGVLLLTTLVGINPSADISNVAPLFPSDKTAIAAILSIVAIAPWAFVGFDNIPQAAEEFNFSSKKAFRLIILAILFATILYCLMIFATAMAQPWEGLVAAGHNWGTAEALQDILGTVGVAILAIALLMGIFTGLNGFIISTSRLLFAMSRAKFIPRSFSKLGKNETPYISIIFTVIVAMVAPWFGRQALTWVVDMSSVGVTIAYFYTCYTAFSLFKWNDNHGFNTNKHVVAPGKKIFALLGMVASISFLGLLLIPGSPAFLGLESRIALVVWIVLGIIFYIMKYKDYKNLDKEEMNYLILGSKEIKVKKD

SEQ ID NO: 38503 - protein, 359 aa, Vanilla planifolia
MGSIPKNQEEVDVCNYAQKLVSCVVLPMTLNAAIQLGLFEEIVAAGPGARLSAEELASRIGSTNPLAPALLHRILRLLASYSIVTSSEAADNDGRGTTIRYGAAPVCKYLTRNEDGVSLASISQLTNHKIAMESWYHVKDAVLHGGVPFNMAHGGLNEFEYHATDPSFSKVFNEAMRGHSVFIMRNILKVYRGFDEAKVMVDVCGGTGGTLGMITAKHPHIKGINFDLPHVIAQAPPLPGVEHVGGDVFASVPSGDTVLLKWVLHDWNDEDCVRILKNCKKAIPETGKVVVVESVVPESLESSDLAHFILHSDLVMLLESPCGKERTKKDFRSLAQQSGFSGFAVLCSFSSSWVMEFTN

SEQ ID NO: 38504 - protein, 359 aa, Vanilla planifolia
MGSIPNNHAEVDVCNYALKLVSSAVLPMTLNSAIQLGLLEEIVAAGPGARLSAEELASRIGSTNPLAPALLDRILRLLASYSIVTSYEAADTDGRGTTTRYGAAPVCKYLTRNEDGVSLASLSQLTNHKIAMESWYHVKDAVLHGGVPFNMAHGGLNEFEYHATDPSFSKVFNEAMRGHSVVIMRNILKVYRGLDEAKVMVDVCGGTGGTLGMITAKHPHIKGINFDLPHVIAQAPPLPGVEHVGGDVFASVPTGDTVLLKWVLHDWNDEDCVRILKNCKKAIPETGKVVVVESVVPESLESSDLAHFILHSDLVMLLESPFGKERTKKDFRSLAQQSGFSGFAVLCSFSSAWVMEFTN

SEQ ID NO: 38505 - protein, 499 aa, Aspergillus shirousami
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDVDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 38506 - protein, 513 aa, Oryza sativa Indica Group
MAAGVALHLHLQGMKVKAIRVHKIGGPEVLTWEEVEIGEPSEGEIRIKNKAIGVNYVDIYYRTGLHQEPLPFVPDLVYGDSDNKIPTYFVKSNVSSWPGENSWLPSELIEYTGKQAVGVVSAVGPGVTGIEVGDVVGYADTPMGTYTEEQIIPATLAIPIPPSVDHITAASVLLKGMTTYVLVKQAFKIQAGHTVLVHAAAGGVGSLLCQWANALGATVIGTVSTQEKAIQAAEDGCHHVIIYTEEDFVAQVAEITSRKGVHVVYDAVGKDTFKGSMECLMPRGCMISYGQCSGRPDPVPVSDLASKSLILGRPGMRHYTATRDELLHAAGEVFAGVAAGVLRVRVNHVYPLHEAARAHADLEARRTSGSVWYQSPRFGTRNNFHGSHGGEARPNVTWVAYGWWAGLRTPTSGRLTFITSGENNFHESHGNKVVLEPKVWIPEQFSWVTWWTGQAQDLKVVAPVEPMVEQTQCDLGGPWLVGQAAHSNRCSCVNFVKRKKRTLLFSDAKCDLE

SEQ ID NO: 38507 - protein, 230 aa, Oryza sativa
  misc_feature (17)..(17): Xaa can be any naturally occurring amino acid
  misc_feature (48)..(48): Xaa can be any naturally occurring amino acid
  misc_feature (155)..(155): Xaa can be any naturally occurring amino acid
  misc_feature (210)..(210): Xaa can be any naturally occurring amino acid
KTPFSIRESTGSEPPIXSRLRRRPTGVQNPNPNPSEEEGVGGGGRRGXEMVYYALYWWADLDNLTNLQPRYGCDDPTYPYYFKLRCENCGEVSAKATCVSLGEVVDLPNGRSTANLVQKCKLCGRDASIVMIPGLGTPLTIEQSQKGDRTCLMVXDCRGCEPIDFAFGNGWKAESLEGTPFDIDCSEGEFADYDEKGECPVGLGKLRSEXRVGKKQESRGRLNMAKSRGV

SEQ ID NO: 38508 - protein, 392 aa, Vibrio cholerae O1 biovar eltor str. N16961
MRGQIMSVIKMIDLDLAGKRVFIRADLNVPVKDGKVTSDARILASLPTIKHCLEAGAKVMVTSHLGRPTEGEYAEEFSLLPVVNYLNDALDCEVRLVKDYLDGVELNAGELVVLENVRFNKGEKKNEEALSKKYAALCDVFVMDAFGTAHRAQASTHGVGMFAPIACAGPLLADELEALGKAMDKPARPMVAIVGGSKVSTKLTVLESLSKIADQLVVGGGIANTFIAAAGHNVGKSLYEADLVETAKKLMEECAIPVATDVACAKAFDENAEAEIKHVSEVQDDDMIFDLGPNSTAELAEILKNAKTILWNGPVGVFEFKNFEAGTRGIAEAIAQSEGFSVAGGGDTLAAIDKFGIKADVSYISTGGGAFLEFVEGKKLPAVEMLEARAKA

SEQ ID NO: 38509 - protein, 170 aa, Nostoc punctiforme PCC 73102
MDLSRIPAQPKPGLINVLIEITGGSKNKYEYDKELEAFALDRVLYSSVKYPYDYGFVPNTLADDGDPLDGMVIIDEPTFPGCIIAARPIGFLEMIDGGDRDEKILCVPDKDPRYTQVKSLKDVAPHRLDEIAEFFRSYKNLEKKVTEILGWQDVDKVAALVEKSVKAYRG

SEQ ID NO: 38510 - protein, 1530 aa, Schizosaccharomyces pombe
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGEHDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEAPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAPDAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYGYVESVIKLLEMESYAEAIIGTPGSGLNVEQRKRATIGVELAAKPALLLFLDEPTSGLDSQSAWSIVCFLRKLADAGQAILCTIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 38511 - protein, 180 aa, Nostoc punctiforme PCC 73102
MTIPNWITFSRLLGIPFLLYGLYNPTPEAQWICLAIFLVAALTDWLDGYLARKLNQISELGKFLDPLVDKLLVLAPLLVFIELGKVPAWGVFLILARELAIAGWRVNQTTITGANIWGKLKTVSQIVAIALLIAPLGEVWRTPSLLAFWISVALTLISGGIYLVPQNPAKENPRLDTKRT

SEQ ID NO: 38512 - protein, 482 aa, Arabidopsis thaliana
MKEPLQKKKVVVRHLPPSLSQSDLLSQIDPRFADRYNWVSFRPGKSSYKNQKYSRAYVSFKAPEDVYEFAAFFNGHVFVNEKGAQFKAIVEYAPSQRVPKPSDKKDPREGSISKDPDYLEFLKVIAQPVENLPSAEIQLERREAEQSGASKAAPIVTPLMEFIRQKRATVMGPQGLSDIRRGGRRTRVVSANKPSPRPSKRNSEKKKYVEKESSKNVPRKTTADVSSSKPDYRQSNSSGKELPGNETAAIIDSSPPGIALTMDSGKKKILLLRSKDRDNPDNPPPQPEQHIDTNLSRNSTDSRQNQKSDVGGRLIKGILLRNDSRPSQSSTFVQSEQRVEPSEAENYKRPSRPANTRAGKDYHTSGTISEKQERRTRNKDRPDRVMWAPRRDGSEDQPLSSAGNNGEVKDRMFSQRSGEVVNSSGGHTLENGSARHSSRRVGGRNRKEEVVIGEGKTSRRGSGGGPSSHEKQMWIQKPSSGT

SEQ ID NO: 38513 - protein, 384 aa, Burkholderia thailandensis E264
MQSAAAPRSKLPDVGTTIFTVIGQLAAEHQALNLSQGAPSFAPDPALVERAARAMRDGHNQYAPMAGVAALRDALAVKTERLYGGRYDPDSEVTVVASASEGLYAAISALVHPGDEVIYFEPSFDSYAPIVRLQGATPVAIKLSPDGFRVNWDEVAAKITPRTRMLIVNTPHNPSATILGDADIAHLARLTAGTDIVVLSDEVYEHVVFDGARHHSMARHRALAERSVIVSSFGKSYHVTGWRVGYCLAPAELTRELRKVHQFMTFAADTPMQHAFAEALAEPASYLELGAFYERKRDLLASELAGSRFELQRSEGSFFMLARFRHFSDESDADFVLRAIRDARVATIPLSAFYADGTNTGCIRLSFSKDDATLIEGARRLRSL

SEQ ID NO: 38514 - protein, 357 aa, Geobacter metallireducens GS-15
MYVVILAGGSGTRFWPLSRKLHPKQLMSVFGGKSMLQRTAERVLPLNPKRILVITNHLQAEETRRQLEYLRGVRIEVIEEPLGRNTAPAICLAATLIARHDPEAVMAVLPADHFIRDEDAFCATIQKGREAALNGYLVTLGITPDRPETGYGYIEAETSLRGDGPYPVKRFVEKPDRERALEFLAAGTFFWNSGMFLWRADVILGQMAAHMPELAQAFAGITFSPDIWEPADLAPQIEAVYAMVKGESIDYGVMEKADSVAMIPASFGWSDVGSWSALPEVMEPDAAGNVVIGAPETVIADAAGCILRGEKLMALVGVRDLVVVDTPDALLVCAKDRAQDVKKVVEELERRGLRRCL

SEQ ID NO: 38515 - protein, 377 aa, Chondrus crispus
MVNVSTDTWVKAPGADKSSHHANAKIASNVSEVLAKKGIERPVIIGVAADSGCGKSTFLRRVTGIFGTEVSKTHTPVGNFISVICLDDYHLHDRMGRREARVTALDEAANNFELMASQIQALREGKSIMKPIYNHETGEIDECELVEPNHIIVIEGLHPMYDTRVKKSLDFSVYLDLADEVKIAWKIQRDMAERGHSLENILASIESRKPDFAQFVDPQKRDCDVVMEILPTRLIPDDDEKKVLRVRLLQDENSENFDPIFLYDEGSTIDWVPCGRKLTCSYPGIKFHYGPDTYYDKEVAVFEVDGGFEKLDEMVYVETHIERAGTKFFGEITQSLLRNPTAPGSKNGTGLIQVIMAMMMRSVYEKVTGKPVAVSGN

SEQ ID NO: 38516 - protein, 427 aa, Nocardioides sp. JS614
MPRVLRMPEVAANATEAVLAEWLVSENAEFGALDTIATVETEKALVDVEAEDAGVVLKTLVPPGALVEVGAPIAVLGAPGEAVGDLGAVLAELGVAEPVDHVLPERRSLVEPVDPVVEPVEAPAPTQGSNHRVFASPLARRLARLAEIPVEEIAGTGPRGRILRRDVEAAVAARPATPVVEQRAPASVVETPAPTQGSASKVEPVDVPHSRLRRAVANRLAESKQTAPHFYLRATVRADRLVDLRAELNEGAETRVSLNDLVVKAVAAAHARVPEMNVVWTPDAVRSFSSVDVAVAVATDRGLVTPVLRDVTSLTVTAVAAKVQDLAARAREGRLKQDELEGGTISVTNLGMYGVEEFAAIINPPHAAILAVGAVREEPVVEDGAVVPGKVLTVTLSVDHRPVDGVVAARWLAAFVDLVEHPARILA

SEQ ID NO: 38517 - protein, 623 aa, Yarrowia lipolytica CLIB122
MEKCKQVFHEVFLSTAPVKHYPKKECNTNAKERGWTQKKIIIGWIFVYLYSSSKTIAQHLYPSLAPFATSHFSGLALLSSQSVVESAVFVVTRPAAAKIADHLGRLEGWCVVIIAHALGSILYAAAPNIGCYFAGTVFWEIGIVSGHLMMELYASDTSTTDTRVLWSSFIQTPSIWAPWISAPVLAGFLKVTTWRWGYGAFAIILPVCSIGTVIMMAYMRIRYERKAGGLGDFYSPGGPLRFIKSFDVVGLVTLCAGLILFFLPITLAAGSERWKLHSYIAMLTIGSFLIVFFTVWEYFPKAPFMPWRLFKSRVMCCSAALVFLMSLANKLYVPYFITWLMVVKGQSPKAATNVSSVLVVSSNVFGMFFAAPYMWWSGRPKRVLVFGCCFHLIGIGLTYHYRQPSSGLAIMIVAQCFEGVGRGCIYIPAATMAQAMFDKHKVAAVTALYFSSGGIGQVIGDAICGAIYRELYPRYIHKYAPDIPHKDLNLIINKIKKATKFPMGSLVRTEINHAFNETMRHMLVGPFACVGAMVIVSLMYPSIDLKSAARDGEVEGEDQMDEDDPMAIHGVPEGSGSESEHDQEEQFGEKDSREDTGSESEHANEKMSAERAAAGYINDNVMV

SEQ ID NO: 38518 - protein, 358 aa, Oryza sativa Indica Group
MSAYCGKYKDELIKNAAYIGTPGKGILAADESTGTIGKRFASINVENVEDNRRALRELLFCTPGALQYISGVILFDETLYQKTKDGKPFVDVLKEAGALPGIKVDKGTIEVAGTDKETTTQGHDDLGKQCAKYYEAGARFAKWRAVLKIGPNQPSQLAIDLNAQGLARYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 38519 - protein, 475 aa, Bifidobacterium longum DJO10A
MIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQAGLEFGSPVAAIGEAVFARALSSHGELREDAQKEGLAGPNKTIDLAGEDKAAFVEDVRKALFASKVVAYAQGLNEIQDGAKEYGWDINLSEVARIWRGGCIIRAQFLLDRITEAFRGDNPPASLLFDPYFEKIIGESQDAWRRVIVRAVEAGIPTPVFSSSLAYYDGLRSKRLPTALTQSQRDFFGAHTYGRVDKPGVFHTLWAEEGKPEIEA

SEQ ID NO: 38520 - protein, 123 aa, Burkholderia vietnamiensis G4
MSATWFNGSCHCGAVKFAVRTALEPAARCNCSLCRRRGALMSPMFAAADLKIVEGEDVLTLYRFNTHTARHYFCSRCGVYPFHQTRRDPACWRVNLGCLDGVDPYALPATVANGASLSVVEDA

SEQ ID NO: 38521 - protein, 471 aa, Ralstonia eutropha JMP134
MAQSVADVMKLVKENDVKFVDFRFTDTKGKEQHVSVPTSHFDDDKFESGHAFDGSSIAGWKGIEASDMLLMPDSNTAFIDPFYEEPTLVLTCDVVEPSDGKGYDRDPRSIAKRAEAYLKSTGLGDTAFFGPEPEFFIFDGVTWNVDMQGCFVKVHSEEAPWSSGKEFEHGNSGHRPGKKGGYFPVAPIDTFQDMRSEMCLILESLGIPVEVHHHEVAGQGQNEIGTRFSTLVQRADWTQLQKYVIQNVAHTYGKTATFMPKPIVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLMNPYLGFSALLMAGLDGVMNKIHPGEAADKNLYDLPPEEDAKIPTVCNSLDQSLEYLDNDREFLTRGGVFSNSMLDAYIELKMEEVTRFRMTTHPVEFEMYYSL

SEQ ID NO: 38522 - protein, 123 aa, Bacillus sp. SG-1
MKTFIIIGAVNAFLSVALGAFGAHALEGKISQKYIDIWNTGVLYQMFHSIGILIIGVLAGNIAASALLNWSGWLMLIGIVLFSGSLYVLSLTGIKVLGAITPLGGVSFLIAWVLLIITAAKSM

SEQ ID NO: 38523 - protein, 446 aa, Burkholderia vietnamiensis G4
MQASSTHEPLQLKRTLGLPSVLLFGLAYMAPLIVYGTYGVLAKASGDTAALAYLLALVAIAFTALSYGKLARLYPTAGSAYTYTRKTFNPHLGFMIGWATLLDYFFLPMVIWLIGAAYLNAAFPHVPTWIWIVAFIVLTSGLNIVGIELAARFNIVLMVVQLAIVAMFVVLCWHYASAAAGAGGIAMAEPFFKPHVPFGATMAGAAIAAYSYLGFDAVSTLTEETIDPKRNMPRAILLIALIGGAIFVIAAYAMQLAHPGVEFKDTDSAAFEVAKMIGGDLFVTVFLAGLILAQFASGISAQASVGRLLYAMGRDEILPKRIFGVIHPRFKTPAVNIALAGIVGLIALKLDVATSTSFINFGAFLAFTAVNLCVIRLYLSGRHGERRIGVFGGLVFPAIGAVADLWLLASLEKTAIVLGLVWFGLGLVYLCWITRLFRQAPPEVAI

SEQ ID NO: 38524 - protein, 485 aa, Marinobacter sp. ELB17
MSSNGFQIEHRYLELPESFFTRVQPSPLKEAKMVCFNQDLARELGFHSNNPAQWEKVGGGAELLEGMEPVAMKYTGHQFGMYNPDLGDGRGLLLWETISPNGQRWDWHLKGAGMTPYSRFGDGRAVLRSTIREYLCSEAMHGLGIATTRALFMVRAKDPIRRESIETAAALMRVAHSHIRFGHFEFAAHHQSPDTVKTLLEHVISLHFPELITLPETERHQRWLEAVVGRTARLIADWQTVGFCHGVMNSDNMSIIGDTFDYGPYAFMDDFDAGYICNHTDERGRYAYNRQPQMGFENCHYLARALLPVMGEDAVHEGLKHYESAYNTRFLQNMRNKLGLQQDDDSDMHLIMDTFSMLHEQKVDFTRFFRGLSTLYGRGHGPVRDLFTDRAIADAWLGRYEQRLEQETQAHDAREYAMGRVNPKYILRNYLAQQVILEAQNGDYQPLEELLTVLKKPFDEQTQYEERYAALPPDWGKGMSVSCSS

SEQ ID NO: 38525 - protein, 323 aa, Bacillus sp. SG-1
MSNLFETLKAKVTGKDLKIVFPEGQDERILQAASRLASDGILTPVIIGNAGNVEAKAQEVNVSLEGCEILDPADNEFMDELVQSFVDRRKGKATEEDAKKILLDENYFGTMLVYTGKAHGLVSGAAHSTADTVRPALQIIKTKEGIRKTSGVFIMVREGEKYVFADCAINIAPDSQDLAEIAIESAKTAEMFDIDPRVAMLSFSTKGSAKSPETEKVTEAVNIAKEKAPELTLDGEFQFDAAFVPSVASKKAPDSVLKGDANVFIFPSLEAGNIGYKIAQRLGNFEAVGPILQGLNAPVNDLSRGCNEEDVYKLALITAAQAL

SEQ ID NO: 38526 - protein, 491 aa, Oceanobacillus iheyensis HTE831
MEQTIQPRAVIVIFGATGDLAKRKLFPSIYRLYRSGKLDEHFAVIGLARRPWTDEVLRENVENSIQDALSPDEDLSEFISHFYYKSFDVTEKESYQGLNEIIQNLEGQYQTEGNRLFYLAMAPDFFGAIANQLNDYGLKNTSGWTRLVIEKPFGHDLPSAKKLNHELQAAFREDQIYRIDHYLGKEMVQNIEVIRFANGIFEHLWNNRFISNIQITSSETLGVEERARYYDTSGATRDMVQNHMLQMVALLAMEPPISLTTEEVRSEKIKVLRALRMMETNEIDDYFIRGQYGAGTVKGNSVIGYQDEDEQLENSRTETFVAGKLLIDNYRWAGVPFYIRTGKRMTEKSTKIVIEFKDIPMNLYYQKDDQRNPNLLVINIQPNEGITLCLNARKSGEGALAEPIQLAYHQNAVSGINTPEAYEKLIYDSMLGDATNFTHWDEVALSWQFVDKILENWSENQPAFPNYRSGSMGPEASDELLKKDGFHWWPI

SEQ ID NO: 38527 - protein, 361 aa, Streptococcus pneumoniae R6
MMDSPKKLGYHMPAEYEPHHGTLMIWPIRPGSWPFQGKAAKRAFTQIIETIAEGERVYLLVEQAYLSEAQSYLGDKVVYLDIPTNDAWARDTGPTILVNDKGKKLAVDWAFNAWGGTYDGLYQDYEEDDQVASRFAEALERPVYDAKPFVLEGGAIHSDGQGTILVTESCLLSPGRNPNLTKEEIENTLLESLGAEKVIWLPYGIYQDETNEHVDNVVAFVGPAEVVLAWTDDENDPQYAMSKADLELLEQETDAKGCHFTIHKLPIPAVRQVVTEEDLPGYIYEEGEEERYAGERLAASYVNFYIANKAVLVPQFEDVNDQVALDILSKCFPDRKVVGIPARDILLGGGNIHCITQQIPE

SEQ ID NO: 38528 - protein, 209 aa, Ostreococcus tauri
MTICAACGVDDDSHDRADARLLKKTHFRSGQIRVLRDVFHRVAKSDDKIDFKEFQLALYGDAGDEKSSDLFSERIFACFDARGDGTVSFEEFVVGLDVFHPDASVEDKTAFAFRVYDLRGVGAINREDVRKMLEAVLRQSRAMSLTKEMTESVLDKTFEDCDLNKNGTISLSEFQILVKKNDRIIANMTMENLASLTKRYPEFLFADYS

SEQ ID NO: 38529 - protein, 470 aa, Vibrio cholerae O1 biovar eltor str. N16961
MKKTKIVCTIGPKTESVEKLTELVNAGMNVMRLNFSHGDYVEHGTRITNFRKVMEVTGKQLAILLDTKGPEIRTIKLENGDDVDLVAGQEFTFTTDTKVVGNKERVAVTYSGFAKDLNVGNRILVDDGLIEMEVLATTDTEVKCKVLNNGALGENKGVNLPGVSVNLPALSEKDKNDLKFGCEQGVDFVAASFIRKGSDVKEIREVLASHGGQNIQIISKIENQEGLDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVKIMAQIAERTDPVLKAELGSRLDSPRLRITEAVCKGAVDTAEKLAAPLIIVATEAGKSARSVRKYFPTANIIAVTTNKKTAAQLVLSKGVTPVVVDAIDNTDAFYHLGKEIALQSGLGKKGDIVVMVSGALVASGTTNTASVHVL

SEQ ID NO: 38530 - protein, 522 aa, Synechococcus sp. WH 7803
MLGELWSFQGRYRTLHLTWFAFFLTFVVWFNLAPLATTVKADLGLTVGQIRTVAICNVALTIPARVLIGMLLDKFGPRLTYSTLLVFSVIPCLMFASAQDFNQLVVARLLLSIVGAGFVIGIRMVAEWFPPKEIGLAEGIYGGWGNFGSAFSALTLVGLAGWLSFSGGFTLPTGDVLNWRGAIALTGIISAVYGVIYYFNVSDTPPGKVYQRPERTAGLEVTSMRDFWGLLGMNVPFAAILCVLCWRLQKVGFLNASTYPLALLAVLVWFVFQTWGIIRTNRDLIMGTKVYPKEDRYEFKQVAILELTYIVNFGSELAVVSMLPTFFETTFDLPKATAGILASCFAFVNLVARPAGGLISDKLGSRKNTMGFLTAGLGVGYLIMSLIKPGTFTGTTGIVIAVLITMLASFFVQSGEGATFALVPLVKRRVTGQVAGLVGAYGNVGAVTYLTIFSLLPLWMGGAGEPTAETIAASNSAFFQILGIAGLIVAFFCFFFLKEPKGSFAELHEGETAAEGTPSMAR

SEQ ID NO: 38531 - protein, 172 aa, Zea mays
MDSTFIMIKTDGVQRCLIDEIISRFEKKGFYLKDLKLVNVERSLDDKHYNNLVSKSFFQGLECYIISEPEVCMVWEDKSVVTTVRKIIGATNPLTSETGTIRGDFAGDIGRNVIHGSDSIDSANKEIALCVPEGPGDCQSIQHPCIYYNQTCIASHHILTDRGSMSPLVLSQ

SEQ ID NO: 38532 - protein, 288 aa, Oryza sativa Indica Group
MACSHLAAAAAAASPAAARSPAASSAATASAFARLSAMPRVASGGLAVRGQRGVAAVVAAAAGAAAATPVADFEDRRATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVRYDEELGKALFNGLPNPFTAARYHSLVIEQETFPHDALEATAWTEDGLIMAARHKKYRHIQGVQFHPESIITPEGKRIILNFVRFIEELEKQRAGEKN

SEQ ID NO: 38533 - protein, 341 aa, Oryza sativa Indica Group
MGHVDASAAAAAARDAKKKRGNRSSAKLKQCKLDARREQWLSQDCSNSDPPAFWIGIVKDGKEAKASTSPTGTEPNAGSMTVPSPHPPLPRRRVDVRSKGGDPEEDREERGAARQELGSSYLDSPVHSPSSDNSGSVGGMHRKHYNNGGGLNLSSSSSVWSSSRSVSEAEDDDTGGPEEENGVLDDWEAVADADALTVDDCHSHQSSGHVAPPAAPNVCTAPANQTGRQDPIQRTKAWAPDDIFRPQSLPSISRQVSFPASIGNGWMGAAQQANLSTPLTCPICCEDLDLTDSSFCPCPCKFRLCLFCHNKILEADGRCPGCRKEYVAARLSRSCSMGPRY

SEQ ID NO: 38534 - protein, 253 aa, Pseudomonas putida GB-1
MSMTFSGQVALVTGAAAGIGRATALAFAREGLKVVVADLDPVGGEATVALIHAVGGEALFIACDVTRDSEVRQLHERLIAAYGRLDYAYNNAGIEIEQHRLAEGSEAEFDAIMGVNVKGVWLCMKYQLPLLLAQGGGVIVNTASVAGLGAAPKMSIYSASKHAVIGLTKSAAIEYAKKGVRVNAVCPAVIDTDMFRRAYEADPRKAEFAAAMHPVGRIGKVEEIASAVLYLCSDGAAFTTGHCLTVDGGATAI

SEQ ID NO: 38535 - protein, 132 aa, Triticum aestivum
  misc_feature (23)..(24): Xaa can be any naturally occurring amino acid
  misc_feature (43)..(43): Xaa can be any naturally occurring amino acid
  misc_feature (84)..(84): Xaa can be any naturally occurring amino acid
LVLDRERPLASPEEAEAEGGDPXXPGALGGPCLHVLAGVSEQXNNKRIVLALQSGLKSEILWGLNALTGLCFKEKDELARGYNXPLAKGPGRWDALLQGIDDWGERGGGRGHTEPPRVGTLGGSTAIAGLRP

SEQ ID NO: 38536 - protein, 983 aa, Bradyrhizobium sp. ORS278
MAKAVAKSKKVAAKSKPSKTGKAKAAPLAPPRKALKTAPKPAAKASAKAATKPAAKAPVKTAPKKPAKATAKPVAKAAAKPAPKSAATAIKPNKWVYTFGDGKAEGKAGLRDLLGGKGANLAEMANLGLPVPPGFTIPTSVCTYFYANDKTYPKELQSQVDKALDYIGKLTGKKFGDPENPLLVSVRSGARASMPGMMDTVLNLGLNDQTVEALATLSGDRRFAFDSYRRFITMYSDVVLGFEHHHFEDILDSFKDSQGYQLDTDLSSEDWEMLVGKYKDAVAHETGKDFPQDPHDQLWGAIGAVFSSWMNARAVTYRKLHDIPESWGTAVNVQAMVFGNMGDTSATGVAFTRNPSTGESKLYGEFLINAQGEDVVAGIRTPQDITEDARIESGSDKASMEVAMPDAFHELTRIYTLLEKHYRDMQDMEFTVERGKLWMLQTRSGKRTAKAALRIAVELANEGLISENDAVLRVDPASLDQLLHPTIDPAAKRDVVATGLPASPGAASGEIVFSSDEATKLQADGRKVILVRIETSPEDIHGMHAAEGILTTRGGMTSHAAVVARGMGKPCVSGCGTIRVDYGRGTMSIGGRTFKTGDVITIDGSVGQVLAGRMPMIEPELSGEFGTLMGWADAVRETGVRVNADTPEDARTAIKFGAEGIGLCRTEHMFFEETRIRTVREMILSEEEQERRAALAKLLPMQRADFVELFEIMKGLPVTIRLLDPPLHEFLPHTQAEVEEVARAMNTDPRRLADRARELSEFNPMLGFRGCRLAIAYPEIAEMQARAIFEAAVEAEKRTGEAVGLEVMVPLIATKAEFDLVKARIDAMAQAVIRETGAKLEYQVGTMIELPRAALMAGQIAEAAEFFSFGTNDLTQTTYGISRDDAGSFLGAYVAKGILEIDPFISIDRAGVGELVKIGVERGRATRPKLKVGICGEHGGDPASVAFCHKIGMNYVSCSPYRVPIARLAAAQSALGKEIASQA

SEQ ID NO: 38537 - protein, 82 aa, Populus x canadensis
TLLKPNMVTPGSDAPKVANEVIAQFTVRALQRTVPAAVPAIVFLSGGQSEEEATRNLNAINKLKTKKPWSLSFSFGRALQQS

SEQ ID NO: 38538 - protein, 536 aa, Gossypium arboreum
MLQIAFSSYSWLLTASNQKDGMLFPVALSFLVAILGISLWHVWTIRKPKKDIAPLPPGPRGLPIVGYLPYLGTDNLHLVFTDLAAAYGPIYKLWLGNKLCVVISSAPLAKEVVRDNDITFSERDPPVCAKIITFGLNDIVFDSYSSPDWRMKRKVLVREMLSHSSIKACYGLRREQVLKGVQNVAQSAGKPIDFGETAFLTSINAMMSMLWGGKQGGERKGADVWGQFRDLITELMVILGKPNVSDIFPVLARFDIQGLEKEMTKIVNSFDKLFNSMIEERENFSNKLSKEDGNTETKDFLQLLLDLKQKNDSGISITMNQVKALLMDIVVGGTDTTSTMMEWTMAELIANPEAMKKVKQEIDDVVGSDGAVDETHLPKLRYLDAAVKETFRLHPPMPLLVPRCPGDSSNVGGYSVPKGTRVFLNIWCIQRDPQLWENPLEFKPERFLTDHEKLDYLGNDSRYMPFGSGRRMCAGVSLGEKMLYSSLAAMIHAYDWNLADGEENDLIGLFGIIMKKKKPLILVPTPRPSNLQHYMK

SEQ ID NO: 38539 - protein, 228 aa, Ralstonia eutropha JMP134
MTQDELKALVAQAAADYVKQEVPEGAVLGVGTGSTANLFIDAVAAFKDRFAGAVSSSEASTRRLQQHGFKVLDLNEVDDIPVYVDGADEIDASGAMIKGGGGALTREKIVASVAGRFVCIADGSKLVETMGAFPLPVEVIPMARAAVARQVAALGGQPRLRMNKDGGIYKTDNGNVILDVSGLKITDPRGLEQSINQIPGVVTVGLFALRGANVLLLGTGEGVQRTDY

SEQ ID NO: 38540 - protein, 402 aa, Glycine max
MAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 38541 - protein, 204 aa, Glycine max
  misc_feature (48)..(48): Xaa can be any naturally occurring amino acid
  misc_feature (61)..(61): Xaa can be any naturally occurring amino acid
  misc_feature (136)..(136): Xaa can be any naturally occurring amino acid
MKKPRSPPQARTWLSEIRKYRYQLLCEIAQNFKINIIDRYLWSTIVLXKELQLLGISSLLXYEEILSPKVKDFITISNDAYSRNHILSMEKAILERLEWNFTVPTPYVFLVRFIRTFGLPPDQQKEKMTFFLAELXLVHYETANLSPPSMTAAAAVYAARCTLNRKHPWNEILKDMAGYTTAQLREFCTLDRGRKALLSPTKDI

SEQ ID NO: 38542 - protein, 101 aa, Populus x canadensis
TVVSIPNGPSALAVKEAAWGLARYAAISQDNGLVPIVEPEILLDGEHGIDRTFEVAQKVWAEVFFYMAENNVMFEGILLKPSMVTPSAECKDRATPEQVAE

SEQ ID NO: 38543 - protein, 235 aa, Wolbachia endosymbiont of Drosophila mojavensis
RGHVYSKEWSHGISPSGWESIERTKILLKSPTTTPQGKGHKSLNVALRKNLGLYANIRPCISYHPVIENKFGKFDIVVIRENEEDVYTGIEHRLTGDSYQCTKIITRSGSEKICRYAFEYAKKHNRKKVTCLTKDNIMKMTDGTFHAAFDRIAKEYQDIKAEHYIVDIGMARVATEPENFDVIVTENLYGDILSDIVAQTSGSVGLAGSSNIGNEYAMFEAVHGSAPDIAGKKHS

SEQ ID NO: 38544 - protein, 91 aa, Zea mays
MAAAGGGAGGKVSFKIILTSDPKLPFKVFSVPEAAPFTAVLKYAAEEFKVPPQTSAIITNAIQSKPQCIVEDGIGINPQQSAAPKEELNFS

SEQ ID NO: 38545 - protein, 420 aa, Pseudomonas putida GB-1
MSFNKISVVGLGYIGLPTAAVFAARKKHVIGIDVNQHAVDTINRGEIHIVEPELDMVVHAAVTEGYLRASTVPEAADAFLIAVPTPFMDDHQPDLSYIESASKAIAPVLKKGDLVILESTSPVGATEQMAYWLAQARPDLSFPQTHGEASDIRIAHCPERVLPGHVLRELVENDRIIGGMTKKCSEAAVRLYRTFVEGECIITNARTAEMCKLTENSFRDVNIAFANELSIICDKLNIDVWELIRLANHHPRVNILQPGPGVGGHCIAVDPWFIVSQTPEQARLIRTARVVNDSKPEWVIDKVKMALANFLIKNPGKSAHQVKIACYGLAFKADIDDLRESPALSIAERLGNELEATLQLVEPNIEALPQRLSRHEHVDFVYAQDSADIHVLLVKHREFRETFSVRDAAFVIDAAGVTQG

SEQ ID NO: 38546 - protein, 82 aa, Brassica napus
  misc_feature (11)..(11): Xaa can be any naturally occurring amino acid
  misc_feature (25)..(25): Xaa can be any naturally occurring amino acid
  misc_feature (47)..(47): Xaa can be any naturally occurring amino acid
  misc_feature (68)..(68): Xaa can be any naturally occurring amino acid
  misc_feature (73)..(73): Xaa can be any naturally occurring amino acid
  misc_feature (80)..(80): Xaa can be any naturally occurring amino acid
QQAQQQAWLQXRRTENMARKSAGEXPLPEEDPSNPIFKPIPEPSRLXSFLITNQVSNFCGQINGVAGXNFSRXYLTKALXDN

SEQ ID NO: 38547 - protein, 253 aa, Triticum aestivum
  misc_feature (225)..(225): Xaa can be any naturally occurring amino acid
NKFVQKSRLVPVRNSRDIVDPRVPHLLPPRNSLLLPQPKLSPVATQNKMQRAIQAIGSHGSVLKSAVLQHISVVKPAMLPAVFPRFMSVSSAQIEESGFESSTVADILKSKGKSADGSWLWCTTDDSVYDAVKSMTQHNVGALVVVKPGEDKSIAGIVTERDYLRKIIVQGRSSKSTKVGDIMTEENKLITVKPETRVLKAMQLMTEKRIRHIPVISGTEMMGMXSIGDVVRAVVSEHKEELNRLNAYIQGGY

SEQ ID NO: 38548 - protein, 2201 aa, Chlamydomonas reinhardtii
MPQPVGQLVLPSAPAQSTPLHAVTAFPRLAAGSMARVGVPRSSAAASRPRAAVRPRWLPLGPGLGNRLVLCDAHSAVPPAQGLFDPENDKDACGVGFVGELSKKPSRKCIKDALTMLNRMTHRGACGCEANTGDGAGILVGMPDGFFQAVLMEEQGLKLPPLGAYAAGQVFLPQDEEVRQKVKDICDRVATSLGHVSLTWRPVPTNNRSLGKSAVDTEPAIEQWFITSTGNRSSLEVEQQLYLLRKQIEYALRADGIKDDDAYFCSLSSKTIVYKGQLTPEQVRVYFKDLQREDFRSYMALVHSRFSTNTFPSWARAQPMRNLGHNGEINTLRGNANWMRAREGAMACLKLGLPKEVVEQMEPIVPASSSDSGAFDSVLELLTRAGGRDMPEAMMMLIPEAWQNDPLMSKEKKAFYRYHSAVMEPWDGPALVSFTDGRFLGATLDRNGLRPGRYYVTKSGRVIMASEVGVVDVDPEEVVRKGRLMPGNILLVDFDEHRLVEDKELKERYANRRSYSMWLDEHALTLQQLTASVPPEKRIPAPLPGSRPLDAGVQSLLKPLKVFGYTREALELLMGPMAKSGAEPLGSMGNDAALAALSRRNRLPFEYFKQLFAQVTNPAIDPFREAVVTSLRCFVGPEVDLTSEPGPQQCARLELPQPVLDIDEMEALKNIDHPGGWKTKVLDCTFPVSEGPAGLRKALDRLCQEAEAAVKAGQYAMICLSDRGYGPNRAPVPSLLATGAVHHHLVQLRLRSNVGLLVDSGEPREVHQFCLLVGYGADGVCPYLAFDALAAMQRDGKLPASTPLEELKSKFVKGLGVGILKTMAKMGISTLQSYKGAQIFEALGLAPEVVDVCFRGTPTRIGGSGWEQLGRDVLALHDAAFASERMPDGSADAKALPNAGDYHWRNAPDAERHMNDPEAIAKLQAATSGNDRELYKQYSALNTRLSRNVQLRGLLRFKTEAATPIPIDEVQPAKEIVKRFVTGAMSYGSISLETHTTLALAMNTLGGKSNSGEGGENPRRLEPLADGSKNPFRSAIKQVASGRFGVTAYYLTNADELQIKISQGAKPGEGGELPGDKVKGDIAVTRGSTAGVGLISPPPHHDIYSIEDLAQLIYDLKSSNPSARVSVKLVSENGVGVVASGVVKGHADHVLISGHDGGTGAAKWSSIKHAGLPWELGLAETHQTLVANDLRGRTTLQVDGQLRTGRDVAIACALGAEEFGFSTAPLITLGCIMMRKCHTNTCPVGVATQDPELRAKFAGEPEHVINYFFMVAEEVREHLASLGLRNLDELVGRADLMEMDREAIAEGGAKLAGIDLGRLLTPAASLRPGAAQRCVQKQDHGLDAGLDVHLVPLCKAALPDEPNAASEPVYIEMEVQNTHRAVGTTLSHEVTKRFGDVGLPDDSIHIKLTGHAGQSLGAWLCRGITLELEGDANDYVAKGLSGGVVAVYPPRISTFRAEDNVIVGNVALYGAVRGECFIRGIAAERFCVRNSGARAVVEGVGDHACEYMTGGVTVVLGPTGKNFGAGMSGGIAYVYDPNDKFKSLCNVDVANDLLPVESAEDVRALKSLIQRHLKFTGSDVARRILLSWDRSRVHFKKVFPHEYRRALGEAEALAKAEAAEAALLASSDAKVRTEGVGLSPKDAFEELKAMAAAAAGRPTIVAATAPAADKVRGFVNYDRKPLPYRAEAERIKDWDEVHDHSGTAAHAALLHTQAARCMECGTPFCHTQSTGCPLGNKIPEFNDLVHKGRWREALDRLLETNNFPEFTGRVCPAPCEGSCTLGIIEPPVSIKSIEATIIDKAFEEGWMVPRPPKLRTGKQVAVVGSGPAGLAAADQLNKMGHEVTVYERADRAGGLMMYGVPNMKAGKLDVVQRRVDLMAAEGVKFVMNAHVGGNVTAQDLVGKHDAVVLAAGATKPRDLPVPGREASGVHFAMEFLTANTKSLLDSDLADGKYISAKGKKVVVIGGGDTGTDCIATSLRHGATSIVNLELLDKPPATRAKNNPWPQWPRIFRVDYGHAEASHVYGADPRTYNVMTKRFIDDGKGNLKGVEIVTVKMEKDAKSGQFRPVEVPGSEKVLEADIVLLAMGFTGPEERLATSLGIKTDERSNFKATFGDFATSIPGVFAAGDCRRGQSLVVWAIREGRDAAASVDKYLQQKAGNGLLGQALDVQGGIFDVSGAPISVPQAGPPRDTSPKRPPVAV

SEQ ID NO: 38549 - protein, 182 aa, Triticum aestivum
  misc_feature (47)..(47): Xaa can be any naturally occurring amino acid
MGLTFTKLFSRLFAKKEMRILMVGLDAAGKTTILYKLKLGEIVTTIXPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 38550 - protein, 585 aa, Mycobacterium tuberculosis H37Rv
MSNPIQAPDGGQGWPAAALGPAQRAVAWKRLGTEQFDVVVIGGGVVGSGCALDAATRGLKVALVEARDLASGTSSRSSKMFHGGLRYLEQLEFGLVREALYERELSLTTLAPHLVKPLPFLFPLTKRWWERPYIAAGIFLYDRLGGAKSVPAQRHFTRAGALRLSPGLKRSSLIGGIRYYDTVVDDARHTMTVARTAAHYGAVVRCSTQVVALLREGDRVIGVGVRDSENGAVAEVRGHVVVNATGVWTDEIQALSKQRGRFQVRASKGVHVVVPRDRIVSDVAMILRTEKSVMFVIPWGSHWIIGTTDTDWNLDLAHPAATKADIDYILGTVNAVLATPLTHADIDGVYAGLRPLLAGESDDTSKLSREHAVAVPAAGLVAIAGGKYTTYRVMAADAIDAAVQFIPARVAPSITEKVSLLGADGYFALVNQAEHVGALQGLHPYRVRHLLDRYGSLISDVLAMAASDPSLLSPITEAPGYLKVEAAYAAAAEGALHLEDILARRMRISIEYPHRGVDCAREVAEVVAPVLGWTAADIDREVANYMARVEAEVLSQAQPDDVSADMLRASAPEARAEILEPVPLD

SEQ ID NO: 38551 - protein, 501 aa, Thermoproteus tenax
MRAGLLEGVIKEKGGVPVYPSYLAGEWGGSGQEIEVKSPIDLATIAKVISPSREEVERTLDVLFKRGRWSARDMPGTERLAVLRKAADIIERNLDVFAEVLVMNAGKPKSAAVGEVKAAVDRLRLAELDLKKIGGDYIPGDWTYDTLETEGLVRREPLGVVAAITPFNYPLFDAVNKITYSFIYGNAVVVKPSISDPLPAAMAVKALLDAGFPPDAIALLNLPGKEAEKIVADDRVAAVSFTGSTEVGERVVKVGGVKQYVMELGGGDPAIVLEDADLDLAADKIARGIYSYAGQRCDAIKLVLAERPVYGKLVEEVAKRLSSLRVGDPRDPTVDVGPLISPSAVDEMMAAIEDAVEKGGRVLAGGRRLGPTYVQPTFVEAPADRVKDMVLYKREVFAPVALAVEVKDLDQAIELANGRPYGLDAAVFGRDVVKIRRAVRLLEVGAIYINDMPRHGIGYYPFGGRKKSGVFREGIGYAVEAVTAYKTIVFNYKGKGVWKYE

SEQ ID NO: 38552 - protein, 267 aa, Zea mays
LRHCRYLPAPTPHLRFAMNPSSSSTSSSGGYHSRAAAFASPQPRGGGGGGGGGRDGSDRIDALGRLLTRVLRHMAAELRLDMRTDGYVRVRDLLKLNLQTFAKVPLKSHTVDEIREAVRRDNKQRFSLLEEDGELLIRANQGHTISTVTSESLLKPILSPDEVSVCVHGTYRKNLDSILQFGLKRMARLHVHFSSGLPSDGEVTSGVRQNVNILIHLDVSKALKGGMKLYISDNKVILTEGFDGVVPVKYFERVETWPGRAPIPFQR

SEQ ID NO: 38553 - protein, 383 aa, Glycine max
MCVKDGEQVGEDHIEKNVDNNRRVSWPLHCDLLRAHMDNKEKDSSFRIPSDQISVVNSSPLESICEDAEIVDKKQNMMNFVPTLRSGECSDIGDRPSMEDTHICIGDLAEKFGNNELCKEAISFYGVFDGHGGKSAAQFVRDHLPRVIVEDADFPLELEKVVTRSFLEIDAEFARSCSTESSLSSGTTALTAIIFGRSLLVANAGDCRAVLSRGGGAIEMSKDHRPLCIKERKRIESLGGYIDDGYLNGQLGVTRALGDWHLEGMKEMNGKGGPLSAEPELKLMTLTKEDEFLIIGSDGIWDVFRSQNAVDFARRRLQEHNDVKQCCKEIIGEAIKRGATDNLTVVMICFHSEPPPPMVVERPRVRRSISAEGLQNLKCLLEG

SEQ ID NO: 38554 - protein, 574 aa, Prochlorococcus marinus str. MIT 9301
MKETSPKSNNGTILDINDSFKIEFDPISDALAAIRNGECIIVVDDERRENEGDLICAAQFATPQQINFMATEGRGLICLAMQGEKLDSLDLPLMVDRNTDENQTAFTISIDAGPENNVTTGISAEDRAKTIQVAINPNTKPDDLRRPGHIFPLRAKKGGVLKRAGHTEAAVDIAAMSGLYPAGVICEIQNPDGSMSRLPQLKEYAKQWGMKLISIADLISYRFQTERFVFRKSDAVLPSIFGNFKAYGYVNELDGSEHVALVKQKSSKLREPVLVRMHSECLTGDAFGSLRCDCRPQLEAALSRIEKEEEGVVVYLRQEGRGIGLINKLKAYSLQDGGLDTVEANEKLGFPADLRNYGVGAQILTDLGIKKLKLLTNNPRKIAGLGGYGIEVIERVPLVICPNDNNAEYLSVKKTKLGHMIDEENSNSRNIDPFISIFLDGKYKSNDLVPIKNAVIKFCSYKNINIKLESTPRLLAFWNRPKLVWRILHDQNRTNSNITDEEIKNIELFIQFLSNYENSTKIGIIVSRNIEQALHPTNSIKLINTKFTINNEILYSSTRKFNLDKETFSIVFEG

SEQ ID NO: 38555 - protein, 556 aa, Ricinus communis
GEFTWKLADHPKLPKGKTIAMVVLDGWGEAKPDQYNCIHVAETPTMDSFKKTAPERWRLIKAHGTAVGLPTEDDMGNSEVGHNALGAGRIYAQGAKLVDLALASGKIYEGEGFKYVKECFDKGTLHLIGLLSDGGVHSRLDQLQLLLKGAAEHGAKRIRVHVLTDGRDVIDGTSVGFAETLEKDLENLREKGVDAQVASGGGRMYVTMDRYENDWNVVKRGWDAQVLGEAPYKFKSAVEAIKKLREEPKANDQYLPPFVIVDENGKPVGPIVDGDAVVTINFRADRMVMLAKALEYENFDTFDRVRFPKIHYAGMLQYDGELKLPSHYLVSPPEIERTSGEYLVHNGVHTFACSETVKFGHVTFFWNGNRSGYFNPEMEEYVEIPSDVGITFNVQPKMKAIEIAEKARDAILSGKFQQVRVNIPNGDMVGHTGDVEATVVGCKAADEAVKMIIDAIEQVGGIYVVTADHGNAEDMVKRDKSGKPMADKSGKIQILTSHTLQPVPIAIGGPGLTPGVRFRSDIPTGGLANVAATVMNLHGFEAPSDYEPTLIEAVDN

SEQ ID NO: 38556 - protein, 265 aa, Streptococcus pneumoniae R6
MKIGFIGLGNMGASLAKSVLQTRTSDEILLANRSQAKVDAFIADFGGQASSNEEMFAEADVIFLGVKPAQFSELLSQYQTILEKRESLLLISMAAGLTLEKLASLIPSQHRIIRMMPNTPASIGQGVISYALSPNCRTEDSELFCQLLSKAGLLVELGESLINAATGLAGCGPAFVYLFIEALADAGVQTGLPRETALKMAAQTVVGAGQLVLESQQHPGVLKDQVCSPGGSTIAGVASLEAHAFRGIVMEAVHQAYKRTQELGK

SEQ ID NO: 38557 - protein, 501 aa, Thermoproteus tenax
MRAGLLEGVIKEKGGVPVYPSYLAGEWGGSGQEIEVKSPIDLATIAKVISPSREEVERTLDVLFKRGRWSARDMPGTERLAVLRKAADIIERNLDVFAEVLVMNAGKPKSAAVGEVKAAVDRLRLAELDLKKIGGDYIPGDWTYDTLETEGLVRREPLGVVAAITPFNYPLFDAVNKITYSFIYGNAVVVKPSISDPLPAAMAVKALLDAGFPPDAIALLNLPGKEAEKIVADDRVAAVSFTGSTEVGERVVKVGGVKQYVMELGGGDPAIVLEDADLDLAADKIARGIYSYAGQRCDAIKLVLAERPVYGKLVEEVAKRLSSLRVGDPRDPTVDVGPLISPSAVDEMMAAIEDAVEKGGRVLAGGRRLGPTYVQPTLVEAPADRVKDMVLYKREVFAPVALAVEVKDLDQAIELANGRPYGLDAAVFGRDVVKIRRAVRLLEVGAIYINDMPRHGIGYYPFGGRKKSGVFREGIGYAVEAVTAYKTIVFNYKGKGVWKYE

SEQ ID NO: 38558 - protein, 438 aa, Arabidopsis thaliana
MNTNNQRDNHYPNIPNSPRDYNYTPSSPTARIRHRRRSSEVNRSNVSRVSNLLLGDKNKYRSMWIRTCSSLWMLGGVVFIIYMGHLYIWAMVVVIQIFMAKELFFLRRRAHEERRLPGFWLLNWHFFFTAMLFVYGRIIQQQLVNTVSSDRFIYKLVSGLIKYQMVICYFLYIAGLIWFILTLKNKMYKYQFGQYAWTHMILIVVFTQSSFTVANIFEGIFWFLLPAALIAMNDVAAYFFGFYFGKTPLIKLSPKKTWEGFIGASVATIISAFIFANVLGQFQWLTCPRKDFSTGWLHCDPGPLFRPEYYPFPSWITPFSPWKGISTLPVQWHAFSLGLFASIMAPFGGFFASGFKRAFKIKDFGDSIPGHGGFTDRMDCQMVMAVFAYIYIQSFIVNRDYSVEMILDQISRSLGHEEQKMLYEKLGDILQHKLQGRF

SEQ ID NO: 38559 - protein, 432 aa, Legionella pneumophila str. Paris
MEECMYLDALSRLDKAASFCRIDSEALEKLKHPKSCLEVSLPVRMDNGELKIFPAYRVHHNDSRGPMKGGIRYHPKLDLDEIKTLALWMTIKCAVADIPFGGAKGGVIVDPKQLSRMELERLSRSYIELIADFIGPDKDIPAPDMYTNEMIMGWMMDEYATIVRKNSPAVITGKPISLGGCLGREGATGLGAYYCIKILEKKKKWQSSELRVAVQGFGNAGQSIAKLLYDNGYKIVAISDSKGGIYNTKGIDIPRMIEIKNSSKDVQSIYCKESVCKLAKEATITNEELLELDVDLLIPAAAQNQITQENAARIKAPIIIEIANGPITLEADALLQKKGLLIVPDILANTGGVIVSYFEWVQNKSGYYWSLEKVQEELQTIISREFGNIWQLMEQYQTDMRQAAYVHALNRYDKAVTAQGTRGYFSNLSLSL

SEQ ID NO: 38560 - protein, 259 aa, Arabidopsis thaliana
MASQVRSVKVGNLSSGATEHDIKEFFSFSGEVESIDIQSNEHSAYVTFKETQGAETAVLLSGASIADQSVIIELAPNYSPPAAPHAETQSSGAESVVQKAEDVVSSMLAKGFILGKDAVGKAKAFDEKHGFTSTATAGVASLDQKIGLSQKLTAGTSLVNEKIKAVDQNFQVTERTKSVYAAAEQTVSSAGSAVMKNRYVLTGVSWAAGAFNRVAQAAGEVGQKTKEKVEAEQPSQPAQSQQQLPEGYSPIHSSEYSKN

SEQ ID NO: 38561 - protein, 281 aa, Glycine max
IIFYILKFQELPCIHTIIAQYNALTFQVGMTKTDAAVQTLSDINPDVALESYTLNITTVTGFETFMSSLKNKSFRPNKQGSGVDLVLSCVDNYEARMAVNQACNELSQTWMESGVSEDAVSGHIQLLIPGETACFACAPPLVVASGVDERTLKREGVCAASLPTTMGVVAGLLVQNTLKLLLGFGQVSPYLGYNSLKDFFPTMQMKPNPQCSNVACLERQEEYLFAKPARDAAAKAKMEAEAPSTEEVPLHEDNEWNISVFNDLVLDHFHVCNRRYKTLIN

SEQ ID NO: 38562 - protein, 648 aa, Shewanella oneidensis MR-1
MEHGFLIQILLMLVIAIIAIALLRRIGLPAILAYLLTGVLSGPSGFHWFTQQQMQSVAELGVVLLMFTLGLEFSVPRLWAMRRTVFGLGSAQVFVTTVLTMLVALACGLNWRESLVIGAAIALSSTAIVLKLLNELGWLRRRHGELSVSVLLFQDLAVVPLLILLPLLGQSDEPLVLASIAWALLKGILAFFFLMALGKWALPRLFDEVARSRSNELFVLSTLVVALVTGAFTQWLGLSMALGAFMAGMLLGESQYRRQLEADIRPFRDLLMGLFFISIGMMLNFALVIQFWWQILLILLAVVFGKALIIHGLLRLVGEPFRIAISTALSLAQVGEFSFVVLALAVSYGLLSNETSTMLVMVAVLSMSIAPWLVRHCMDIAKWLLGIRQSGHVDDVVPVITDDHDLVVILGYGRVGQTIARFLKTEAVPYLVLDLDPTRVYEARRAGEPIYFGDVCKRAILKQIGIKHAKMIVITFCESRSVEEALPLCRQLAPEANILVRTRDDSELDLLQKAGANQVIPETLEGSLMLVSQVLHQCGVPLARILKRLESERRNHYQFLHGFFSGTETDFTLESLHAVLLHRGADAVGKQVADIDWELLRVELRAIRRSGQEIEHPASDWVFRAGDILLIVGKPRRLEKAEAKLLQG

SEQ ID NO: 38563 - protein, 527 aa, Prochlorococcus marinus str. MIT 9301
MNGDLNSWDKFCNYLWFDKKLNIWLDISKINFTSKEINNLEDKFVDVFSSMKELENGAISNIDENRQVGHYWLRNPSISPSSKIAEEIRADINAISEFGKQILNGDIKNKNNKQYTDVLWIGIGGSGLGPLLITESLQKCSRGLNFSYIDNVDPFLISEKLEELSEKLSTTLFVVVSKSGGTPEPRIAMEIIKSHCEKNSLEWNSNAIAITMKDSKLFKKATSEYWLKIFNLQDWVGGRTSITSSVGLLPLALINENISEFIKGASLMDEATRISDFKNNPAALLSSAWYLTGDGTGKRDMVVLPYRDRLQVFSKYLQQLVMESLGKKFNRNGEVVNQGISVFGNKGSTDQHAYVQQLRDGIDNFFCIFIELLDTPSTNIFDDKENPKEYLSGFLQGTRSALSSENRQSITITLEKLNCFSLGALIALFERAVSFYAELVNINAYDQPGVEAGKKAAANIIEYQQKVSNLLDAGGEYSINDITSLFDNSVSESIFFILREMCFGNDNYLVKGDWSNPNSLVIQKLNS

SEQ ID NO: 38564 - protein, 154 aa, Burkholderia thailandensis E264
MRVSDILKVKGNTLFTVTPDTPLRSAVDTMAEHDIGSLVVMEYGDLVGILTFREIILRLKANGGSVGDVLVRTVMDEPLTCTPETDIDEVRRMMLERHARYMPVLDKKVLMGVISFYDVAKTVVEAQSFENRMLKAYIRDWPEPDSEERKPLAS

SEQ ID NO: 38565 - protein, 387 aa, Xylella fastidiosa 9a5c
MNFHEYQAKQLFAEYGIPVPAGRIASSADEAVTAAKSLGNGPWMVKAQIHAGGRGKAGGVKFCKTTDEVKQAAAAMLGTKMATYQSAGVALPVNLVLVTEAGEITKELYLSVLVDRGTRSITYIASSEGGVDIEHVAAETPEKIQTLNVDFVEGLQPYQGRDIGFHLGLEAKQVNQLSKIMISLYQLFNDKDLSLIELNPLAILSNGDLYALDGKINSDDNATFRHKELAAMRDKTQEDETEVLASENDLNYVTMDGNIGCMVNGAGLAMATMDVIKLNGGEPANFLDVGGGATKERVTTAFKLILSSNKVKAIFVNIFGGIVRCDMIAEGIIAAVKEVGVKVPVIVRLEGTNVDAGKQLLATSGLAIIPADDINDGAKKAVAAVTV

SEQ ID NO: 38566 - protein, 246 aa, Nostoc punctiforme PCC 73102
MQQSLDSISDPPSTKTQDSAHKSMLKNLLSGVFFEPLLSDFRIIFERDPAARNWLEVVFCYPGLHALCLHRLAHWLHGRGVGFIPRFISHLGRFLTGIEIHPGAEIGQGVFIDHGMGVVIGETAIVGDYTLIYQGVTLGGTGKETGKRHPTVGKNAVIGAGAKVLGNLQIGDRVRIGAGSIVLRNIPNDCTVVGIPGRIISRNENASLSPLEHGKLPDMEATVIRSLLSRVEQLEKQLQTLGVKSH

SEQ ID NO: 38567 - protein, 378 aa, Triticum aestivum
  misc_feature (202)..(202): Xaa can be any naturally occurring amino acid
  misc_feature (231)..(231): Xaa can be any naturally occurring amino acid
  misc_feature (248)..(248): Xaa can be any naturally occurring amino acid
  misc_feature (284)..(284): Xaa can be any naturally occurring amino acid
  misc_feature (351)..(351): Xaa can be any naturally occurring amino acid
AYLGDTIEQVCTKKQAGTGPEFPGYRRPTRPLAYKYLKTRIIIDAVEKFLRIQQVIGPTRYAYTNIVAVTSHFRDKLGQGGYGSVYKGVLLPGDIHVAVKMLEGNSNCNGEDFISEVSTIGRIHHVNVVRLVGFCSEEMRRALVYEYMPNGSLDKYIFSTEKSFSWDKLNDIALGIARGINYFHQGCDMQILHLDIKPHNIXLLDSNFVPKVADFGLAKLYPRGDSFVPLXSAMRGTVGYIAPEMISXGAFGVISSKSDVYSFGMLLLEMAGGRRNPDPNMGVXSARAYYPSWVYAKLTREEAGEEISPVAADMHELEKKLCVVGLWCIQMRSCDRPTMGEVIEILEAGTXACRCLQDHFSATKGTSMWRTLIISLPS

SEQ ID NO: 38568 - protein, 133 aa, Ostreococcus tauri
MRVFDSSVTIYTEHAPIIYTPKDGKEGHEPIRQGWAPVPGKYATRVGAGAPVYLAAVLEYLAAEVLELAGNASRDNKKSRIVPRHIQLAIRNDEELSKLLGTVTIASGGVLPNIHSVLLPKKGKKSGSASQEY

SEQ ID NO: 38569 - protein, 177 aa, Glycine max
MLVFFLINRMMSDYKVEMINDGMQEFYVHFHGPNESPYHGGVWKVRVELPDAYPYKSPSIGFINKIYHPNVDEMSGSVCLDVINQTWSPMFDLVNVFEVFLPQLLLYPNPSDPLNGEAAALMMRDRATYEQRVKEYCEKYAKPEDIGAATEENSSDEELTEDEYDSSDEQVAGKADP

SEQ ID NO: 38570 - protein, 232 aa, Triticum aestivum
  misc_feature (193)..(193): Xaa can be any naturally occurring amino acid
  misc_feature (196)..(196): Xaa can be any naturally occurring amino acid
MVISHSSSGPGESAYNTFSSRYARVELPRYRMPENSIPKETAYQMITDELMLDGNPRLDLASFVTTWMEPECNKLIMDSINKNYVDMDEYPVTTELQNRCVNMIAHLFNAPINEDEKAIGVSTVGSSEAIMLAGLAFKRKWANKRKEEGKPYDKPNIVTGANVQVCWEKFARYFEVELKEVKLTEGYYVMDPXEAXEMVDENTICVAAILGSTLTGEYENVQLLNDLLVGKT

SEQ ID NO: 38571 - protein, 309 aa, Oryza sativa
MRDVWGCRQWLRRSSARSSRCHSVDQQPERSRIARRARPRQWRRTALLSAALVPRQPPATPALLPAASKETEWSSTESSAASGLDFEDTALTLRLPCSLAAAVPDPTASAPPPKPTRPTTPPPSPPPATTIGFPTAAAAATADRAMPTPASPRLRQNIRVREILNAKGEAKAGAVYWCCTSHFVHEAIKHMTAHNVGALVVLKSGDEKQLAGIVTERDFARKILLPGRPSEETRVGDIMTEEDKLITVSSNTNILQAMELMTERHIRHVPVFDEKVVGMITIGDVVKTIVDQQHQEVKQLKKYIRGDYY

SEQ ID NO: 38572 - protein, 437 aa, Bacteroides thetaiotaomicron VPI-5482
MKIAIVGTGYVGLVTGTCFAEIGVNVTCVDTNSEKIESLQKGMIPIYENGLEEMVLRNVKAKRLKFTTSLESCLDDVEVIFSAVGTPPDEDGSADLSYVLEVARTIGRNMNQYKLVVTKSTVPVGTARRVRAAIQEELDKRGVNIEFDVASNPEFLKEGNAISDFMSPDRVVVGVESVRAEKLMSKLYKPFLLNNFRVIFMDIPSAEMTKYAANSMLATRISFMNDIANLCELVGADVNMVRSGIGSDTRIGRKFLYPGIGYGGSCFPKDVKALIKTAEQNGYTMRVLRAVEDVNEAQKGVLFEKLMKQFNGDLRGKTIALWGLAFKPETDDMREAPGLVLIDKLLKAGCQIRAYDPAAMNECKRRIGDVIYYARDMYDAVLDADVLMLITEWKEFRLPSWAVIKKTMNQQIVLDGRNIYDKKEMEELGFIYSCIGK

SEQ ID NO: 38573 - protein, 486 aa, Nocardioides sp. JS614
MADFTLAQIPDLPLDLCVGGKEVPASDGGRFDVLDPATGAVLTSVANGTVEDALACVDAADAAAAAWAATAPRERSEILRKAFELMRERADELAHLISLENGKALADARGEVAYAAEFFRWYAEEAVRAAGSVMTAPSGANRIVVLQQPVGICVLVTPWNFPAAMATRKIGPALAAGCTVVLKPASDTPLTALLMAKILADAGVPAGVVNVLPARRSGAVVSAMLHDPRVRKLSFTGSTEVGRVLLREAADQVVNCSMELGGNAPFIVLDDADLDAAVDGAMIAKMRNAGEACTAANRFYVHADVADEFSRRLAERMAALRVGPGTADDTEVGPLVNDESAAKVDELVRGAVSAGARVVVGGRRPEREGYYYEPTVLLDVPVDAEILGEEIFGPVAPVVTFTDEDDAIRMANETEYGLVSYVYTRDLARGMRVSERLDSGMVGLNRGLVSDPAAPFGGTKQSGVGREGGHEGMLDYLESKYVAVSW

SEQ ID NO: 38574 - protein, 392 aa, Synechococcus sp. WH 8102
MPTSRRLEALGNGVFARTDRAKQAHRDKTGVPPLIDLSLGSTDLQPPEEILRCMAAAVTDPASSAYCLEAGTAPFQQAVAAWCQRRFGVEVDPQRQVQLLVGSQEGTAHLPLAILDPGDRALLLDPSYPSHRGGLVLAGASICSLPLFQEQDWLPDFDAIRPAVWDQLKLFVLGYPHNPTATVGNQELLDQAMARGCRHQLVIANDNPYVDLALEGEAPSLLRSPGWSEWGIEFFSLSKGWCLGGFRLAFAIGAEPLITALRQVKGVVDFNQSLALQQGAIQALTQWADWPRSLHGAYRERRDRVLSVLRGGGWSCPTPGMAMYLWLPLPADAGVRKLDDETFASHVLQRSGVALTPGSGFGEGGKGWLRMALVRPTDELEDAARRVVAAVP

SEQ ID NO: 38575 - protein, 254 aa, Enterococcus faecalis V583
MPKEFETKRVLVTGAASGIGQAQAIAFAEQGAEVIGIDLDETGLKQTAALVDPDSAKSFTYFVGDVSSPSFVQATMKQIVKNNGQIDILLNTAGILDDYRPSLETSEALWDQILATNLKSVFLVTNAILPYFLQQKKGVIVNMASIAGLVAGGGGAAYTASKHAIIGYTKQLSYDYAKLGIRANAIAPGAIQTPMNAADFAGEGEMAAWVARETPAGRWAQPQEVAKLSLFLASDDADYIHGTVMTIDGGWTMK

SEQ ID NO: 38576 - protein, 597 aa, Magnaporthe grisea 70-15
MVQSVIFGLLLAALPVQTFNVLPGYQKLSSVRNGALSVLGSHNQKRQNFQNGPCAGNTATTRSTWCSYNIDYDWYDVVPTTGVTREYWFVLSDNRTISPDGVPRYAQTINGTMPGPTLFANWGDNVVVHLTNNLTRSVNGTSLHFHGMRQYYTVQNDGVASITQCPIPPGSSMTYKWRATQYGTSWYHSHFGLQAWAGMYGGIVINGPASENYDHDLGALFLSDWSHETPDALFHTAQTTGPPILSNGLINGTNVYGEDGSGNQTGSRFTQRVTAGESYRFRLINSAIDSHFRFSIDNHTLTVIAADLVPIESYTTKMVSIGIGQRYDVLVTADQGSTAGAESFWMRAIPQVNCTKARSPTNVRGILHYGERPSTPRSTGYAYTDSCQDEDAKRLVPVVPKDVDSPTWTHFDLASWNRTSDNLLRWYLNGTSMSVDWSNPTLAQIHDNATEYKRSHAVAELDEPDSWAYVAVETNASASHPVHLHGFDFYILAQGSGRYDAHDPSALNLVNPPRRDTAMLPAWGYVVLAFKTDNPGAWLMHCHIGWHTSEGFAMQFVVRKRDLLRNKMIDYASLNGTCAAWKRHVAAGGIVLADSGV

SEQ ID NO: 38577 - protein, 312 aa, Mycoplasma capricolum subsp. capripneumoniae
MALNLKGKSFLKLLDFSPREIRYLLDLSRDLKRAKYAGNEVQTMQGKNVVLLFQKNSTRTRCAFEVATLDQGAHVTYLGPSGSQFGKKESVADTAKVLGRMYDAIEFRGYEQSVVEDLAKYSGVPVYNGLTNEFHPTQILADFLTVEEYKGNLKGLKFVFAGDTRNNVATSLMVGCAKMGMHFVGAAPKELWPSEDLVNQSKEIAKETNATISFVEDMKQACSDADVIYTDVWVSMGEPAEVWESRINLLKPFQVNMDAIKVAKPDVIFMHCLPSFHDLNTEVGRQIYEKFGIPEMEVTNEVFESKHSVVFE

SEQ ID NO: 38578 - protein, 557 aa, Alteromonadales bacterium TW-7
MGLFFSPTKLVITSVLVFQFSAFHVAAKQVAQSAVAMPDSYSADTAKNILELGGNAVDAAIAAQFVLAVTLPEAGNIGGGGFMLIQKDGKSDFIDYRETAPSDAHRDMYLDEQGNVIPNRSIYGIHASGVPGSVAGMWLAHKKHGTVEWKKLVQPAVTLAEQGFIVPPKLAQGVSNYISYLNEQKIDVNFEKYFAGLKANEKFTQPELAKTLKRIRDDGQAGFYEGETANIIEKFMRKHGGIITKADLKNYTAKSRTPLKASWNGYEVLTSPPPSSGGIAILQWLKMYELQKLNNEVAHNSSSYVHLLSEIGKRVFADRAEYLGDPDFFDVPVNALLNELYLKKRMADISLTAISTTEKIKPGLKESEQTTHFSIVDKMGNAVANTTTINLGFGSGVVVEGAGFILNDEMDDFSAKPGVMNAFGALGGKANEIQPHKRMLSSMTPTILLKDNTVKMVTGSPGGTTIISSVYQSILNTIEFNMSAEQVVNVPRFHHQLWPKNVIRVHEGLNDAVKVELQKMGYTIDERHFGDMHVIINKDGDLDAASENSGRGKSIVF

SEQ ID NO: 38579 - protein, 218 aa, Candida tropicalis
MSAAKEVGKNVILLPQTNQLIGLYSIIRDQTTKRGDFVFYSDRIIRLLVEEGLNQLPVEDAIIKCHGGYEYKGAKFLGKICGVSIVRAGESMEMGLRDCCRSVRIGKILIQRDEETALPKLFYEKLPEDISERYVFLLDPMLATGGSAMMAVEVLLARGVKMDRIFFLNLLAAPEGIKAFQDKYPDVKIITGGIDEKLDESKYIVPGLGDFGDRYYCI

SEQ ID NO: 38580 - protein, 249 aa, Glycine max
MTHTLARNNTMCTLEKRGPLFVLTLTSEFDDQHRLNPTLLSSLLAALSEVKSQATAGSALLTAAHGRFFCNGFDFRWAQAAGDQPSARLRLRRMSDALRPVLAALLSLPIPTVAAVSGHAAAAGAIFALAHDYVLMRADRGVIYFPEVDLGITLPEYFAAVAGAKIPAAALRDVVLAGRKVRAEGAVEMGIVHSAHDSAEGTVEAAMRLGEELARRKWVGDAYAEIRKSLYPEVCAALGLTPKTIVSKI

SEQ ID NO: 38581 - protein, 322 aa, Bacillus licheniformis
MNKKVALITTGGTIASRKTESGRLAAGAISGPELAEMCSLPEDVQIDVYPAFQLPSMHITFQHLLELKQTIERVFQDGGYDGAVVTHGTDTLEETAYFLDLTIEDERPVVVTGSQRAPEQQGTDAYTNIRHAVYTACSPDIKGAGTVVVFNERIFNARYVKKVHASNLQGFDVFGFGYLGIIDNDKVYVYQKLLKRDVHQLQRPLPAVDIVKCYLDGDGKFIRAAVREGVEGIVLEGVGRGQVPPNMMADIEQALNQGVYIVITTSAEEGEVYTTYDYAGSSYDLAKKGVILGKDYDSKKARMKLAVLLASYKEGIKDKFCY

SEQ ID NO: 38582 - protein, 828 aa, Oryza sativa
MRPQSYAFLGLVLLLFSLLPLAPCSAANLNNDTLLAGQALAVGDKLISNNGKFTLGFFQPDAGTSKSSDTSTNSPGWYLGIWFNKIPVFTTVWVANRERPLTIPELNLTQLKFSSDGNLVIFNHATESIIWSTRVIIDSHRTQETSSTNTSVVLLNTGNLVIESTANVVLWESFDSPTDVVLPGAKFGWNKITGLNRQCISKKSLIDPGLGSYSVELDTNGTKGVILMLRNPPKVYWYGLTSPTLIPELRSLLAMDPRTRGLIIPTYVDNSQEEYYMYTLSNESSSSFLSLDMSGQIMLNVWSEANQSWQIIYAQPADPCNPFATCGPFTICNGNSNPVCECMESFTRKSSQDWDLGDRTGGCSRNTPLDCTISGNRTSSADMFHPIAHVKLPYDSESIQDATTQSKCAQACLSSCSCTAYSYQNNICSVWHGDLFSVNQNDGIENHFDDVLYLRLAAKDLQSLSKNKRKPIVGVVTTISIISLVLLIMLMVLVMVWRNRFKWCGVPLHRSQGGSGIIAFRYSDLDHATKNFSEKLGEGGFGSVFKGVLRDLTVVAVKRLDGARQGEKQFRAEVSSIGLIQHINLVKLIGFCCQGDKRLLVYEHMLNGSLDTHLFQSNATILTWSTRYQIAIGVARGLSYLHQSCHECIIHCDIKPQNILLGESFTPKIADFGMAVFVGRDFSRVLTTFRGTVGYLAPEWISGVAITPKVDVYSYGMVLLEIISGMRSLPNVHSSNSHHAAYFPVQAISKLHEGDVQSLVDPRLSGDFNLEEAERVCKVACWCIQDNEFDRPTMGEVVLVLEGLQEFDMPPMPRLLAAITRSSNVAEM

SEQ ID NO: 38583 - protein, 325 aa, Cattleya bicolor
MESGSFPVINMELLESSQRPEAMALLREACENWGFFELLNHGISTELMNRVETVNKENYRRFREQRFKEFAAKTLDSGEKVDGDNLDWESTFFLRHLPTSNISQIPDLDEDCRSTMKEFARELEKLAERLLDLLCEDLGLEKGYLKRVFCGGSDGLPTFGTKVSNYPPCPKPELIKGLKAHTDAGGIILLFQDDKVSGLQLLKDGQWIDVPPLRHSIVVNIGDQLEVITNGKYKSVMHRVVAQTDGNRMSIASFYNPGSDAVISPAPELVEKEAEEEKKEATYPKFVFEDYMNLYIRKKFEAKEPRFEAMKTMETVSGSQLIPTA

SEQ ID NO: 38584 - protein, 813 aa, Oryza sativa
MPSLYIFLGLLLFSLQAPPCPAATDTLKTGQVLSAGDKLVSRNGKFTLGFFNPSANISKSSDNISSSWYIGIWFNKIPVFTVVWVANRERSIAEPDLKLTQLKISQDGNLAIVNHANESIIWSTRIVNRTEASMNTSVLLHDSGNLVIQSTSNAVLWQSFDYPTDVALPNAKIGWNKVTGLNRVGVSKKSLIDMGTGSYSVQLYTNGTRRVTLEHRNPSIEYWYWSPDESGMKIPALKQLLYMNPQTRGLVTPAYVNSSEEEYYSYNSSDESSSTFLLLDINGQIKFNVWSQDKHSWQSLYTQPVDPCRSYDTCGPFTICNGNSQPFCDCMENFTRKSPRDWDLGDRTGGCSRNSPLDCTRNTSSTDIFHPLIHVTLPRNPQTIQEATTQSECAQACLSSCSCTAYSYQNTSTCSIWHDELFSVNQDDGIEIHSQDVLYLRLAAKDLQSLRNNKRKPNVAVVIAASVIGFVLLMVGVFLLIWRNRFEWCGAPLHDGEDSSGIKAFRYNDLVHATKNFSEKLGAGGFGSVFKGMLIDLTTIAVKRLDGDRQGEKQFRAEVSSIGLIQHINLVKLIGFCCEGRKRLLVYEHMLNGSLDAHLFQSNAGTLNWSIRYHIALGVARGLAYLHQSCHECIIHCDIKPQNILLDASFAPKIADFGMAAFVGRDFSRILTTFRGTVGYLAPEWISGVAVTPKVDVYSFGMVLLEIISGRRNSPNEYTSDNYHVSYFPVQAINKLHEGDVRNLVDPQLCDDFSLEEAERVCKVACWCIQDDEHDRPTMSEVVRVLEGMQELEMPPVPRLLAALTKCSDVGSI

SEQ ID NO: 38585 - protein, 303 aa, Cattleya intermedia
MAVLREACENWGFFELLNHGISTELMNRVETVNKENYRRFREQRFKEFAAKTLDSGEKVDGDNLDWESTFFLRHLPTSNISQIPDLDEDCRSTMKEFARELEKLAERLLDLLCEDLGLEKGYLKRVFCGGSDGLPTFGTKVSNYPPCPKPELIKGLRAHTDAGGIILLFQDDKVSGLQLLKDGQWIDVPPLRYSIVVNIGDQLEVITNGKYKSVMHRVVAQTEGNRMSIASFYNPGSDAVISPAPALVEKEAEEEKKETTYPKFVFQDYMNLYIRKKFEAKEPRFEAMKTMETVSGSQLIPTA

SEQ ID NO: 38586 - protein, 1979 aa, Cryptococcus neoformans var. neoformans JEC21
MKRQSLSFKNLIAVEPRMSPTQRRSSFFERQRQSSGSSTKTDHSSVFGSGSGSGSGLMKKKNLVSKMEGWWNAVKSNFVPEHPPGRPGGHSNQGRVNHSPKRRGSIPSITQLKSAYLAPEPAALRGSPNLPLRQVISHNELRQRPQGDNHYESASVLDSTPADIARLSRNSSSETAMPIPQHMLVPPPPPVRHASTVTEVTEEPTNPPSRQEPPIHTSLEARRRQPNLRLELEPHTLAQPSPHSSNSSGSQPRMVPLGMPLRLSESSLRSSVYGQSRGPGLTPGAPRWDQTPWPVHTFSQHQVEDREDKPVAPGAELTVGSVRNHIRRRLNGAKEACDASLRRTINSITKFVEQERQDVGRQEEIPVDYFETLNLNDSAVVDGEDTGSEAAYENEGPSSRAVSISWSRGPSRRPSVSLHAISPKARTSALATSPSRIVSRRRPSAVLPRTFGPTGRNVSIPKDRTQSGASSRSTSRSHSPMPGRQLPLQVDSTDEDRHFLQALQDLIVQATEVVDSSVHTLKSGPDSCATIIQRIQKIGAKWDEHPDWPGREWYVEILLAVANLGRVLDWWEAEKGFWNFDAETENDQLLFVLKPREEQRFDQEFRATFSEPRYSPLSTAVSVAGDLPPALGLDATSPIVSSPQTAKSEEPGKGLSPKAQAIDDLKFLAEHAKSVNIVMELSLQGEIVEYVNDAVLEVLGQVPEEVIDHPITDLLAPGDASVFSEATHQLIEDDNNTVQCRFRFEVHDLAQDEDDERQPGPVYIELEGVGMLMRENNEPSHTMWVMKPVAATQVEAITAAVFPRDGHISTEGILCRICEREIVAWFFEKHNETCDALHRLEAEIAECDDCLHELRQTVVDLESEVDAAAPNNPAQYQGVLFFTLPESVAASDAKAATQYLQGIEVRKVAREHLQDVLHILSTARQIETPYVREEEADLPSNIQNYLSEESEDRLLKIMRWQRPQTNEFALNLLFTHVEEQLKRKHKAVARMQSTIRYSEKTRHEWEDKVNEMLAEQEDGSGTESESGSGGSEIDKSPSEVHAALSVENPESSPPGPRKIAPLARLPITQAHPHRQPSVLEELSAPTSIAPTPAAPQTITTDPAPPALTSASSLPTVPILAPKVRNAPFQFGSKVHSPDMPPPAPSRRVTPSKTGSTEPESMTSSPLLMPYGADRHHRRRISGSQGMRDAPLSPRIPSAALRSSVAQTTIDDFKILKPISRGAFGSVYLAKKVATGDYFAIKALKKSDMISKNQITNVKAERTILMNQASSPYVAKLFFSFQSKDYLYLVMEYLNGGDCASLVKTLGGLSEDWARNYTAEVVLGLEYLHKRNIVHRDIKPDNLLIDARGHLKLTDFGLSRIGLLNRQVGGPRPAYLRGISLRGSGQHRLSMTRTTSNSSLIDSNMLSPEISSGQSLPNVSQSYFSQMRPSGPEDESSGSESAGIIPKHVRQMATKLSSELGTPSVNGKEPPKFVGTPDYLAPESILGIGQDDAAVDWWALGVVLYEFLYGFPPFHAETPEKVFDNVVSRRINWHEDEVGISPEARDLINRLLCSDPQMRLGANGAEEVKSHPYFASINWDTIATSEASFVPDVADPESTDYFDSRGATVGFHDGGGVPQVSKQTATDPNAKANPGAASMSPKASGEMEAIANDMAEQSDFGAFNYKNLPVLKQANDDVIRKLRTDSMAPLSQALECAPSLSKGKQRRLSVQVQSKSTRRISDPNQAPYTPSPSTSTSSAVSTPSRSNMQPPSSSTSHHPRRLSELGALDRVKSTDEADEPREAQSQTRLRGDSGSSIGSNSTELTKQRRHASLQLDFATSEPFGGLAENKHFVGSNVHSRGLDVLVAEDNPISQKILETLLTRVGCRCICVDDGPSALAAIMGSIRFDVIICDIHMPVVNGEQVARMIRSTNNHNQLTPIIAATSYEQYINEEGTLFSGVLAKPVTKADLIRCLAKLGFVISAGASDVASVPTTAPAVQS

SEQ ID NO: 38587 - protein, 130 aa, Ostreococcus tauri
MLRASGSGAIVFNSSVSGLTSTATGSLYAMSKGAMNQLTRYLACEWAKDNIRVNAVAPWYIATPLAKQVLKNETYRRAVVDRTPAGRVGEPPEVGAVAAFLVAPASSYVTGVVIPIDGGFTAHGFIPPKL

SEQ ID NO: 38588 - protein, 279 aa, Triticum aestivum
MPINAADSVPSPPTRSTSASHFPPPPFLKIYTKIRSKILPKSPTSRFCSRSHPNPLQETLATGSTAAHALDRLGDLLRTGALRAVAGVPTSLKTEAHAARVGIPMLALADAAEIHLSIDGADEVDPDLNLVKGRGGSLLREKMIEGAGARFVVIVDESKLVPRLGCTGAVPVEVVPFGSAYTLGLIRKVFDKLPGFHARLRTVKSKAGDGQEELFLTDNGNHIVEMFFEDGIHGNLRDISDSLLRITGVVEHGMFLGMATKVIVAKKDGTVAVLSKKVA

SEQ ID NO: 38589 - protein, 859 aa, Oryza sativa
  misc_feature (271)..(271): Xaa can be any naturally occurring amino acid
MVTMAMAAASAMRPLAPLFLFFFFSLAASASDNILANSSLADGQKLVSAGGVFELGFFTPPGSTTAARFLGIWYRDIDPPTVVWVANRDAPVSGTAGSLAVVVNGGGGGGGGRLVLGDGSGRVVWSSAPSNVTASDPVAARLLDSGNFVLAGGGGSGDVIWQSFDYPSDTLLPGMKFGWDLTTGLDRYLTTWRSAGDPSPGDYTFKIDPRGAPEGFIWYNGTSPVYRNGPWDGLQFSGEPEMEPNNTSFRFEFVANRTDVYYTFRRRRRRXGGVLSRFVLNQSSAQRYVWLPQAGGWSLYWSLPRDQCDQYAHCGAYGVCDVGAASMCGCPAGFAPASPRNWELRDSSAGCARRTRLNCTGDGFLPLRGVKLPDTTNATVDAAIAVHQCRARCLANCSCVAYAASDVRGGGSGCIMWSSPLVDIRKFSYGGEDLFMRLAASDLPTNGDDSSRKNTVLAVVLSLSGVVLLALAAFFVWDKLFRNKVRFQSPQRFTSFDSSIPLNQVQDRKMEDETRHSNELNVTLFDFNTIAFSTDNFANLAKLGEGGFGPVYKGELDGGQTVAVKSPGLQEYGTRDEFKNEVMLIARLQHVNLVRLLGCCIHGEERMLVYEYMENKSLDNFIFDKARSAQLNWSKRFNIILGIARGLLYLHQDSRFKIIHRDLKAGNILLDGDMNPKISDFGVARIFGDDTDSHTRKVVGTYGYMSPEYAMDGVFSVKSDVFSFGVLVLELVSGRKNRGMYSSGEQTSLLSHAWRLWREGNALALLDEAVAGGGGGGGYSRSEVLRCVQVGLLCVQERPEDRPHMAAVFMMLGNLSAVVPQPRHPGFCSDRGGGGGSTDGEWSSTCTVNDVTVTIVEGR

SEQ ID NO: 38590 - protein, 498 aa, Rhodococcus sp. RHA1
MAQHIWDRPAQYIGGRYRDGKSADTFDVLDPSTGRTVVTGPLASTEDVDDAVTAAAGALPEWAGATPAHRCEVMTRWARELEAIADQLATVESAQAGKPIKLTTEFDVPGSIDNVAFFAGAARNLEGKASGEYSGDHTSSIRREPIGVVGSIAPWNYPLQMAAWKILPAVAAGNTIVLKPAEITPLTSLLFAEAATRAGIPDGVINVITGKGTTAGNALVTHRDISMVSFTGSTPVGHGIAAAAAGKRLHLELGGKAPFVVFDDADVDAAIQGAVAASLINTGQDCTAATRAYVQRPLFDRFVDGVAAVMDTVRLGPTTDPSTDQGPLVSRRQQGHVAGFVDRARAGGATIVRGGNIPGGDLADGFYYEPTLVVGATQDSEIVQQEIFGPVLVVLPFDNDDEGIALANDTPFGLAASAWTRDLYRAQRATRDIAAGCVWVNDHIPIISEMPHGGYKQSGYGKDMSTYSLDEYTNVKHVMSDITGVAHKDWHRTIFGDR

SEQ ID NO: 38591 - protein, 253 aa, Zea mays
MGLLGRRPWLLLLALASAAVAVAVAVEASEGDADPLYRACVEGCQKTGSLKEASIKHCMVPTDGQPADKSWYAHEPLYLQWKDWNCKSECRYHCMMEREGERAKLGLQPVKYHGKWPLKRASVFQEPLSAALSALTLVVQFNGWLSFFLLLYYKLPLRPETHKTYYEYTGLWHIYGLLAMNSWFWSAIYHSCDTIWTEKLYFSSAAAFLGYSLILAILRTSSLRDEASRVMVAAPILAFVTRHILYLNNSVLD

SEQ ID NO: 38592 - protein, 142 aa, Novosphingobium aromaticivorans DSM 12444
MTIAQVIAGRGEVWSCHADDSVADAVDMLARYRIGALPVEDGTNGVAGIFSERDMIRCLHKHGEAALHMKVRDMMTAPVVTITPQTSVLEALALMTQRRFRHLPVVEGGHMVAFVSIGDLVKHRIDKIEAEADAMRVYIQQA

SEQ ID NO: 38593 - protein, 240 aa, Oryza sativa Indica Group
MGCFQSTARRPRPGYEDPVGLASETAFSVSEVEALFELFKSISGSVIDDGLINKEEFQLALFKNKRKENLFANRVLLVNILSAFRHNLILSLEIYTEWTLQIFDLFDVKKRGVIDFGDFVRALNVFHPNIPMEEKIDFSFKLYDMDNTGFIERKEVKQMLIALLGESEMRLSDEIIETILDKTFSDADTNQDGRIDRTEWENFVSRNPSLLKIMTLPYLKDITTTFPSFVFNSEVDDLVT

SEQ ID NO: 38594 - protein, 511 aa, Arabidopsis thaliana
MMMRAVIRRAASNGSSPSLFAKSLQSSRVAASSPSLLSGSETGISMYLLIFDEQSNKVLFENLNRHICIVEIMLIAFITLLCQFLKIFVLLFCLYPTSRELGHLEVGEFSFFNPAKMGDTVEAVVPHMGESITDGTLATFLKKPGERVQADEAIAQIETDKVTIDIASPASGVIQEVNMFALCVVYSVVIVVLFLFLVNEGDTVEPGTKVAIISKSEDTASQVTPSQKIPETTDTKPSPPAEDKQKPRVESAPVAEKPKAPSSPPPPKQSAKEPQLPPKERERRVPMTRLRKRVATRLKDSQNTFALLTTFNEVDMTNLMKLRSQYKDAFYEKHGVKLGLMSGFIKAAVSALQHQPVVNAVIDGDDIIYRDYVDISIAVGTSKGLVVPVIRGADKMNFAEIEKTINSLAKKANEGTISIDEMAGGSFTVSNGGVYGSLISTPIINPPQSAILGMHSIVSRPMVVGGSVVPRPMMYVALTYDHRLIDGREAVYFLRRVKDVVEDPQRLLLDI

SEQ ID NO: 38595 - protein, 499 aa, Bdellovibrio bacteriovorus HD100
MESPLSPKCKLLSTRLPFAFPLGKEDKEQVSTPFIPPIYELGPDFYDEVRPAVFPKALLRYRNQDAAESVGLGLLTPQEWQKHFWAFESLPQNIKTPLALRYHGHQFRSYNPDLGDGRGFLFAQVRDQDRLLDLGTKGSGTTPYSRRGDGRLTLKGAFREILATELLQSYGVNTSKTFSVFETGESLERHDEPSPTRAGVLVRLSHSHIRFGTFQRLAFFNQTDNIKKLLHYCVRHYYPHLTGFSEAELAAEFLRAVSQKTAETVAAWMMAGFVHGVLNTDNMNITGESFDYGPYRFLPVYDPAFTAAYFDQSGLYCFGRQPSAVLWNLHQLGGALKTAYPELAVPELLEEFGDTFNVEVQNRLLKRLNLKNPLQEITAIHDLNAELVSGIFQFMDTEKGAFEQTLYDLHSGASPERLHRSVQKDLYQKESFNNLRETLACFEIEDEDKARHSYLQTGKACALVIDELEALWAPIAEQDDWGPFERKLLEIRSFRGLYG

SEQ ID NO: 38596 - protein, 330 aa, Shewanella sp. ANA-3
MQTLAQHLTSKAVNESLSQLILTLADTSKAISHAVRHGALAGVLGATEQENVQGETQKKLDIITNDMLKDALKADGTVRGLASEEEDHVVEVCANGQYLVCFDPLDGSSNIDINSLVGTIFSVLPAPQGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGLDYSEEPSLD

SEQ ID NO: 38597 - protein, 462 aa, Streptococcus pneumoniae
PSLFRLYKSGNLSKHFAVIGTARRPWSKEYFESVVVESILDLADSTEQAQEFASHFYYQSHDVNDLEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFDAKWTWQP

SEQ ID NO: 38598 - protein, 635 aa, Salmonella enterica subsp. enterica serovar Paratyphi B str.
MIVFSSLQIRRGVRVLLDNASATINPGQKVGLVGKNGCGKSTLLALLKNEISADAGSFTLPGTWQLAWVNQETPALPQPAIEYVIDGDREYRQLEAQLNDANERNDGHAIASIHGKLDAIDAWTVRSRAASLLHGLGFSNDQLERPVSDFSGGWRMRLNLAQALICRSDLLLLDEPTNHLDLDAVIWLEKWLKSYPGTLILISHDRDFLDPIVDKIIHIEQQTLFEYTGNYSAFEVQRATRLAQQQAMYESQQERVAHLQSYIDRFRAKATKAKQAQSRIKMLERMELIAPAHVDNPFHFSFRAPESLPNPLLKMEKVSAGYGDRIILESIKLNLVPGSRIGLLGRNGAGKSTLIKLLAGELEPLHGEIGLAKGIKLGYFAQHQLEFLRADESPLQHMARLAPQELEQKLRDYLGGFGFQGDKVTEETQRFSGGEKARLVLALIVWQRPNLLLLDEPTNHLDLDMRQALTEALIDFEGALVVVSHDRHLIRSTTDDLYLVHDKKVEPFDGDLEDYQQWLSDVQKQENQADDAPKENNANSAQSRKDQKRREAELRTLTQPLRKEITRLEKEMEKLNAQLAQAEEKLGDSSLYDPSRKAEMTECLQLQASAKSGLEECEMAWLEAQEQLEQMMQND

SEQ ID NO: 38599 - protein, 302 aa, Ipomoea batatas
MDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 38600 - protein, 426 aa, Zea mays
MAAAGITRAPIGQNPRLACYAPGRGGGVVRCSLQGAVVGGRAEWQSSCAVLSSKVAALGTHSVNGHVAPAPAPAPTQNGAVLDLVPVSSSINGAITKNLPQPLRIADLSPAPMHGSQLRVAYQGVPGAYSEKAAGKAYPGCDAIPCDQFEVAFQAVELWIADRAVLPVENSLGGSIHRNYDLLLRHRLHIVGEVQLPVHHCLLALPGVRKECLTRVMSHPQALAQCEHTLTAMGLNVVREAFDDTAGAAEYVAANGLRDTAAIASSRAAELYGMEVLADGIQDDSGNVTRFVMLAREPVVPRTDRPFKTSIVFAHDREGTSVLFKVLSAFAFRDISLTKIESRPHRHRPIRLVDDANVGTAKHFEYMFYVDFQASLAEPRAQNALAEVQEYTSFLRVLGSYPMDMTPMTAGSSSTVVSSSDDPSSS

SEQ ID NO: 38601 - protein, 141 aa, Ralstonia eutropha JMP134
MAIERTLSIIKPDAVAKNVIGQIYARFEAAGLKIVAAKMVHLSRGEAEQFYAVHKERPFFKDLVDFMVSGPVMIQALEGEGAIAKNRDLMGATDPKKADKGTIRADFADSIDANAVHGSDAAETAAVEIAFFFPGMNVYTR

SEQ ID NO: 38602 - protein, 506 aa, Arabidopsis thaliana
MIKSILLCFFFLFPLLLTLFKKLLPSKWKLPPGPTGLPIIGNLHQLGRLLHSSFHKLSLEHGPVMLLRFGVVPMVVISSKEAAKQVLKSRDLETCSRPKLVANGLFTRNFKDIAFAQYGEDWREMKKLVGLELFNPKKHKFFRYIREEEGDLLVKKLSKSSQTQTLVDLRKAFFSFTAGIIFRVSFGQNFRECDFIDMDRLEELVQESETNVFSFAFTDFFPTGLGWLVDRISGQHSRIEKAFSKLTKFFQHVIDEELKIGQSQDHSNLVSSMLDMINRSTEYGSFKITSDHLIAMMTDIVLGGVNAGTITMIWTMTELTRHPRVMKKLREEIRATLGPNKERITEEDLEKVEYLKLVIKETFRLHPPGPFLLPRQVMSDIEIQGYHIPKNAHIKISTYAIGRDPKCWTNPEEFNPERFANTSINYKGQHYELLPFGAGRRSCPGMTLGITILELGLLNILYYFDWSLPNGMTIKDIDMEEDGALTIAKKVPLELIPTLPASLCIK

SEQ ID NO: 38603 - protein, 479 aa, Marinobacter sp. ELB17
MSTSHPLYINGQWVTGAKRITNSSPSDLTDVIGEYDQASAEQTRQAISAARQGFAQWSKSGLEQRYKALMAIGDELITRQQELGELLSREEGKPLAEGKGEVYRSGQFFHYYAAEVLRQIDERAESVRPGVEIDVRREPLGVVGIISPWNFPMATAVWKIAPALAFGNAVVFKPANLVPASAWALTEIISRQEFPAGTFNLVMGSGGETGEALINSPQIQALTFTGSLEVGRRIASATVANLVKCQLEMGSKNALIVVDDADVDLAVEAAFNGSYSGSGQKCTASSRLIVTDAVHDEFVSKLIARLEKATVGHALHEGVQIGPIADKRQLDSNMEWIERAQADGATLAFGGNRIEMATEGYYMVPALFTNTTNDMAINRDEVFGPIACVIRVADYEAALTTLNDTQYGLTAGIITNSLKLASDFKARAETGCVMVNLPTAGTDYHVPFGGRKNSSFGPREQGQYAREFYTVVKTCYVRA

SEQ ID NO: 38604 - protein, 739 aa, Alteromonadales bacterium TW-7
MTDSVFNLAVDENKIAVVTIDVPGEKMNTLRDSFADDLKALLTQAQEHAVKGMVFISGKSDNFIAGADVKMLDSVEKREDALAISELCHQAFFDMKKLPYTTVSAIHGAALGGGLEFALACDYRVGTDSDLTKIGLPEVQLGLLPGGGGTQRLTKIVGIQKALEWMLTGKQIRPKQAKKAGVLDDCVPQSVLLKVAKEFAAKKKPQAKEPKLDKVSKLLESNPFGRNFIFKKAKENVLKKTGGHYPAPLAIIKAVRASVELDELKAYKTEAEGFATLVMSEQSKALRGLFFATTEMKKEWRNDDAPAVTKTAVLGGGLMGAGIAHVSAVKAKVPVRIKDVAEQGISNAMNYTYKILDKRLKRRIMSKADMQLTMNRITGTTDYSGFKHIDLVIEAVFEDLALKQGMVADVEQQCQENTIFASNTSSLPISQIAANATRPENVIGLHYFSPVEKMPLVEIIPHEGTSQETIARVVNFARKQGKTPIVVKDMAGFYVNRILAPYLNEAANLMLAGEPIEKIDAALVEFGFPVGPLALLDEVGIDIGSKIAPILEKELGERFKGPDAFSRMIDSKRLGRKTGRGFYDYEKKGKKVDESVYELLGVTPNSRLNKNEIAQRCVAQMLNEAARCLDEGIIASPRDGDIGAIFGIGFPPFLGGPFSYMDKLGTSKVSSDMSTLANSNAIFAPCESLVSMAESGETFYGEKPTQNETVAEVVKLETSEQEADVVPEEQSDVAKDDTK

SEQ ID NO: 38605 - protein, 118 aa, Candida rugosa
MLSRFASLRSVAGRLAVARPAVRVMTPFRSYAVDAHAKEAAAERVFDILESYAKITDPSKITLDASFTTDLHLDSLDVAEVVMQLEEEFSIEIPDEEIDEITTVGGAVDYVLRQPDAV

SEQ ID NO: 38606 - protein, 286 aa, Streptococcus salivarius
MITLKSAREIEAMDRAGDFLASIHIGLRDLLKPGVDMWEVEEYVRRRCKEENVLPLQIGVEGSIMDYPYATCCGLNDEVAHAFPRHYILKDGDLLKVDMVLSEPIDKSVLDVSKLDFDNVAQVKKYTESYSGGLADSCWAYAIGTPSDEVKKLMEVTREAMYLGIEQAVVGNRIGDIGAAIQEYAESRGYGVVRDLVGHGVGPTMHEEPMVPNYGVAGRGLRLKEGMVLTIEPMINTGTWEIDTDLETGWAHKTLDGGLSCQYEHQFVITKDGPVILTSQGEERTY

SEQ ID NO: 38607 - protein, 400 aa, Candida rugosa
RPIYLDMQATTPTDPRVVDKMLPFSIGLYGNPHSSTHSYGWETEKEVEAARAHIANVIKADPKEIVFTSGATESNNTAIKGVARFYGKTKRHIITTQTEHKCVLDTCRRLQDEGFDVTYLAVNEDGLINLEELEKAIRKDTALVSVMSVNNEIGVVQPLAEIGAICRKNKVFFHTDSAQAFGRLDLDVNAQQIDLMSISSHKIYGPMGIGALYVRRRPRVRIEPLINGGGQERGLRSGTLAPALIAGFGEAARLMTSEYASDMAHITKLSEKLKAGLLSIPETTLNGSAIHRYAGCVNISFAYVEGESLLMALKDIALSSGSACTSASLEPSYVLHAIGKDDALAHSSIRFGIGRFTTEEEIDYVVKAINERVEYLRELSPLWEMVQEGIDLSTIEWSGH

SEQ ID NO: 38608 - protein, 288 aa, Zea mays
MATWRLRRAGAALAASSTLAAVLAASSASATDPSAAALEAARQRVARSGATPPLRDAQRAALAGSTPAEPLDVLVVGGGATGCGVALDAATRGLRVGLVEREDFSSGTSSRSTKLIHGGVRYLEKAVFNLDYGQLKLVFHALKERKQVIENAPHLCHALPCMTPCFNWFEVVYYWFGLKLYDLVAGRRLLHLSRYYSVDESVELFPTLAKNGHNCSLKGTVVYYDGQMNDSRLNVGLACTAAVVGAAVLNYAEVVSLIKDESGERIIGARVRDTLSGRIKYVLSLLTI

SEQ ID NO: 38609 - protein, 337 aa, Shewanella oneidensis MR-1
MTILVTGGAGYIGTHTVVELLNAGSEVIVLDNLSNSSIEALDRVERITGKSVTFYQGDILNKALLQKVFSDHSIDAVIHFAGLKAVGESVAKPLKYYENNVTGTLILCQVMAEFKVKNLVFSSSATVYGDPASLPITEDFPTGATNPYGQSKLMVEHILADLHHSDPSWNIARLRYFNPVGAHASGLIGEDPNDIPNNLMPFIAQVAVGKREALSVFGNDYPTHDGTGVRDYIHVVDLAIGHLKALEKLATKPGLVTYNLGTGQGYSVLDMVKAFEKACGKSIAYLIAPRRPGDIAACYADPDHAKTDLDWQATHSLEDMANSSWHWQSTNPNGYKG

SEQ ID NO: 38610 - protein, 859 aa, Saccharomyces cerevisiae
MSRKSSTEYVHNQEDADIEVFESEYRTYRESEAAENRDGLHNGDEENWKVNSSKQKFGVTKNELSDVLYDSIPAYEESTVTLKEYYDHSIKNNLTAKSAGSYLVSLFPIIKWFPHYNFTWGYADLVAGITVGCVLVPQSMSYAQIASLSPEYGLYSSFIGAFIYSLFATSKDVCIGPVAVMSLQTAKVIAEVLKKYPEDQTEVTAPIIATTLCLLCGIVATGLGILRLGFLVELISLNAVAGFMTGSAFNIIWGQIPALMGYNSLVNTREATYKVVINTLKHLPNTKLDAVFGLIPLVILYVWKWWCGTFGITLADRYYRNQPKVANRLKSFYFYAQAMRNAVVIVVFTAISWSITRNKSSKDRPISILGTVPSGLNEVGVMKIPDGLLSNMSSEIPASIIVLVLEHIAISKSFGRINDYKVVPDQELIAIGVTNLIGTFFHSYPATGSFSRSALKAKCNVRTPFSGVFTGGCVLLALYCLTDAFFFIPKATLSAVIIHAVSDLLTSYKTTWTFWKTNPLDCISFIVTVFITVFSSIENGIYFAMCWSCAMLLLKQAFPAGKFLGRVEVAEVLNPTVQEDIDAVISSNELPNELNKQVKSTVEVLPAPEYKFSVKWVPFDHGYSRELNINTTVRPPPPGVIVYRLGDSFTYVNCSRHYDIIFDRIKEETRRGQLITLRKKSDRPWNDPGEWKMPDSLKSLFKFKRHSATTNSDLPISNGSSNGETYEKPLLKVVCLDFSQVAQVDSTAVQSLVDLRKAVNRYADRQVEFHFAGIISPWIKRSLLSVKFGTTNEEYSDDSIIAGHSSFHVAKVLKDDVDYTDEDSRISTSYSNYETLCAATGTNLPFFHIDIPDFSKWDV

SEQ ID NO: 38611 - protein, 302 aa, Shewanella oneidensis MR-1
MKQHQIRKAVIPVAGLGTRMLPATKAIPKEMLPVVDKPLIQYVVSEAIAAGIKEIVLVTHASKNSIENHFDTSFELEAQLERRVKRQLLEAVQSICPKDVTVISVRQSQAKGLGHAILCAKSVVGDAPFAVLLPDVIIDEASCDLKTDNLASMVSLFDETQVGQIMVEGVPHHLVNQYGIADVNGHDLQPGESEPLVELVEKPPVDEAPSNLAVVGRYVLPAAIWPLLAKTPAGAGDEIQLTDAIAMLMKEETVNAYYMQGKSHDCGNKQGYMRANVEYALRHSEIGEDFAHYLKTVVKGIK

SEQ ID NO: 38612 - protein, 384 aa, Sulfolobus solfataricus P2
MDKLLLHVGPTTIKEDVLVAGLENNVGFTSKEFVEALAYSLKGLRYVMGASKNYQPLIIPGGGTSAMESVTSLLKPNDKILVVSNGVFGDRWEQIFKRYPVNVKVLRPSPGDYVKPGEVEEEVRKSEYKLVALTHVETSTGVREPVKDVINKIRKYVELIVVDGVSSVGAEEVKAEEWNVDVYLTASQKALGSAAGLGLLLLSPKALSILDSQNSIAGYYLDLRNWLPVMRGAEEGKAAYFATPPVHVILQLAEAFRLIEKEGIENRIKRHTMVASAIRAGLEALGLEIVARRPESYSNTVTGVILKVADPQKVLAGTVNEGVEFAPGVHPAFKYFRIGHMGWVTPNDAIIAISVIERTLRKLGEPIRFGEGVKAVEEVLFSAR

SEQ ID NO: 38613 - protein, 246 aa, Ostreococcus tauri
MAEHLASIFGTEKDRVNCPFYFKIGACRHGDRCSRLHNKPSASQTVLLTNMYRAEGAGGTVDPRDAASGKSASASAGQGHFEAFVEDLFEELDECGEIEGVNVCDNATDHMAGNVYVKFVDEDGARRALEKLQGRYYDGRPILVEYSPVTDFKESTCRQYEENSCTRGGYCNFMHLRPIGRSMRKQLRRRATGSSTMDASTRRGCPTTHDEPCSRSGTKRVRIDFLELKFLCVRIASTDHSRAKKY

SEQ ID NO: 38614 - protein, 640 aa, Novosphingobium aromaticivorans DSM 12444
MSQEPATPLLDTVKTPDDLRKLAPTQLRQLADELRVEMISAVGQTGGHLGSGLGVVELTVAIHYVFNTPEDRLVWDVGHQAYPHKILTGRRDRIRTLRQAGGLSGFTKRSESEYDPFGTAHSSTSISAALGFAIANKLSGRLGKGIAVIGDGAMSAGMAYEAMNNAEAAGNRLIVILNDNDMSIAPPVGGLSAYLARLVSSGPFLGLRDIARRLSRKLPRPLHEAARKTDEFARGMAMGGTLFEELGFYYVGPIDGHNIDQLIPVLENVRDAAEGPCLIHVVTQKGKGYAPAEAAADKYHGVQKFDVITGEQVKAKAAAPAYQNVFGETLAKLADADPTICAITAAMPSGTGVDKFAKAHPDRTFDVGIAEQHAVTFAAGLAAEGMRPFCAIYSTFLQRAFDQVVHDVAIQNLPVRFAIDRAGLVGADGATHAGSFDVTYLATLPNLVVMAAADEAELVHMTYTAALHDSGPIAFRYPRGNGVGVPLPEVPERLEIGKGRIIRQGSKVALLSLGTRLAEALKAADQLDARGLSTTVADLRFAKPLDVALIRQLMTTHDVIVTVEEGSIGGLGAHVLTMASDEGLVDGGLKIRTMRLPDLFQDHDAPEKQYDEAGLNAPHIVDTVLKALRHNSAGVSEARA

SEQ ID NO: 38615 - protein, 396 aa, marine gamma proteobacterium HTCC2080
MNPGLEALQPYPFQRLSQLFSGVSAANLPEIALTIGEPQHQPPRLVTEALMEALTGINHYPSTTGTPELRNSIARWLEQRFNLQHVDADRQVLPVNGTREALFAIAQTLVTPGAPGRVISPNPFYQIYEGAALLAGTDPKFVPANSASGFKPDFSDVTSDDWQRLELLYICNPGNPSGAVMSEKELSTLIALAQEHDFVIVSDECYSEIYPDESAPPAGLLTAAANMGHTDYAKCLCFHSLSKRSNLPGLRSGFVAGDADVIHKFTRYRTYHGCAMPPHHQVASTVAWSDENHVLANRSAYRAKFEAVVPILAQQLEVTAPDAGFYLWPSTPIDDLDFSRELLRRCNVAVLPGQFLGRWVNGENPGANRIRIALVAEQGICTEAAQRMVQVLEQGW

SEQ ID NO: 38616 - protein, 259 aa, marine gamma proteobacterium HTCC2080
MAVTPKTPQELQGMRVAGRLAADVLEMIEPLVKVGMTTGELDRICHDYIVNVQQAIPAPLNYHGFPKSICTSVNEVICHGIPSDSKKLRNGDIINIDVTVIKDGWHGDTSIMVGVGDVAPHAERLMRITQECLYKALAIVRPGTTLGDIGHVIQQYAEENYYSVVREYCGHGIGQIFHEEPQILHYGSPGVGEVLREGMTFTIEPMINAGKRHTKLNTKDGWTVTTRDGRLSAQWEHTLAVTAEGCEVFTQRTPETLPC

SEQ ID NO: 38617 - protein, 172 aa, Synechococcus sp. WH 8102
MIEGLEPVPLQELRVLGAPSYWTVEGHLDQLTSLTPVRGQLKAEHRGNVLIVDGELSTIVNLCCDHCLGQYNHQLRCSSSELIWLGQSPPTEEELQNSEDIAAMEGLAECLDPRGDFDPQQWVFEQLNLQLPVVNHCGEHCPGPPIRPEAAVQASAEPLDPRWAALRGLQQP

SEQ ID NO: 38618 - protein, 502 aa, Petunia x hybrida
MEIQLSSLVPFLLFLSSIFLLLRKWKTQELNLPPGPWKLPFIGSLHHLVFAGPLPHHGLTNLAKRYGPLMLLQLGEQPTVFISSPQMAKEVLKTHDLAFATRPKLTFAEIIKYGSTDIAFSPYGEYWRQIRKICVMELLSAKMVNSFSSIREDELSNMISWIRLRPNIPVNLTEKVKWFTSSVVCRSALGKICKDQNKLIILMREILSLAISVNFADFFPRWKFLHDLGGSKTRLLKEHHKIDEILQDIVNEHKQNRVNGKMGNGEFGGEDLIDVLLRVRESGQHQLPITDDNIKAVIVDMFSAGTETSSTTIIWALAEMMKKPSVLAKAQAEVRQAMKGKKGFQLIDLDELKYLKLVIKETLRMHPPIPLLIPRECMEETKINGFNIPLKTRVIVNIWAIGRNPESWEDPESFMPERFENNPIDFTGNHHQFIPFGAGRRMCPGMLFGLTNVAQLLAQLLHHFDWKLPNGQSPQDLDMTESPGVSATRKDDLVFVATPYDS

SEQ ID NO: 38619 - protein, 293 aa, Dryopteris caudipinna
  misc_feature (171)..(171): Xaa can be any naturally occurring amino acid
VGILPLSLQYGFSVANKFLQGAQSIDNHFKTAPFEKNIPVLLGLLSVWNVSFLNHPARAILPYCQALEKFAPHIQQLSMESNGKGVSIEGVPLSFEAGEIDFGEPGTNGQHSFYQLIHQGRVIPCDFIGIIESQQPVYLKGEVVSNHDELMCNFFAQADALAYGKTPEELXAEGVPEHLVPHKTFSGNRPSLSILLPKLTPYTLGQLLSIYEHRIAVQGFIWGINSFDQWGVELGKSLASHVRKQINASRSQGKSVAGFNYSTSTLLNHYLKVKSNVYTSTHDSFPPAILPPK

SEQ ID NO: 38620 - protein, 390 aa, Bifidobacterium longum DJO10A
MSRRAREANPFRAMVFGEQADKMIAQGTSVIKLSLGEPDFGAPPAVRDAMREQYDGRALPYTAAMGLPELRQAIADFYRERHDLDIDPKRICVTAGGSAALLLATALTVDPGDDVIVADPSYPCNRELVRSFEGRVIDVPTSAATRFHLTADLCSQYWTSKTKAVMITSPSNPTGTTIDFNVLDEVCKLAASRGAWRIVDETYLDLADREPDGTEVKSVLACDPDAIVCNSFSKFFGMTGWRLGWAILPDEPTVLEAVDDLATNYYLCAHTPTQHAALACFTPESLAECEARRQELLARRRIVIDGLKRIGLPVEVEPNGAFYAYFNISRTGLDAWTFCERALDEAHVALTPGRDFGAATADTHVRLSYAASREALTEGLERLGTFVESL

SEQ ID NO: 38621 - protein, 364 aa, Pseudomonas putida GB-1
MSEQELKALRVRIDSLDEKILELISDRARCAEEVARVKTASLKEGEKPVFYRPEREAAVLKRVMERNKGPLGNEEMARLFREIMSSCLALEEPLKVAYLGPEGTFTQAAAMKHFGHAVVSRPMAAIDEVFREVAAGAVNFGVVPVENSTEGAVSHTLDSFLEHDMVICGEVELRIHHHLLVGENTKTDSITRIYSHAQSLAQCRKWLDAHYPNVERVAVSSNAEAAKRVKGEWNSAAIAGDMAANLYGLTRLAEKIEDRPDNSTRFLMIGSQEVPPTGDDKTSIIVSMSNKPGALHELLVPFHQNGIDLTRIETRPSRSGKWTYVFFIDFVGHHRDPLIKAVLEQISQEAVALKVLGSYPKAVL

SEQ ID NO: 38622 - protein, 545 aa, Phaeodactylum tricornutum
MAPQQRNPVLNEDGNTGMRRVDSEASDMSELGNDTRAQDYRIRKSSLIGMIDWGHVMVSHLPLLMVVGILTLVAQIVHQVVIELGLQNIDWSVQTVSTICHAIKELFRDLYASIMESRGFDLFSPAVKTTALLLFLGAWWMRRKSPVYLLSFATFKAPDSWKMSHAQIVEIMRRQGCFSEDSLEFMGKILARSGTGQATAWPPGITRCLQDENTKADRSIEAARREAEIVIFDVVEKALQKARVRPQDIDILIINCSLFSPTPSLCAMVLSHFGMRSDVATFNLSGMGCSASLISIDLAKSLLGTRPNSKALVVSTEIITPALYHGSDRGFLIQNTLFRCGGAAMVLSNSWYDGRRAWYKLLHTVRVQGTNEAAVSCVYETEDAQGHQGVRLSKDIVKVAGKCMEKNFTVLGPSVLPLTEQAKVVVSIAARFVLKKFEGYTKRKVPSIRPYVPDFKRGIDHFCIHAGGRAVIDGIEKNMQLQMYHTEASRMTLLNYGNTSSSSIWYELEYIQDQQKTNPLKKGDRVLQVAFGSGFKCTSGVWLKL

SEQ ID NO: 38623 - protein, 438 aa, Mycobacterium tuberculosis H37Rv
MHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKQKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 38624 - protein, 573 aa, Cucurbita pepo
MGNTCVGPSISKNGFFESVSAAMWRSKTPENSVSNHTNGENVREVVASEPESPLPVQNQPPEKVTMPESVAKPEPPMEPKVRPVMKRVGSAGLRGGSVLQTKTGNFKEYYSLGKKLGQGQFGTTYMCVEKATGKEYACKSIAKRKLVNEDDVEDVRREIQIMHHLSGHPNVISIKGAYEDAVAVQVVMELCAGGELFDRIIQRGHYTERKAAELTRTIVGVLEACHALGVMHRDLKPENFLFVSKEEESLLKTIDFGLSMFFKPGEKFNDVVGSPYYVAPEVLRKRYGPEADVWSAGVIVYILLSGVPPFWAESEEGIFEEVLHGDLDFSSDPWPSISDSAKDLVRRMLVRDPRKRLTAYEVLCHPWVQVDGVAPDKPLDSAVLTRLKQFSAMNKLKKMAIKVIAESLSEEEIAGLKEMFKMIDTDNSGQITFEELKAGLKKFGANLKESEIYDLMQAADIDNNGTIDYGEFVAATLHLNKIEKEDHLLAAFSYFDKDGSGFITHDELQQACKEFGIEDLQMEEMMREVDQNNDGSIDYNEFVAMMQKGNVVNTGKKGLQSSFSIGFREALKL

SEQ ID NO: 38625 - protein, 502 aa, Mycobacterium tuberculosis H37Rv
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSPMLTSTLTANAIVAAFSLTMLRVLGGAGVFAVFGTFAVVAFVVVYRFAPETKGRKLEEIRHFWENGGRWPAERSPAADEP

SEQ ID NO: 38626 - protein, 423 aa, Lentisphaera araneosa HTCC2155
MRDPQAESLLAYIDASPSPFHAVANTKEQLKAADFTELDESDEWKLEAGGAYYVERSGGSIIAFRLPEIHKEVKFHIVGAHTDSPCFKMKPNAATSVGNYHQWGAETYGGLLKNSWLDRDLHLSGRLTLIINGEMVTKLVSLDSYQFRIPQLAIHLDDNREALKLNAQQHLMPIFGLDKEQDLLQIILDEHKIKATSTEVAAFDLFLHDSQKSAFGGLNDEFIYAPRLDNLAMCHASLEALIKSKPHSAVSMAALFDHEEVGSVSDRGACSSFLPAILERISLSLKGEREAYLAALSRSYLLSADMAHAVHPNYAERHDKDHHPLINHGPVIKHNANQRYATNSETAAYFNLLCQESGIMVQEFVSRNDCPCGSTIGPSVASKLGIKTVDVGNPMLSMHSIREMAGSKDHAKMICVFEEFFCK

SEQ ID NO: 38627 - protein, 141 aa, Cucumis melo
MAEEFQESEVIFSDLRDHTRYLRRDDDDFFNFNSRRGIILAPPRTKYHHRTTMRDGCVRLSKKEIARSLPVRIPERSFHRTAEEDDDMDEEEIIPPHLVTERRVARKMAFSVCTGNGRTLKGRDLSRVRNSILRMTGFLET

SEQ ID NO: 38628 - protein, 498 aa, Scrophularia californica
  misc_feature (1)..(8): Xaa can be any naturally occurring amino acid
  misc_feature (10)..(10): Xaa can be any naturally occurring amino acid
  misc_feature (67)..(67): Xaa can be any naturally occurring amino acid
XXXXXXXXGXGVSTLEKKNLGRIVQIIGPVLDVAFPPGKMPNIYNALVVKGRDTAGQPINVTCEVQXLLGNNRVRAVAMSATDGLTRGMEVIDTGAPLSVPVGGATLGRIFNVLGEPVDNLGPVDTSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINQENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 38629 - protein, 298 aa, Lentisphaera araneosa HTCC2155
MQNQEINFAVIADVQYSDEDNLELCHFRQSPEKLYDAVSDINQSDAQFTVQLGDFINQYEKSYEIVLPIWDELLKPSRHVLGNHDLMVSDQFKQKVAPLLGLQKTWYSESLNDWRFIYLDGNDISFSASCEGTAEYEEVEKYYQAHGAPSPRWNGALGEEQLQWLENELQIATRSEQKAMIFCHFAVYPFSEFCLWNAPYIVSIIDKYTCVKAWFNGHEHDGNYQQRNHCHYLSFKGMVDTDESSFAFVSLKEESIEITGMGREISRSLAIAEPIPDELLTSPHKKAKTARKPPKFLV

SEQ ID NO: 38630 - protein, 481 aa, Dictyota dichotoma
MSENLNREPELNIGYITQVIGPVIDAVFSAGQLPKIYNALEVKSKDGTTIICEVQQLFNDNRVRAIAMSATDGLQRGVEVIDTQAPILVPVGKATLGRIFNVLGQTVDNIEIGTGEDRLPIHRPAPSFTDLETKPAIFETGIKVVDLLAPYRRGGKIGLFGGAGVGKTVLIMELINNIAKAHGGVSVFGGVGERTREGNDLYMEMKESGVINESNLSESKVALVYGQMNEPPGARMRVGLTALTMAEYFRDINRQDVLLFIDNIFRFVQAGSEVSALLGRMPSAVGYQPTLGTEMGALQERITSTTQGSITSIQAVYVPADDLTDPAPATTFAHLDATTVLSRGLAAKGIYPAVDPLDSTSTMLQPVIVGSEHYDTAQLVKKTLQRYKELQDIIAILGIDELSEEDRLVVDRARKIERFLSQPFFVAEVFTGSPGKYVDLENTIKGFNMILNGELDVYQSIAFYLVGDINEAIAKAKTITN

SEQ ID NO: 38631 - protein, 518 aa, Rhodococcus sp. RHA1
MWRASPEELRAGAPERETVPLAGVPHVSTPPSPSHRDGVIDISEHTLTQQPTTSDRVSPPLHGPEIVARLDRLPVLKPHIVWIGLIAINLMIEYYDNGLFIYIAPALQSDANLTTGQIGTIGSVFFVGMLVGALIGGRLADRFGRRTVLVWATVVYSLASLMSAAMPEYSWLLVSRIITGIGVQAATSVLLVYIAEMFPSKSRGRFVAIATIAFTLTAPILGALSLYMLPNSAPGTWRYLFLFGTVGLLIAPAVRLLLPESVRWQVGQGDLDAADKQVADLEGRARHAGKPLPTPIVRIETGTQYTLRELVRNKKMLRLVAVVGFGWFGATLGLYMYQNWSVYVLIDSLQYSETDAYTLQFAWSLVYALTPLVTVLLIDRMERKALILWSSAASALPILALGLATSNVVVAIAGGAAGILTGVVFSVYYAYIPETMPTEARGLGTGVIFSLGRLGGVLSGVLGAAIYSADEWGLDRSGLMISAAAVYIVSAIVVFGFGPKTANKSLEEVSARELRPAD

SEQ ID NO: 38632 - protein, 158 aa, Vibrio cholerae O1 biovar eltor str. N16961
MIRIGHGFDVHRFGGEGPIIIGGVKIPYEQGLIAHSDGDVALHALSDALLGAIAAGDIGRHFPDTDDKWKGADSRELLKDVYRRVKAQGYVLGNADVTIIAQAPKMAPYIQAMCAAIAEDLETDLGNINVKATTTEKLGFTGRKEGIACEAVVLLRKA

SEQ ID NO: 38633 - protein, 498 aa, Symphoricarpos albus
  misc_feature (1)..(10): Xaa can be any naturally occurring amino acid
XXXXXXXXXXGVSTLEKKNLGRIVQIIGPVLDVVFPPGKMPNIYNALVVKGRDTAGQPINVTCEVQQLLGNNRVRAVAMSATEGLTRGMEVIDTGAPLSVPVGGATLGRIFNVLGEPVDNLGPVDTRTTSPIHRSAPAFIELDTQLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNKQNVLLFIDNIFRFVQAGSEVSALLGRMPSAVGYQPTLSTEMGTLQERITSTKKGSITSIQAVYVPADDLTDPAPATTFAHLDATTVLSRGLAAKGIYPAVDPLDSTSTMLQPGIVGQNHYETAQRVKQTLQRYKELQDIIAILGLDELSEDDRLTVARARKIERFLSQPFFVAEVFTGSPGKYVGLTETIRGFQLILSGELDVLPEQAFYLVGTIDEATAKAMNLEMESNLKK

SEQ ID NO: 38634 - protein, 542 aa, Triticum aestivum
MSAAQLLRHSRKLRSLRNSVDCERTSLARYFSTGSGSSAVKENGVEKRIGGARFSQYKQPGKELETFKVSLGGANGSSTCRRMLINRVPSAVTGLNGSLSCGRVASARSFSSSADLPPHQEIGMPSLSPTMTEGNIAKWIKKEGDKVSPGEVLCEVETDKATVEMECMEEGYLAKIVQGDGAKEIKVGEVICVTVEEEGDIEKFKDYKPSAADAPAAPSESKATPEPAAPKVEEKVPAKAPEPKAPKAEKASRSGDRIFASPLARKLAEDNNVQLSSVKGTGPDGRILKADIEDYLAKGGKSEAFAASGLDYTDIPNAQIRKVTANRLLASKQTIPHYYLTVDTRVDKLIKLRGELNPLQEASGGKKISINDLVIKAAALALRKVPECNSSWMNDFIRQYHNVNINVAVQTEHGLFVPVVRDADKKGLGTIGEEVKQLAQRARDNSLKPQDYEGGTFTVSNLGGPFGIKQFCAIINPPQSAILAIGSAEKRVIPGSADGQYEFGSYMSVTMSCDHRVIDGAIGAEFLKAFKGYIENPTTMLL

SEQ ID NO: 38635 - protein, 483 aa, Nostoc sp. PCC 7120
MQKLNGLLTNDIIEESAWEALEKSILYYKGRPVGTVAAFDASVEALNYDQCFVRDFVSSALIFLIKGKTDIVRNFLEETLKLQPKDRQLDAYKPGRGLIPASFKVVSDNGEEYLEADFGEHAIARVTPVDSCLWWILLLRAYVVASKDFSLAYQPEFQTGIRLIMEICLANRFDMYPTLLVPDGACMIDRRLGIYGHPLELQVLFYAALRAAREMLICQGNQDVVEAIDNRLPLLCAHIRQHYWIDINRLNAIYRFKSEEYGKAAVNLFNIYVDSIPYYELDKWLPKKGGYLAGNVGPSQLDTRFFALGNLMAIISDLATEEQSQAIMTLIEDRWEDLVGDMPMKICYPALENEEYRIVTGCDPKNIPWSYHNAGSWPVLMWMLAAASVKAGKPYIAGKAIEIAQARLLEDEWPEYYDGKKGRLIGKQARKYQTWTIAGFLLAAELMKNPSLLSLISFDKLPSELVSRACEFEIGSVDASISR

SEQ ID NO: 38636 - protein, 297 aa, Ostreococcus tauri
MPDVDGFKLLEIIQFELNLPVLMMSANSDSSVVLRGIIHGAVDYLLKPVRIEELRNIWQHVVRRDYSARNSGSEDGVNPSSPSKRLKTSGSDSKSEEVERAANEAGSSKARKKPAGKKGAKGSKEKEAERKGDAIDSSKKPRVVWSAELHTQFVTAVNQLGIDKAVPKRILDLMGIQGLTRENVASHLQKYRLYLKRLQGNDLMRNGSNASSSGGVSQSRAKEQPMTIKGKNVNPFLDDNIFRADDLGLPGDLGNIGYDASFDPSLLAPLDLDKVGKSDVLGADPSDNILNFFFQGD

SEQ ID NO: 38637 - protein, 499 aa, Shewanella oneidensis MR-1
MTTQVKHYIDGEFTAGTGTSQIVVTNPANNATIAVINSATADEVHAAIASAKAAFKTWKEVPVSERARVMLRYQHLLKEHHDELATILAHETGKTFEDAKGDVWRGIEVAEHACNIASLLMGETVENVARSIDTYSYTQPLGVCAGITPFNFPAMIPLWMFPLAIACGNTFILKPSEQDPMTPQRLVELFVEAGAPKGVLQLIHGDKTAVDILLADPAVKAISFVGSVAVGQYIYKTGTDNLKRVQAFAGAKNHCVIMPDANKQQVINNLVGASVGAAGQRCMAISVAVFVGAAKEWIPELKEALAKVRPGLWDDKDAGYGPLISPAAKVRVLKLIAQGKEEGAQCLLDGSDFTVAGFESGNWVGPTMFTKVTTDMSIYKEEIFGPVLCCMESDSLEDAIELVNASPYGNGTSIFTASGAAARKYQHEIEVGQVGINVPIPVPLPFFSFTGWKGSFYGDQHAYGKQAVRFYTETKTITARWFESDIAVAAGPNMSINLR

SEQ ID NO: 38638 - protein, 565 aa, Solanum tuberosum
MSKQTYKVGFFFRRQFTMAAAEAPADIKNLFKRYSDDSGVMSVQNLHRFLIEIQKEKNASLDNAEAIINNHGGDSKQKGLQLDGFFNCLFSDVNPPLDPKLGIHHDMNAPLSHYYIYTGHNSYLTGNQLSSDCSDIPIIQALQRSVRVIELDIWPNSDKDDIEVLHGRTLTAPVALIKCLRSIKEHAFSASEYPVVITLEDHLTPDLQEKVAEMITQTFGDMLFSPSESLKELPSPESLRKRVMISTKPPKEYLQSKEVKEKDDTKKEAEQDDVDEEEDEDEDEDDEEDPKSEKKAASEYKRLIAIHAGKGKGGLSDWLRVDLNKVRRLSLSEPELEKAVDTHSKEIIRFTQQNLLRIYPKGIRVDSSNYDPFVGWMHGAQMVAFNMQGYGRSLWLMHGMFRANGGCGYVKKPDLLLKAGPNNEVFDPTANLPVKTTLKVTVYMGDGWDKDFDQTHFDTYSPPDFYAKLGIAGVPADEVKKRTKTMDDNWIPSWDEQFEFPLTVPELALLRIKVLDYNLSDKDEFAGQTCLPVAELRQGIRAVPLYDRKGEKYSSVKLLMRFEFI

SEQ ID NO: 38639 - protein, 604 aa, Ostreococcus tauri
MTDAKRAKTTDGRPSATEGVDAVVVLDYGSQYTQLIARRVRELGAYSVLLPGDADMARIEALKPKAIVLSGGPNSVHVEGAPTVPDGFFERVAETSTPVLGVCYGMQLLVQRLGGVVEAAVGKGEYGRMPVVYQSDDSLLYGKGSKAGDSEQVWMSHGDEATKLPSGFVCVGKSEAGAVVAIEDADRKLFGLQYHPEVTHSEKGTEMLRRFLFDIAGVKAEWSMQNVLDEQIAIVNEKVGKDAHVICALSGGVDSAVAATLVHKAIGDRLHCVFVDNGLLRYKEQERVMEMFKDHLHLPVDCVDHSEQMLKALAGVSDPEKKRKIIGAEFIECFKNFKSEIEKRTGVRPTFLVQGTLYPDVIESCPPPGSDQKHSHTIKSHHNVGGLPKELGFELVEPLRMLFKDEVRKLGALMDVPRTFLARHPFPGPGLGVRIVGDVTANNALDILRRADEIYINTIREFGLYDEIWQAFAYFLPVRTVGVQGDQRSHSFMIGLRAVCSSDGMTADWYPFPTEFLKTVSSRITNQVKEVNRVLYDINSKPPATIENFAQTAPSRHSASRARPGGAEGHYLSVSREIRPFKFEFETRAHEHAIHVNAGKVFVV

SEQ ID NO: 38640 - protein, 454 aa, Gibberella zeae PH-1
MARKRTKKRTHLGASNPDVDSAGHASAKDPKSMVIRIGAGEVGSSVSQLAADVRKVMEPGTASRLKERRGNRLKDYAVMCGPLGVTHLMLFSRSETGNTNLRMALTPRGPTLNFRVEKYSLCKDVQRAQKHPKGGGKEFITPPLLVMNNFTRPDSDNKSKVPRHLESLATTVFQSLFPPINPQATPLKSIRRVLLLNRETSEEDDGTFIVNFRHYAITTKSTTVSKPLRRLNAAEQFVTSKTNRKGKMPNLGKLEDVADFLIGGEAGDGYMTDATSGSEMDTDAEVEILDSTTRKVLSAKARQAAAQNETEPEAEEENVERRAVKLVELGPRMRLRLTKVEEGLASGKVMWHEYIHKNKDEIKELEKRWEQRRQEKDARKKEQKANVERKKAAKTKDGNKGEDDDEEDEFEYDSDMDVDEFDSEGLAGDAEFKVNEKMEEDGEWEDEEEEIANS

SEQ ID NO: 38641 - protein, 585 aa, Solanum tuberosum
MSKQSYRVCFCFRRRFRVLAAEAPADVKNLFNRYSDNGVMSAENLHRFLIEVQKEENATLEDAHAIMNNLHDLKILNIFHRRGLHLDAFFKYLFADINPPLNSKLGIHQDMNAPLSHYFIYTGHNSYLTGNQLSSDCSDVPIIQALHRGVRVIELDIWPNSAKDDVEVLHGGTLTTPVALIKCLKSIKEHAFTVSEYPVVITLEDHLTTDLQAKTAEMITQTFGDMLFSSDSCLKEFPSPESLKRRVLISTKPPKEYLQAKEVNETGAMKGTDQTDTEAWGREVSDIKARYNDKDDSDEGEADDSDEEDPTSQQNTAPEYRRLIAIHAGKGKGGLSDWLRVDPDKVRRLSLSEQELGKAVVTHGKEIIRFTQRNILRIYPKGIRFDSSNYNPFNAWTHGAQMVAFNMQGYGRSLWLMHGMFRGNGGCGYVKKPDILLKAGPNNEVFDPEANLPVKTTLKVTVFMGEGWYYDFEHTHFDAYSPPDFYARIGIAGVDADIVMKKTKTLEDNWIPTWDEQFEFPLTVPELALLRVEVHEYDMSEKDDFAGQTCLPVSELRQGIRAVPLHNRKGEKYNSVKLLLRFEFI

SEQ ID NO: 38642 - protein, 295 aa, Vibrio cholerae O1 biovar eltor str. N16961
MSDFPTLEDYVGQTPLVRLQRLNAGRSTVLVKLEGNNPAGSVKDRPALNMIVQAEARGSLQPGDTIIEATSGNTGIALAMAAAIKGYKMILIMPDNATQERKDSMRAYGAELILVSKEQGMEGARDLALQMQQEGKGKVLDQFNNLDNPDAHYRSTGPEIWQQSQGKITHFVSSMGTTGTIMGVSRYLKQQNPQIQIIGLQPSEGSAIPGIRRWPQAYLPGIFDAARVDQVLDVTQTDAEQTARALAREEGICAGVSSGGAVFAALQIAQQNPGSVVVAIVCDRGDRYLSSGLFS

SEQ ID NO: 38643 - protein, 371 aa, Campylobacter upsaliensis RM3195
MEISYYEILEITQSADKESIKKAYRKLALKYHPDRNQGDKEAEDKFKLINEAYEVLSDDEKRAIYDRYGKEALKGRAGGSAGFGDFEDIRDIFTSFFGEGFGGRKSRQKNNEDKFNADFVVGLNLSFKEAVFGCTKEIDFTYKNSCKTCNGSGAKDGKMQICPKCQGRGQIVMKQSFLSFAQTCPDCSGSGSCASDKCPQCKGLGYEELKDKVELKVPEGVDSGMNLRVSEKGNITKNGIRGDLFVKIHAEEDETFIRDDEDIYIEFPVFFTQAILGQSVKVPTIRGEATLNLPKGAKDGQRFVLENEGVKNVRSSHIGRQIVQIAIKFPNSLNEEQTKLLEQLSESFGIKDGMHHEQKGLFDKIATWFKG

SEQ ID NO: 38644 - protein, 550 aa, Hordeum vulgare
MATTAALPFSCAATLQTLTRTLSPRRSILIHRHRLRSLAASPRLPDRPRARLCRPVSASAAPNGSSSAGEYDYDLFTIGAGSGGVRASRFASTLYGARAAICEMPFSTISADDLGGLGGTCVLRGCVPKKLLVYASKFSHEFEESHGFGWTYDTDPKHDWSTLIANKNTELQRLVGIYKNILKNAGVDLIEGRGKVVDAHTVSVDGKLYTAKNILIAVGGRPSMPDLPGIEHVIDSDAALDLPSKPEKIAIVGGGYIALEFAGIFNGLKSDVHVFIRQPKVLRGFDEEVRDFIAEQMSLRGVTFHTEHSPQAITKSNDGLLSLKTNKETIGGFSHVMFATGRKPNTKNLGLEEVGVKMDKKGAIVVDEYSRTSVDSIWAVGDVTDRINLTPVALMEGGAFAKTVFGDEPTKPEYRAVPAAVFSQPPIGQVGLTEEQAIEEYGDVDVYLSNFRPLRATLSGLPDRVLMKLIVCATTNKVVGVHMCGDDAPEIIQGIAIGVKAGLTKQDFDATVGVHPTSAEEFVTMRSPTRKVRRKTAAEAESKDEVVAQK

SEQ ID NO: 38645 - protein, 476 aa, Rhodopirellula baltica SH 1
MNQHSPSYAITIRLRYSDSPGAMGKITTAIGEADGAIGAVDIVNIRGGKISRDFTVNARDVDHGKRIVEHLRTVEEVEVVHTSDRVFLMHLGGKIEVLPKMPIKTRDDLSMAYTPGVARVCNAIAEDPDSSFALTIRQNTVAVVSDGSAVLGLGNIGPRAAMPVMEGKAMLFKEFAGVDAFPICLDTQDTEAIIETVRQLAPTFGGVNLEDISAPRCIEIEERLDKELEIPVFHDDQHGTAIVVLAGLKNSLLRVGKALPNIRIVVNGAGAAGTAIVKLLLISGAKDIVVCDRDGAIHAGEPSQPDASKQWIADNTNPRGASGKLSEVIQGADVFIGVSAPNVLQTEDVAAMAADPIVFALANPDPEILPANAAPHVRIMATGRSDFPNQINNVLCFPGLFRGVLDVRATTINNEMKLAAAEAIAATIPESDLLDDYVIPSVFDRRVAKVVAQAVAKAAVDTGVARRRNKPAEDIM

SEQ ID NO: 38646 - protein, 497 aa, Hordeum vulgare
MARKMLKDGEAPVAAADDGGSYDYDLFVIGAGSGGVRGSRTAAGFGAKVAICELPFHPISSEWLGGHGGTCVIRGCAPKKILVYGASFRGEFDDASNFGWEINGDINYNWKKLLENKTQEIVRLNGVYKRILGNSGVTMIEGAGSIVDAHTVEVTQPDGSKQRHTTKHILIATGSRATLVNIPGKELAITSDEALSLEELPKRAVILGGGYIAVEFASIWKGLGAQVDLFYRKELPLRGFDDEMRTVVASNLEGRGIRLHPGTNLTELSKTADGIKVVTDKGDEFIADVVLFATGRAPNSNRLNLEAVGVEVDQIGAIKVDEYSRTSVPNIWAVGDVTNRINLTPVALMEATCFAKTVFGGQTVKPDYKDVPCAVFCIPPLSVVGLSEQEALAEAKNDLLVYTSSFNPMKNSISKRQEKSIMKLVVDAETDKVLGAAMCGPDAAEIMQGIAVALKAGATKATFDSTVGIHPSAAEEFVTMRTLTRRVSPASKPKTNL

SEQ ID NO: 38647 - protein, 291 aa, Geobacter metallireducens GS-15
MQVKKAVFPVAGLGTRFLPATKASPKEMLPLIDKPLVQYVVEEAVAAGIEQILFVTGRGKRAIEDHFDISFELEALLQEKGKNDTLREVRDIAEMVNIFYVRQKQAMGLGHAILCAREFVGNEPFAVLLGDDIIDAEKPCLGQLLDVYRKYRGPVLALEKVPMENISSYGCVRANGITDRIFEVTDLVEKPKREEAPSDMAIIGRYVLTPEIFPILERQEPGKGGEIQLTDALLKLSKDEAIYGCLFEGIRHDCGDKLGFLKATVDMALKREEFNTEFEEYLRERLCRRQD

SEQ ID NO: 38648 - protein, 112 aa, Zea mays
MATAPRRLLPALLKALAPAGARGLSTEKAVGAAAVAVVGSHTAKWMQDTSKKSPMELINKVPPIKVDGRIAVCEGAAEGVGLGHPIEYICLDLEAPNVCKYCGLRYVQIHHH

SEQ ID NO: 38649 - protein, 659 aa, Symbiobacterium thermophilum IAM 14863
MLALIVAGLLAAKIRGQDPGTPRMQEIAAAIHDGAMAFLNREYRTLVVFVLALAIIILIAGFTTDAMQWQTAIAFVAGALCSVLAGNFGMRVATMANVRTANAAQHGLNRALDIAFSGGAVMGLSVVGLGMLGVGVVYLIFRDPDIVNGFALGASSIALFARVGGGIYTKAADVGADLVGKVEAGIPEDDPRNPAVIADNVGDNVGDVAGMGADLFESYVGAVIAAMAIAVVDKDIDPNLAALPLLIAAGGIVASVIGTQFVRGKEGGNPAKALNAGTYAAGILTLIVAAVISFLGYGTHIYFTAVVAGLIAGIAIGQLTEYYTSGDYGPVKSIADASRTGPATNIISGLGVGMMSTALPILVIGAATLVGYLVGAPHGQGLFTIALAAVGMLSTTGMTVAVDAYGPIADNAGGIAEMSHLDPKVRKTTDTLDSVGNTTAAIGKGFAIGSAALTALSLFGAFATAAGLGNVSMTDPKLIVGLFVGGMLPFLFGALTMNAVGRAAMQMVEEVRRQFREIPGIMEEKAKPDYARCVDISTGAALKEMIVPGLMAVAAPLLTGWLLGVTALAGLLAGALVTGVMMAIMMANAGGAWDNAKKYIEAGAHGGKGSEPHKAAVVGDTVGDPFKDTSGPSMNILIKLMTIVSLVFAATFGNGLLPF

SEQ ID NO: 38650 - protein, 333 aa, Burkholderia vietnamiensis G4
MKAALDVVTYGEAMAMFVATEPGHLAHATQFTKRVAGADLNVAIGLSRLGFRVGWMSRVGRDSFGGYVLDTLAREGIDASCVTVDPQYPTGFQLKSRNDDGSDPTVEYFRKGSAASHLCCDDYVADYVLGARHLHLTGVAPAISATSCELAFKLAREMRAAGKTISFDPNLRPTLWPSAEAMATTLNALAALADWVLPGLAEGQQLTGRDAPADIAGFYLAQGARGVVIKLGPDGAYFRTADGREGTVAGERVANVVDTVGAGDGFAVGVVSALLEGKPIEQAVARGNRIGALAIQVIGDSEGLPTRAALDRLEGADAGAAHAERQEETVTAQ

SEQ ID NO: 38651 - protein, 458 aa, Bradyrhizobium sp. BTAi1
MAASEMDQATWAGRSGSSVVASVSWPVATAVVIADMIGVGVFTSLGFQVKDIPSGFAILVLWAVGGLVSLCGALSYAELGTMFPRSSGEYNFLTRAFHPAVGFMAGWVSATVGFAAPVALAAMAFGEYGRAVLPGVSPLMLAVGAVWLVTAVQLGGIRRSGHFQLLSTVLKLGLIVAFLIAGYVITVPQPVSFRPAAADIGHVTSAAFATGLVFVMYAFSGWNAATYIIGELHAPERTLPRALLVGTAVVLVLYMALNAVFLRAVPMQDLAGQLQVASIAGAHIFGETGGRFVAAMICVGLIPSIAAMMWIGPRVLMTMGEDVPALAVFARRSRDGAPTYAVLFQLAVATLMLFTESFEAVLDLVQFSLLCCSFLTVLGLITLRVTKPDLARPYRAWGYPITPLVFLGVTGFMIYYLVTARPWQAGLGALAMVSGLLIYWFAHARPGRAAAAAVSGSE

SEQ ID NO: 38652 - protein, 493 aa, Vicia faba
MSNSNNPPPPKPTWVLPYITENIRELYTLGRKLGQGQFGTTYLCTHNPTGKTYACKSIPKKKLLCKEDYDDVWREIQIMHHLSEHPNVVRIHGTYEDSVSVHLVMELCEGGELFDRIVNKGHYSEREAAKLIRTIVEVVENCHSLGVMHRDLKPENFLFDTVEEDAVLKTTDFGLSAFYKPGEIFSDVVGSPYYVAPEVLHKHYGPEADVWSAGVILYILLSGVPPFWAETEIGIFKQILQGRLDFQSEPWPGISDSAKDLIRKMLDRNPKTRFTAHQVLCHPWIVDDSIAPDKPLDSAVLSRLKQFSAMNKLKKMALRVIAERLSEEEIGGLKELFKMLDADSSGTITLDELKEGLKRVGSELMESEIKDLMDAADIDNNGTLDYGEFIAATVHLNKLEREENLLSAFSYFDKDGSGYITIDEIHVACKEFGLDDIHIDEMVKEIDQDNDGQIDYGEFAAMMRKGNGGMGRRTMTSRLNFRNALGIIGNESN

SEQ ID NO: 38653 - protein, 348 aa, Cucumis melo
MDALRKQASKLKVQVAKQQQAVIKQFGGSGYESSDVMVIDEVEMQRHQQLEKFYKSTRAGRDFQKDIVKAGEAFIAIGYRHIETGNKLSEDCCNYGANNINENILAKASSIYGDACKHVEKEQEDLIKLLSSQILDPLRAMITGPPLEDARHLAQRYSRMRQEAESLAAEISRRRARVREFSNPENVAKLHASEAKMQELKANMAVLGKEASAALAAVDAQQQRLTLQRLVAMVEGEKTYHLRVAAILGEVEAEMVTEKQRKESAPPVISSENHPGKSSFFLAEAVHPFNAASEKELSLSVGDYVVVRKVSPTGWSEGECKGKAGWFPSSYVEKRQRIPTMNTVPESF

SEQ ID NO: 38654 - protein, 562 aa, Thermobifida fusca YX
MTEKTITEQFSFADLGLRPELLDALAEVGYEEPTAIQREAIPSLLEGRDLLGQAATGTGKTAAFSLPILHRLPDSDRGDTPSALILVPTRELALQVSEALHRYGRHLKARILPIYGGQPIGRQLRALERGVDVVVATPGRALDHIGRGTLVLDTVRTVVLDEADEMLDMGFAEDIEAIIEEVPENRQTVLFSATMPDRIEGIARRHLTDPVRVRIARTSPAPGEEPKVRQNAYIVARPYKPAALGRVLDMESPTAALVFCRTREEVDQLTETLNARGYRAEALHGGMSQEQRDRVMARLRGGTADLLIATDVAARGLDIEHLTHVVNYNVPSATETYVHRIGRVGRAGREGVAITLVEPREHRMLKTIQRSTSGPISVEKLPTVADLRARRVELTRAALHEALKEEDDDREAFRVVVESLAEEFDIMEIALAAVKLAHEASGAVTEEEEIPEPVLRPERSERRERRGRRGGPGRGERRGRGPSDGMTRLFVGIGRNARVRPQDLVGAIAGETALSGRDIGAIEIADRFSLVEVPESTADGVIAALKKSTIKGRRTVVRRERF

SEQ ID NO: 38655 - protein, 159 aa, Cucumis melo
MASTQMKSIATLLLLLNFCMYVIILGIGGWAMNKAIDHGFIIGPGLRLPAHFSPIYFPMGNAATGFFVTFALLAGVFGAASAISGLNHIRSWSVESLGAASSAAVFAWTLTILAMGFACKEIALDFRNARLVTMEAFFIILSATQLVYIMAIHGVISTR

SEQ ID NO: 38656 - protein, 496 aa, Escherichia coli O157:H7 EDL933
MITTFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 38657 - protein, 655 aa, Magnaporthe grisea 70-15
MDARPQRPSRAGALQPSGNENIAPVKQVLHQRHKSAGNLKTIYNPATAFPAGGLNVAPKRAVFGEMNTNAKSAAQDLPSKKASMAPVVSHVGKENSGKPAALQKPAQRSSKSYAMLHQQPSAADTHGAALRKATADVLTKPQVTKKTTFVYQDTTAAQLLPEPNQHMIADHPVILPKPDIIKNPRHYKSQPQLKPNQPVLRRTLSRQFAEVASLISSALAEEAQDPPYEDALEEIADINGSRGVPINILGDYMEEPNIEIISHDAIDDYPLEEHVPAPPTAFESEDGWEEEDGDMDDEQGYTTAHSYRSHGENTTGGLTELLAPKATARVQQELEQAKAIVEESRTIEEIEEEQWDVSMVAEYGEEIFEYMRELETRMTPDPHYMDIQTEIQWSMRSVLIDWVVQVHHRFTLLPETLFLCVNYIDRFLSQKVVSVAKLQLVGATAIFIAAKYEEINCPSVNEIIFMVDNGFSADEILKAERFMLSMLQFELGWPGPMSFLRRISKADDYDLETRTLAKYFLEVTIMDERFVGCPPSFLAAGAHCLSRMILEKGDWAHTYWSGYTWSQLRPLVALLFDCCQYPEKHHQAVFEKYCDRRYKGASTFVQRAIARGWTPPFPIQQPFVLDANCFAETIASCRNFSSMEVGRMMATATQA

SEQ ID NO: 38658 - protein, 596 aa, Solanum tuberosum
MSKQTYRICCFQRKFKLKEAEAPDEIKDLFERFSENGIMTAEHLCKFLKDVQGEENVTKEEAETVMESALKLVHEHLNIVFHRKGLNLDGFFRYLFSDLNVSISTDKKVHHDMTAPLSHYFIYTSHNTYLTGNQLNSDCSDVPIIKALQQGVRVIELDMWPNSSKDNVDILHGGTLTPPVELIQCLKSIKEHAFVASEYPVIITLEDHLTPDLQAKAAEMVTQVFGDILFTCGAECLSEFPSPESLKGRIIISTKPPKEYLESKKPSEKDNGSQKGKKSSEEKAWGAEISDLSQKMIAYSENKDNGECQDDEADSHHENPNIQQNIAPEYKHLIAIQAGKSKGPTSEWLTVDPIKVKRISLNEEKLINVALNHGKDLIRFTQRNLLRIYPKGMRVDSSNYNPLMGWMHGAQMVAFNMQGHGRPLWLMQGMFKANGGCGYVKKPELLLKTDANNEVHDPKRLLSVKTTLKVKVYMGKGWHLDFKRTHFDAYSPPDFYVKIGIAGVAADSRVKKTKAIEDNWIPIWNDEFEFPLTVPELALLRVEVHEYDMSEIDDFGGQTCIPVSELRTGIRAVPIYNEKGEKYPSVKLLMRFEFVK

SEQ ID NO: 38659 - protein, 185 aa, Brassica napus
MATKEDVQDPRIPKIASSIRVIPDFPKPGIMFQDITTLLLDTEAFKDTVDIFVERYKGKGISVVAGVEARGFIFGPPIALAIGAKFVPMRKPKKLPGKVISEEYSLEYGTDKIEMHVGAVEPGERAIIIDDLIATGGTLAAAIRLLERVGVTIAECACVIELPVLKGREKLGETPLFILVTSDAA

SEQ ID NO: 38660 - protein, 86 aa, Triticum aestivum
  misc_feature (13)..(13): Xaa can be any naturally occurring amino acid
  misc_feature (25)..(25): Xaa can be any naturally occurring amino acid
  misc_feature (32)..(32): Xaa can be any naturally occurring amino acid
  misc_feature (48)..(48): Xaa can be any naturally occurring amino acid
AKWYRAPPLGPQXVHDGLKEVAPTXVSPAVAXELTRIIYGGSVNGANXCKELAAQPDVDGFLVGGASLKPEFVDIIKSATVKSSSA

SEQ ID NO: 38661 - protein, 388 aa, Synechococcus sp. WH 7803
MHRTLRNSVSLLRSNYATTWSLLLLPAVAAAVIQPGSPESTLGLLLRFLAFGVALVPLARVISILVDQLSEHLGDRYSGVVSVGLGNLVELVVSITALASGLYRLVVISVAGAVITNCLLVLGISTFVAGRREQHVQIDARSTNLQARQLMLSLLFLAVPTIFSLGRGLNPMEGTDQLDNVAVYSLVVAVMILLYYVLSFVLQLGTHRSFFSRSQDQQRLAAVQNAVVPSVAEGHPRQGIAAILIAMVVVSSAVVLVSDPLVETLEVLLKNSPLGELFIGLILLPLFGSTAEGVISIGASAKGRMDLAITSTLESSGQLMMFVLPMLVLLGWPMGRYLHLSVPLIALGCTGFAVVAVHWITENNQLDWYEGIQLITLYGVIVLGTLLL

SEQ ID NO: 38662 - protein, 81 aa, Rhodopirellula baltica SH 1
MASIEERVVDIVSEQLGVDKDKITRETSFVNDLGADSLDTVELVMELEEEFDISIPDDSAEKIQKVGEAIDFIEKEKGEDA

SEQ ID NO: 38663 - protein, 428 aa, Arabidopsis thaliana
MTSLHTLLFSSLLFFIVFPTFTFSSTLLFQSFNWESWKKEGGFYNSLHNSIDDIANAGITHLWLPPPSQSVAPEGYLPGKLYDLNSSKYGSEAELKSLIKALNQKGIKALADIVINHRTAERKDDKCGYCYFEGGTSDDRLDWDPSFVCRNDPKFPGTGNLDTGGDFDGAPDIDHLNPRVQKELSEWMNWLKTEIGFHGWRFDYVRGYASSITKLYVQNTSPDFAVGEKWDDMKYGGDGKLDYDQNEHRSGLKQWIEEAGGGVLTAFDFTTKGILQSAVKGELWRLKDSQGKPPGMIGIMPGNAVTFIDNHDTFRTWVFPSDKVLLGYVYILTHPGTPCIVSIILFYNHYIEWGLKESISKLVAIRNKNGIGSTSSVTIKAAEADLYLAMIDDKVIMKIGPKQDVGTLVPSNFALAYSGLDFAVWEKK

SEQ ID NO: 38664 - protein, 370 aa, Rhodococcus sp. RHA1
MRSETMMITTEAALLTALNEPLEFTEIQVDDPEPNEVRVAVSNVGLCHSDLHYMTGTVGADLPVVVGHEVAGIVESVGSAVTSLRPGDRVVGALTPSCGLCRNCQAGHSTQCQRVSQIRQRPRPAFQLPGGQAVERLADIGAFSRHTLMRENSLVTVPDEVGLHVGCLLSCCIVTGVGAVFRGAQVRPGATVAVIGCGGVGSAIIQGARLAGASAIVAVDLDDARLAAARTYGATHVVNGAADVPAEIRNVLGDGVDYSFEAVGNARTAATALAVLRATGTACLVGIAPDGTDLTLPASDFFFGEKRLIGSYMGSGQAHEDITQFARLYLQGRLLLDEMVSDVIPFGEINKGFEAMKSGEVTRIVADLTA

SEQ ID NO: 38665 - protein, 433 aa, Listeria monocytogenes str. 4b F2365
MNWSPKTKAWQELKNTVPYIQKGKIHTVQEQVYISKGPQVKIGDTVMVGENKVLCEVISIEKENNMLLPFNQSDKVAYGDWVYVTDTKITIPADEYLLGKVLNASGDILNEEAGVAKFKQKMPLEAPPIHAFSRAEITDTLETGIKAIDGMLTIGIGQKIGIFAGSGVGKSTLLGMIARNAKADINVIGLVGERGREVKDFLRKDLGEEGLRKSVIVAATSDESHLMQLRAAKLATSIAEHFRDQGKTVLLMMDSVTRFADARRSVDIAVKDLPIGGKTLLMESYMKKLLERSGKTQNGSITGIYTVLVDGDDMNGPVPDLARGILDGHIVLTRELATKNHYPAIDVLGSVSRVMEEIVPESQWKTASKIREWMSIYQENELYFKLGTIEQTSDNAAIFTSKEKSYFIHQFLKQLRDESVTLEETSKLMETLV

SEQ ID NO: 38666 - protein, 148 aa, Ehrlichia canis str. Jake
MSNEYNILIVVSQFYPEITNLLLDGAVDQLKKYSKPVKHDVVYVPGSFEIPAAIVFAIMSDKYKYDGYIALGCVIKGETDHYYYVCKGVAGSLSEIAANHAVPMGFGVITAENLELAMVRADMHKKNVGGNAAKAALTMIELHNKFLS

SEQ ID NO: 38667 - protein, 335 aa, Brassica napus
  misc_feature (141)..(141): Xaa can be any naturally occurring amino acid
  misc_feature (305)..(305): Xaa can be any naturally occurring amino acid
  misc_feature (324)..(324): Xaa can be any naturally occurring amino acid
MAQIPNLENAPLNLKSIREKSQRELVNLLKDIRGTKCLVIDPKLSGSVSLIIQTSTLKELGLELRHLSEEPVQTECTKVVYLVRSQLSFMKHIASHIQNDISKAIQRDYYVYFVPRRSVACEKILEQEKVHNLVTGKEFPXYMVPLDEDVISFELELSEKDCLVDGDVSSLWHVAKAIHELEFSFGVIPKVRAKGKGSVRVADILNRMQVEEPVNTNDVGRPEVDTLILLDREVDMVTPMCTQLTYEGLLNEFLHISNGAVEVDSSVMGSQQEGKKMKVPLNSSDKLFKETRDLNFEVVVQVLRXKATTMKEDYTEINSTQTVXELKDLVKKLNS

SEQ ID NO: 38668 - protein, 386 aa, Vicia faba
GGELFDRIIQRGHYSEKAAAQLARVIIGIVEACHSLGVMHRDLKPENFLFVNQKEDSPLKTIDFGLSIFFKPGGIYSDVVGSPYYVAPEVLLKQYGCEVDVWSAGVIIYILLSGVPPFWDESEQGIFEQVLQGDLDFSSGPWPSISKSAKDLVRKMLNRDPGKRLTAHEALCHPWVCVDGVAPDKPLDSAVLSRLKQFSAMNKLKKMALRVIAENLSEEEISGLKELFKMIDTDNTGQITFEKLKAGLKMFGANLNEFEIFDLLNAADVDNSGTIDYREFIAATLHLNKVGREDNLVTAFSYFDKDGSGYITQDEIQKVCKEFGMEDVHLEEMIQEADQNNDGQIDYSEFVAMMLRGNADLGNSGSKCRSTSFNIGLRKIEAQSVC

SEQ ID NO: 38669 - protein, 267 aa, Synechococcus sp. WH 8102
MVLMQTPRPINDPSTGLVGLVAILLSVLLLLGQSLFIVPAGQVAVVTTLGKVSGGSRLPGLNFKIPLVQAVSPFDVRTQVRPEEFATLTKDLQVIEATATVKYAVRPNEAGRIYRTIASADREIYPRIIQPSLLKALKSVFSQYELVTIATEWNDISSLVERTVAEELDKFDYVEVRGLDLTGLQIAEEYRAAIEQKQIAEQQLLRAQTEVKIAEQEAIRYDTLNRSLDDQVLFKLFLDKWDGRTEVVPALPGTPGGTPPVIVGRKN

SEQ ID NO: 38670 - protein, 259 aa, Geobacter metallireducens GS-15
MPRKNQDLYHHYPQKDRKFTMYKLSEKGEQIREMFSDIAPRYDFLNRLLSFGIDRRWRRIAVQCARWSEGGKILDVATGTGDVALEIARQTPDSVSIIGIDITEGMVVLGREKVAQSPYARRITLEIAPCEAIPFPDNTFDSVTIAFGIRNVVDRRQGLAEMQRILKPGGRAVILEFSTPRSQFFKRVYYFYFLRLLPAIGGLFSNFSAYKYLPDSVLEFPSQEEFKTLMRSVGFHSTTHRDLTFGIATIYTGEKAAQN

SEQ ID NO: 38671 - protein, 524 aa, Pisum sativum
MLVELALALMVIALFIHLRPTPTAKSKALRHLPNPPCPKPRLPFIGHLHLLDNPLLHHSLIRLGERYGPLYSLYFGSMPTIVVSTPDLFKLFLQTHEASSFNTRFQTSAIRRLTYDNSVAMDPFGPYWKFIRKLIMNDLFNASTINKLRPLRTREIRRVLKVMAQSAETQEPLNVTEELLKWTNNTISTMMLGEAEEVRDIARDVLKIFGEYSLTDFIWPLKMFKFGNYEKRTEAIFNKYDPIIEKVIKKRQEIVNKRKEKNGEIQESEQSVVFLDTLLEFAQDETMEIKITKEQIKGLVVDFFSAGTDSTAVATEWTLAELINNPRVLKKAREEIDSVIGKDRLVDESDVQNLPYIRAMVKEVFRMHPPLPVVKRKCTEECEINGYVIPEGALVLFNVWAVGRDPKYWKRPLEFRPERFLENAGEGEAGSVDLRGQHFQLLPFGSGRRMCPGVNLATAGMATLLASIIQCFDLQVPGPDGKILKGDDAKVSMKERAGLSVPRAQNLVCVPLARDGLAAKLLSS

SEQ ID NO: 38672 - protein, 599 aa, Burkholderia thailandensis E264
MLRRASSATRRGRRRNRDRHGSPDCQAAACRGGAIARLRIRCSASCAAFVIPLFFSPSAAMHDKILILDFGSQVTQLIARRVREAHVYCEIHPNDVSDDFVREFAPKGVILSGSHASTYEDHQLRAPQAVWDLGVPVLGICYGMQTMAVQLGGKVEWSDHREFGYAEVRAHGHTRLLDGIQDFATPEGHGMLKVWMSHGDKVAAMPPGFALMASTPSCPIAGMADEARGYYAVQFHPEVTHTVQGRKLLERFVLDIAGAKPDWIMRDHIEEAVARIREQVGDEEVILGLSGGVDSSVAAALIHRAIGDQLTCVFVDHGLLRLNEGKMVLDMFEGRLHAKVVHVDASEQFLGHLAGVADPEHKRKIIGREFVEVFQAEAKKLTNAKWLAQGTIYPDVIESGGAKTKKATTIKSHHNVGGLPETLGLKLLEPLRDLFKDEVRELGVALGLPEEMVYRHPFPGPGLGVRILGEVKRDYADLLRRADAIFIEELRGTLATEQDAAAGLCEPSQVGKSWYDLTSQAFAVFLPVKSVGVMGDGRTYDYVTALRAVQTTDFMTAHWAHLPYALLGRASNRIINEVRGINRVVYDVSGKPPATIEWE

SEQ ID NO: 38673 - protein, 368 aa, Synechococcus sp. WH 7803
MSVINAFRRRFSPAPVLQDWPGLIEAYRPWLPVTTSTPVVTLREGATPLIPVPSVAERIGRDVKVFVKYDGLNPTGSFKDRGMTMAISKAKEAHCEAVICASTGNTSAAAAAYARRAGMRAFVLIPDGYVAQGKLAQALVYGAEVLAIRGNFDRALDIVREVSDQFPVTLVNSVNPFRLQGQKTAAFEVIDALGDAPDWLCIPMGNAGNITAYWMGFQEYNQAGRSRKLPRMMGFQASGSAPLVNNTTVTDPDTIATAIRIGNPVNREKAIAARKASQGDFLDVTDAEIIEAYKLLGGQEGIFCEPASAASVAGLLKRKDEVPTGATVVCVLTGNGLKDPDCAINNNDAAFHTDLDPDLGTVARVMGF

SEQ ID NO: 38674 - protein, 445 aa, Zea mays
MGQKDSKPSNGYGYSSDYGGTSSGYNLRNTGSTSSSYGARYVPSSENNVQPETHARLQRKYSRIGDDYRSLSQVTEALAQAGLESSNLIVGIDFTKSNEWTGKISFNRRCLHDIGNTPNPYEQAISIIGRTLSVFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTQYKATLDLQLLGRRQRITPRIALPPPTRTAYSRTTSFSQQSGVYSRSSSFDQQTSVYQQRSESLKQQQPAAPKGPDTYVSESALEDRILCPICMYKSKDLAFGCGHQTCYECGRDLERCPLCQQHITTRIRLY

SEQ ID NO: 38675 - protein, 293 aa, Gibberella zeae PH-1
MAPDVCTFTLNTGDEMPAVGFGTWNIPRSQAAKAVETALRAGYRHIDTALAYGNEKEVGAGIRASGVPREEIWVSGKLRNNWHKHARKCLQTSLKNLGVGYLDLYLIHWPCSRDADNPAICYEDWDYVDTWMEMEELLDEGKVLNIGVSNFGIQQLERLLTSTEIVPAVNQIELHPCNPSPKLVAYCNNRGIHSEGYSCLGSGHSALHRNKTLRDIADAKEKTVQQVLLQWGIEKGWGVVCKSVTPSRIKSNFELSGWELTDDDMEAIDGIKKRFKAVGDGFLPHRVFFGDDE

SEQ ID NO: 38676 - protein, 199 aa, Candidatus Kuenenia stuttgartiensis
MTEAKQAGSILKKEGYVFDIAFTSVLKRAIKTLWYILDEMDLTWIPVQKTWRLNERHYGALQGLNKAEVAKKYGEEQVFLWRRSYDTPPPPLTLTDNRYPGNDVRYRSLSKEEIPFTESLRDTIFRFLPYWDDAIAPAIREKKRVIVVAHGNSLRALVKYLDDIPDDKIAELSIPTGIPLVYELDEGLKPTSKYYLRGD

SEQ ID NO: 38677 - protein, 503 aa, Arabidopsis thaliana
MAILFCFFLVSLVTLVSSIFFKQIKNTKFNLPPSPPSLPIIGNLHHLTGLPHRCYHKLSIKYGPVILLHLGFVPVVVISLSEAAEAVLKTHDLECCSRPKTVGTGKLSYGFKDISFVPYSEYWREMRKLAVTELFSLKKVQSYRYIRGEEIEFMVKKLSESALKQSPVDLGSTFFSLTASIIFRVALGRNFHESGSIIDQEGIEELVTAATTAIGSFTFSDFFPSGLGRFLDCLFRTQTNINKVSEKLDAFYQHVIDDHLKPSTLDSSGDIVALMLDMIKKKGHKDDFKLNVDNIKAVLMNIFLAGIDTGAITMIWAMTELVKKPLVMKRAQENIRGVLGLKRDRITEEDLCKFDCLKHIVKETLRLHPPVPFLVPRETISHIKIQGYDIPPKTQIQVNVWTIGRDPKRWTDPEEFRPERFANTCVDFRGQHFDFLPFGSGRRICPAISMAIATVELGLMNLLDFFDWRLPDGMKVEDIDIEEAGNVTVVKKLLIYLVPLQRH

SEQ ID NO: 38678 - protein, 248 aa, Brassica napus
  misc_feature (175)..(175): Xaa can be any naturally occurring amino acid
  misc_feature (225)..(225): Xaa can be any naturally occurring amino acid
KKTIFDGWFKKTKKKKKTILDLPEDLVEDEIISRLPISSLRSVRSTCKKWNTLCKNRILFGKAAKKQFLMMDSRRICLMNLDLSKDNGDPSIKQVSVLDQKFQIPMVFQSDGLLLCVLKDYSRLVVWNPYLGQMRWIEPRNSFHSSDRFAPGHDSNFNYKILRISSEIHPVTERXFLGFELYDFTSSSWKVLDDVTPKRRQIRSGQQGESLKGNAYFLTSVRGSXAGLDFTTERFGPPRPRPPFILTM

SEQ ID NO: 38679 - protein, 90 aa, Zea mays
  misc_feature (74)..(74): Xaa can be any naturally occurring amino acid
KELSNKVNKNTTDYNNYNKIYKTIGQPVENELKEQLKENVLLNHLQKILNSNSTGNGETSDYSVNCQKIKLKQXLAYECQKQYRSIEWSM

SEQ ID NO: 38680 - protein, 248 aa, Symbiobacterium thermophilum IAM 14863
MIRLKSQREIAIMRDAGRIVAECHAALAEKIEPGITTWELDQFVEQFLARHGATPSFKGYNGFPASICASVDDVICHGFPSRKRLKAGQVVTIDIGAYYKGYHGDSAWTYAVGEVSPSVQELMKVTEEALYAAIAVALPGNRMGDIGHAIQSLAESHGFGVVREYIGHGVGQKLHEPPEVPHYGQPGTGIALRPGMTIAIEPMITLGDWRSKLDPDGWTARTVDGSICVQFEHTIAITDNGPEILTKL

SEQ ID NO: 38681 - protein, 385 aa, Glycine max
MGLVCSRSRRFREAHAEENAQDAEIERRIELETKAEKHIQKLLLLGAGESGRSTIFKQIKLLFQTGFNEAELKSYIPVVHANVYQTIKVLQDGSKELAQNDFDSSKYVISNENQDIGQKLSEIGGTLVYPRLTKELAQEIETMWEDAAIQETYARGNELQVPDCAHYFMENLERLSDANYVPTKEDFLYARVRTTGVVEIQFSPVGENKRSGEVYRLFDVGGQRNERRKWIHLFEGVTAVIFCSAISEYDQTLYEDENKNRMMETKELFEWVLRQPCFEKTSFMLFLNKFDIFEKKVLNVPLNVCEWFKHDYQPVSTEKQEIEHAYEFVKKKFEELYFQSTAPDCVDRVFKIYQATAPDQKLVKKTFKLGDETLRRRNPLEAGLL

SEQ ID NO: 38682 - protein, 208 aa, Brassica napus
  misc_feature (146)..(146): Xaa can be any naturally occurring amino acid
MESDSVMVPFPLLPVPIESNYRACTIPYRFPSDNPRKATPTEISWIDLFSNSIPSFKERAESDTYVPDAPVRAEKFAQRYAEILEDLKKDPESHGGPPDCILLCRIRELILRELGFRDIFKKVKDEENAKAITLFPEVVRLSDALXDEGKRIENLVRGIFAGNIFDLGSAQLAEVFSKDGMSFLASCQNLVPRPWVIDDLDNFQARWL

SEQ ID NO: 38683 - protein, 546 aa, Cryptococcus neoformans var. neoformans B-3501A
MPVFSTLINSTESYQRRFDQMARAVLVYWVLKYVLLDGFRHIKARGLCGTANEIRNKIKSLVVRIMLAFPSNRAKLNSELAKTRAELKEKLAPSQYPDGVRLTTVRTLPETGRGREWLESEWENLKKLEKADVDNGRVSGAVYHGGDELNAVINEAMAKFVVTNPLHPDVFPGVRKMESEIVSMCLNLFNGPNGAGTTTSGGTESILMSVKTHRDWARVTKGITRPEMVIPSSAHAAFWKASEYFNIKLHVIPVNQKTRKAEVTAMKRAINPNTIMIVGSAPNFPDGAIDPIPELGALAKRRNVGLHVDCCLGSFIMPFLEKAGFSEGIDPFDFRVPGVTSISCDTHKYAFCPKGTSVIMYRSSELRRFQYYVITDWAGGVYASPSMAGSRPGSVLAGAWAVLNHIGADGYTSSCRQIISAARYLTSSLRTLFPDDLYVLGDPKGPVVAFNSKTINIYAVGDVMSKKGWHLSALGGDGGLHMAFTRLSAKSVDKLIEDLGDALKEVKASPQGAGGDMVALYGLGQTSAGPHVVGKLAETFLDTLYE

SEQ ID NO: 38684 - protein, 338 aa, Enterococcus faecalis V583
MYKAIVAAKGKTTKIVEKESRPLKDNEARLKMEVCGVCHTDLHVKNADFGDVSGCTLGHEGIGIVTEVGKDVTSLKIGDRASVAWFYEGCGHCEYCTSGRETLCRSVKNAGYTVDGAMAEECIVTDGYAVKVPENLASEPASSITCAGVTTYKAIKESGIRPGQWLMISGLGGLGNLALQYAKHVFNAKVVAVDVNDNQLAFAKEMGADLLINPVKDPDFAAQLQKEIGGVHAAVVTAVAKSAFNGAVDAVRAGGTVVAVGLPVETMDLSIPRLVLDGIHVVGSLVGTRQDLREAFQFGAEGKVVPVCQTRQPEEINAIFEEMEQGKIRGRMVIDFRS

SEQ ID NO: 38685 - protein, 175 aa, Triticum aestivum
MAPTVMASSDTSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFLAFQATGCQESGKA

SEQ ID NO: 38686 - protein, 257 aa, Vibrio fischeri
GINDLIDVEYMAYMLKYDSTHGRFNGTVEVVDGNLVVNGKTVRVTAERNPEDLKWDAINVDVVAEATGLFLDDATARKHITAGAKKVVLTGPSKDATPMFVMGVNHTSYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAASYEAICAAMKEASEGELKGVLGYTEDAVVSQDFIGE

SEQ ID NO: 38687 - protein, 194 aa, Prochlorococcus marinus str. MIT 9301
MSLRVGQEAPDFSATAVYDQEFKEITLSGLRGKWVVLFFYPLDFTFVCPTEITAFSDRYQDFSALNTEILGVSVDSKHCHLAWIQTPRNEGGIGDINYPLVSDLKREICQAYNVLNDDGEADRGLFLINPEGIVMHTTVNKAPVGRNVDETLRILQGYQYVAANPDEVCPANWTPGEKTMLEDPKGSKEYFSAL

SEQ ID NO: 38688 - protein, 92 aa, Zea mays
TERDYLRKIIVQGRSSKSTKVGDIMTEENKLITVNPDTKVLQAMQLMTENRVRHIPVIDGTGMLGMVSIGDVVRAVVAEHREELNRLNDYIQ

SEQ ID NO: 38689 - protein, 257 aa, Photobacterium indicum
GINDLIDVEYMAYMLKYDSTHGRFNGTVEVVDGNLVVNGNTVRVTAERNPEDLKWDEIGVDVVAEATGLFLDDTTARKHITAGAKKVVLTGPSKDATPMFVMGVNHATYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAATYEAICAAMKEASEGELKGVLGYTEDAVVSQDFIGE

SEQ ID NO: 38690 - protein, 257 aa, Photobacterium angustum
GINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYETICAAMKEASEGALKGVLGYTEDQVVSQDFIGE

SEQ ID NO: 38691 - protein, 115 aa, Prochlorococcus marinus str. MIT 9301
MKSWTCIENCGACCKFDLNERSDLADKLKKEDIALINSMTDRDGWCKNLDRENKKCLIYENRPHFCRVNEFSTTFKGYLKSGDKFLIDCCKQHISSNYGYQSKEMKTFRIAVSGK

SEQ ID NO: 38692 - protein, 850 aa, Triticum aestivum
  misc_feature (649)..(649): Xaa can be any naturally occurring amino acid
MPPLYVFSLGLLLLLHIPHWCPSSAAASDTLTAGQSLAVGSKLVSRNGKFALGFFQPAAGITSKSQNTTSSSWYLGIWFNKIPVFTAVWVANRDQPITGPNLNLTQLKISSYGNLVIVNNDSVVWSTHTVNNRTQTSSINTTTGAAVLLNSGNLALTVTESPSSSDLPLWQSFDYPTDIFLPGSKFGRNKVTGLIHQSISKKSLIDPGLGSYSIELEETKGIVLKRRNPLVVYWHWASSKTSSLSLIPILNSILDLDPRTKGLINTTYVDNNQEEYYTYTSPNESSPTFVSLDISGLIKLNVWSQANQSWQIIYTQPADPCTPAATCGPFTVCNGIAQPFCDCMMNFSQKSPLDWEFNDRTGGCIRSTPLHCNTSSNNKNITSSTDMFHSIAQVTLPYNPQSIDFANTQSECEEACLSSCSCTAYSYNSSRCSVWHGELLSVNLNDGIDNTSEDVLYLRLAVKDLLPSLMKNKRKPNVGAVTAASIIGFGLLMLMVLLLIWRNRFKWCGLPLYSNEGSSAGIIAFRYTDLVRATKNFSEKLGGGGFGSVYKGVLSDSKTTVAVKRLDGANQGEKQFRAEVSSIGLIQHINLVKLIGFCCEGDHRLLVYEHMLNGSLDGHLFKKSNANVVVLNWNIRCQISLGVARGLCXKKKKNLHESCHKCIIHCDIKPGNILVDASFVPKIADFGLAAFVGRDFSRVMTTFRGTAGYLAPEWLSGVAITPKIDVYGFGMVLLEIISGRRNSSLETPYNTRSSTTRYQNVEYFPVQAISKLHGGDVKSLVDPQLHGDFNLEEAERVCKVACWCIQDNEFDRPTMGEVVRVLDGLQEINMPPMPRLLAALTEQLGAATPV

SEQ ID NO: 38693 - protein, 335 aa, Xylella fastidiosa 9a5c
MTQTITVIRGDGIGPEIMDATLLVLNTLQANLNYEFADAGLNALEKHGDLLPEATLNSISKNKVALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNACMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMEFAKAIASRL

SEQ ID NO: 38694 - protein, 371 aa, Bacteroides thetaiotaomicron VPI-5482
MGIMVGLPSPSGSEKDLQLNFGKNMTVQVEMRAPHLPAEWHLQSGIQLTWPHAGTDWAYMLKEVQECFVNIAREIAKRELLLIVTPEPEEVKKQIVATVNMDNVRFLRCETNDTWARDHGAITMIDTGNPSLLDFTFNGWGLKFASELDNLITGQAVKAGALKGQYIDCLDFVLEGGSIESDGMGTLLTTTECLLSPHRNGKLNQVEIEEYLKSTFHLQKVLWLDHGYLAGDDTDSHIDTLARFCSTDTIAYVKCDNTEDEHYEALHAMEEQLKTFRTLAGEPYRLLALPMADKVEEDGERLPATYANFLIMNDAILYPTYQQPDNDRKAGEVLQQAFPKHQVIGIDCRALIKQHGSLHCVTMQYPSGVIQ

SEQ ID NO: 38695 - protein, 219 aa, Photobacterium profundum SS9
MTQDEMKKAAGWAALEYVTKGSIVGVGTGSTVNHFIDALETRKEEIKGAVSSSVASTERLEKLGIPVFEANEVAGLDIYVDGADEINAEYDMIKGGGAALTREKIVAAISDKFICIVDDTKQVDVLGQFPLPVEVIPMARSFIGRELVKLGGDPEYREGVVTDNGNIIIDVHNMAITDAKDMEKKINALPGVVTVGLFAARGADVLLVGAPEGVRKFEK

SEQ ID NO: 38696 - protein, 200 aa, Vibrio vulnificus
MSPIIDALVPMVVEQTSRGERSYDIYSRLLKERVIFLTGQVEDHMANLVVAQLLFLESENPDKDIFLYINSPGGSVTAGMSIYDTMQFIKPNVSTVCMGQACSMGAFLLAGGAPGKRYVLPNSRVMIHQPLGGFQGQASDIQIHAQEILTIKTKLNKLLAEHTGQPLEVIERDTDRDNFMSADQAVEYGLVDAVLTHRSA

SEQ ID NO: 38697 - protein, 395 aa, Debaryomyces hansenii CBS767
MFYIRITYVLVYFQLFIGCIICSPGDDLYMFQECRYQCEQIICHKRPYHIFQRMILDELGSDGEYEIHAYNENWEFSSLLPLHLKLLGWDCVLNCDYECQRIVTKERCKNNQEICQFHGKWPFLRVFGIQEFASVIFSIGNYMVHAIGIKKVLEAKRQADPMIKYEYTVLIICSFIAMFAWICSTVFHIRDFLVTERLDYFVAGLTVLSGFYGVFTRYFRLYLPSRKLQRMLFTIVCILAYTWHIHRLVDDWLYTYNMQANITLGVLQNIIWGFLCFDLYCKYYKLENNEQVYKEKQSNHLDYITPRRLLIPSFYSRSSKLYSLYPLLLCAIVIAGMSLEIFDFPPIFFDLVDAHSLWHLVTIIPAFYGWYDWMIWDINVNVKHELEEFVQKKND

SEQ ID NO: 38698 - protein, 323 aa, Synechococcus sp. WH 8102
MAIPPALVIAARQGWQWQWQRLMGGLGPADAEGNYQRPSSDHLSASVPSFVLATLPEQRRPLLILGRSCPWAHRTWLVHQLRRLGSSITPLIARADHRAGRWQLDPPWQGCHTLLELYRRCGAPPSYRATVPVLVDPSGPRILGNESAQLVELFNEWPAPDGAPDLAAAHQRGEIDRWQSLLQPAVNDGVYRCGFARTQGAYDRAETDLFNALQQVEQALQDGRSWLCGDELSLADVRLFPTLIRWEVVYAPLFGCSRRPLWQFPNLWLWRQRLHALPGVDDTCDAKAWRQDYFGALFPLNPGGIIPAGPDLSTLVHAGIPRP

SEQ ID NO: 38699 - protein, 634 aa, Synechococcus sp. WH 8102
MSLISLVGAAKDFGIRTLFTDLELHIGEGERLGLIGPNGAGKSTLLKVLAGVEPLGAGERRCSPRLRVELVGQESRVTPGLTVLEQVLEGCGAKRDLLLRFSALSEAVAAAPENEALLSELGQLSQRMDDEEAWSLEQQCQEVLQKLGISDLQRPVADLSGGYRKRVGLASALVACPDVLLLDEPTNHLDAAAVEWLQSWLDRYPGALVLVTHDRYVLDRVTSRMVEVDRGRARTYQGNYSTFLQHKADEEASEASSAAKFRGVLRRELAWLRQGPKARSTKQKARLQRIEAMREAPVQQGRKTLEMASVSRRIGKLVIEAEAVGVTADGRPDGRPLLRDFSYSFSPEDRIGIIGPNGSGKSTLLDLIAGRRQTTSGALRLGETVHIGYLDQHTEAFTEGKGLQRKVIEFVEEAASRIEVGGEQVTASQLLERFLFPPAQQHSPLAKLSGGERRRLTLCRMLIQAPNVLLLDEPTNDLDVRTLSVLEDFLEDFRGCVIVVSHDRYFLDRTVDRLFWFDQGRLQRFEGNYSGFLEQQRQQERQRTSAPVPTIKQDSRQADAKPSTGPRRRSFKETKELQQLDQRLPQLEERKTALEEKLAAHGTDLSQLSLELAELIATIEAAEERWLELSELQA

SEQ ID NO: 38700 - protein, 337 aa, Debaryomyces hansenii CBS767
MSTSYLLARDVCSSQNHFNGENLGARISAVFVILAVSAIGAFFPLVVQRCPYFKLPKWCFFITRYFGSGVIVATGFIHLLAEADQALSDECLGGVFNEYPWAEGIALMGVFVMFLLDIVAHKRLDDKLAKKDKLKAEKAALENENSLEIQAIKEKVDDTEDVKLTDDDTPTENVYQQILNSFVLEFGIIFHSVFVGLSLAIAGNEFKALYVAIAFHQMFEGLGLGTRFAMTPWPKDKQYIPWVLALAYSLTTPIAIAIGLGVRNSYPPGSRVALITTGCFDALCSGILIYNSLVELMAYDFIFSPEFKTDDGMKKMLWAYFCLAFGAAIMALIGKWA

SEQ ID NO: 38701 - protein, 573 aa, Nicotiana tabacum
MDPFIAAQADAGNTPNNTKKLAIGWMLPYLLVVSFAGLFSIVALRKMMIMKYKLTYPSGTATAYLINCSTLLKEQSWPRNKLVPYSNPLASALYLGLFNGYLHVKMAADLVACLHLVSKPMPKSSILIFPQHMLELVCFALMDPLMIFIKIIKLKVDTHLVISDNKGDLSVLCPYMVNVSLLIGAIVSWAIMWPMIEAKKGDWYSAQLSAASLHGIQGYRVFIAISMMLGDGLFHFAYMLVVTVLSFRNRKSGLADSSSEESFEDYDKKRQNEYFLKDQIPNWAAIGGYVGIAIISIIVVPIIFHSLKWYHILVAYLIAPILAFCNSYGSGLTDWSLASNYGKIAILTFSYWVGLQNGGVIAGLASCGLMMSILDTAAGLMGDFKTGYLTLTSPRSMFFSQVIGTAMGCVITPLVFWIFNSAYRLGDPEGAYPAPYASMYRGIALLGVEGFGSLPKHCLRLSVWFFVAAIVINLLTQLLKKFEPKYGIYRCVPSPMCMAIPFYLGGYFAIDMCVGSLILFIWQMVNKQQAKDFGPALASGLICGEPLWGIPAPVLALAGVKAPFCMKVRHGGA

SEQ ID NO: 38702 - protein, 270 aa, Yarrowia lipolytica CLIB122
MPAERTLLASFPLPKKGETQPDDKKLLSLYDTEDYYLIEFHSPKDNRLSNVFIDAFVEALHYLLATKEDEPKPLVTTSAIPKFYSNGLDLEAAMKTDRFFERYLGRLQRSLLEFPWPTIAYVNGHAFAGGFILANSHDFKVQNDKKGWLCMNEIEFDAPLIGQLMSIHAHQYGPVIGRKITMMGHRFTAAEALKDGIIDAAGGWDEVEEIVAKVRNSVGKNSYGQMRMTMFAPVLDHCINYYEEEARDVARQAAARDHQAARIEEVKAKL

SEQ ID NO: 38703 - protein, 142 aa, Bradyrhizobium sp. BTAi1
MTVRAILDIKGHQVESVEPQTTLADAAKLLADRKIGAVLVMSGSRMEGILSERDIVRSLGERGAAVLTEPVSGVMTRRVVSCRPADTVASIMETMTTGKFRHLPVIDGGLVVGLISIGDVVKWRVQEYEAEQEALRQYIKTA

SEQ ID NO: 38704 - protein, 249 aa, Physcomitrella patens subsp. patens
MKLNIANPTTGCQKKVEIDDDAKLRQFYDKRLAQEVSGDQLGDEFKGYVFKIMGGCDKQGFPMKQGVLTQGRVQLLMHRGVSCFRGYGRRNGERRRKSVRGCIVSPDLSVLNLVIVKQGDNDLPGLTDIEKPRMRGPKRATKIRKLFNLTKEDDVRKYVNTYRRSFVSATGKKRSKAPKIQRLVTPLTLQRKRRRIAIKKERVAKSKAEAAEYQKLLALRLKEQREHRSESLAKKRASRASIAKPESSA

SEQ ID NO: 38705 - protein, 673 aa, Zea mays
  misc_feature (474)..(474): Xaa can be any naturally occurring amino acid
  misc_feature (493)..(493): Xaa can be any naturally occurring amino acid
  misc_feature (559)..(559): Xaa can be any naturally occurring amino acid
  misc_feature (577)..(577): Xaa can be any naturally occurring amino acid
MASISGAAAAPSSAACRLRLRRHILLRPSHLRLRAPHSIADLSRSSSSSSSAPTRAQPLGSRPENGGGVRAVEKDPIKLWERYVEWLYQHKELGLFVDVSRMGFTEDFLRQMEPRMQRAFAAMRELEKGAIANPDEARMVGHYWLRDPALAPNSFLRSKIETTLDRILAFSQDVVSGKVAATFSIFLFAYIPAIASAADFELHGMLGVHHLGGKYSNRHGRYIVQPIDAMYLIETFGTFLFVLMYYNKGFRIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLAGAALMDEETRNTVVKENPAALLALCWYWASEGIGNKDMVVLPYKDSLLLLSRYLQQLVMESLGKEFDLDGNRVNQGLSVYGNKGSTDQHAYIQQLREGVHNFFVXLFIEVLRDRPAGHDWELEXPGVTCGDYLFGMLQITEVYDILQGTRSALYANDRESISVTVQEVTPRAVGALVALYERAVGLYASXGVEAGKKAAGEVLALQKXRVLTVLNEATCKDPCEPLTIDEIADRCHCPEDKHNAFPPSITHAQRLLPQIEMIYKIVQHMAANDRAIIAEGSCGSPRSVKVYLGECNVDEDLQAA

SEQ ID NO: 38706 - protein, 429 aa, Pseudomonas putida GB-1
MRDALNTGLIDFLKASPTPFHATASLAQRLEAAGYQRLDERDSWATVPGGRYYVTRNDSSIIAIKLGKQAPLLNGIRMVGAHTDSPCLRVKPQPELQRQGFLQLGVEVYGGALLAPWFDRDLSLAGRVTYRRDGKVESQLIDFKLPIAIIPNLAIHLNRTANEGWAINPQNELPPILAQVAGDERIDFRALLTEQLAREHELIADVVLDYELSFYDTQDAALIGLHGDFIAGARLDNLLSCYAGLQALLAADSDETCVLVCNDHEEVGSCSACGADGPMLEQTLQRLLPDGDSYVRTVQRSLMVSADNAHGVHPNYADKHDGNHGPKLNAGPVIKVNNNQRYATNSETAGFFRHLCMAEEVPVQSFVVRSDMGCGSTIGPITASHLGVRTVDIGLPTFAMHSIRELCGSHDLAHLVKVLTAFYRSRELP

SEQ ID NO: 38707 - protein, 183 aa, Brassica napus
FNLGEISLTTTETDGEETGFISYRLLLLLLLSFETARRLASADPNDEACLKNLRQSLEDPARNLRNWTNNVFSNPCSGFTSYLPGATCNNGRIYKLSLTSLSLRGSISPFLSNCTNLQSLDLSSNQISGDIPPEIQFDDRSKDWRGGRAASFNIIPSSTGAAKAVGKVLPQLNGKLTGMSFRV

SEQ ID NO: 38708 - protein, 257 aa, Photobacterium leiognathi
GINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDQVVSQDFIGE

SEQ ID NO: 38709 - protein, 118 aa, Triticum aestivum
  misc_feature (44)..(44): Xaa can be any naturally occurring amino acid
MAGGKEPIEVKFRLFDGTDIGPSKYDPATTVSALKDFILARWPXDKEITPKTVNDLKLINGGKILENNRTLAESRVTIGEVPGGVITMHVVVRPPQVDKNQKQLGNSPKQNRCGCTIL

SEQ ID NO: 38710 - protein, 447 aa, Streptococcus pyogenes str. Manfredo
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNMGESIMVPRYGAAIADEGLLPAAIAKQNQNGAPLVAILVSGAIAIVLLLTGSFENLAKLSVVFRFFQYIPTALAVMKLRKDAPDANVIFRVPFGPIIPILAVIVSLVMIWGDNPMNFVYGAVGVIIASSVYYLMHGRNHQMDQMPPEEQI

SEQ ID NO: 38711 - protein, 79 aa, Triticum aestivum
  misc_feature (17)..(17): Xaa can be any naturally occurring amino acid
  misc_feature (36)..(36): Xaa can be any naturally occurring amino acid
  misc_feature (45)..(45): Xaa can be any naturally occurring amino acid
  misc_feature (54)..(54): Xaa can be any naturally occurring amino acid
  misc_feature (72)..(72): Xaa can be any naturally occurring amino acid
GGAGNTGRIFRDTEPRXWEGAESCVFLREDVKEMHXQGVDWGNLXVSLGVQKPXISPFQETIRSDLCGLLGXDPSVVNL

SEQ ID NO: 38712 - protein, 309 aa, Hordeum vulgare [sequence omitted]

SEQ ID NO: 38713 - protein, 141 aa, Glycine max
  misc_feature (119)..(119): Xaa can be any naturally occurring amino acid
  misc_feature (124)..(124): Xaa can be any naturally occurring amino acid
  misc_feature (130)..(130): Xaa can be any naturally occurring amino acid
MKGIARIVNSLSRLGGREIISRGSSSSSSSLLLVSRRSLFISAATHFPTNSRDLTSSSRSSSLLPQKWAFLGGGQRRTMFIQTQSTPNPSSLMFYPGKPVMEVGSADFPNVRSALGSPXLAKSXYSIDGXVRVFFGSDFVT

SEQ ID NO: 38714 - protein, 243 aa, Ralstonia metallidurans CH34
MSETHFGFEKVDESEKAGKVAGVFHSVASKYDVMNDLMSGGMHRLWKVFTIAQANVRPGQKVLDIAGGTGDLAKAFAKQAGPTGEVWLTDINESMLRVGRDRLLNKGVVTPVALCDAERIPFPDNYFDLVTVAFGLRNMTHKDAALAEMRRVIKPGGKVMVLEFSKVWKPLEKFYDVYSFKVLPWLGERVAGDAPSYRYLAESIRMHPDQGSLVRMMEQVGLEQVEYFNLTAGVVALHVGRKY

SEQ ID NO: 38715 - protein, 392 aa, Photobacterium profundum SS9
MRGRTMSVIKMTDLELAGKRVFIRADLNVPVKDGKVTSDARILASLPTIKRCLEAGAKVMVTSHLGRPTEGEYNEEFSLAPVVNYLNDALDCDVKLAKDYLDGIELNAGELVVLENVRFNKGEKKNDEALSKKYAALCDIFVMDAFGTAHRAQASTHGVGMNAAIACAGPLLANELEALGKAMDNPARPLVAIVGGSKVSTKLTVLESLSKIADQLVVGGGIANTFIAAEGHNVGKSLYEADLVETAKKLMKDCAIPVATDVACAKAFDENAEAVIKHVSEVQDDDMIFDLGPDSTAVLAEIISNAKTILWNGPVGVFEFKNFEAGTAGIAKAIADSEGFSVAGGGDTLAAIDKFGIKADVSYISTGGGAFLEFVEGKVLPAVAMLEERAKA

SEQ ID NO: 38716 - protein, 139 aa, Frankia sp. EAN1pec
MASTVADVMTRNPATVGMDQPIAEAARRMKTVNAGDVIVLDNTGRVAGIVTDRDITLRVVAEGRDPERTATREVCTQTGLITIAPDTTTDTAVQLIRERHIRRLPVVDKGRPVGVISLGDLARALDPSSTLAEVSAAQR

SEQ ID NO: 38717 - protein, 326 aa, Magnetospirillum magnetotacticum MS-1
MAARRRRDGPRGRRVVAETLSGLRTELARFPYALVAVTGASNVTGESLPVAEVVRAAHDAGVRVVLDGAQLVPHRGFSLAASGVDYVAFSGHKTYAPFGAGALVGRRDWLDAGTPYLAGGGAVRQVAVTGTQWQTAPARHEAGSPNVVGAAALAAACDALAALDPTDLHAHEAALRAALVAGLEAVPGVRVVRVWDDAVDPVGVVTFAVEGHDPGLVAAYLSAEHGIGVRDGRFCAHPLLARLGYDAGAIRASVGVGTTGADVVRLVEAVRAYVEQGPATRYEVVDGCWAVVDDPRPVPVGSGLEGLFATAAAGFLADAAGCGPAV

SEQ ID NO: 38718 - protein, 734 aa, Physcomitrella patens subsp. patens
MNQAKKKNFKIEPFKHKVEMDPKYAEKTWKILEDAIHEIYNHNASGLSFEELYRNAYNMVLHKYGEKLYSGVVTTMTQHLREIARIVEAAQGGLFLEELDVKWREHNKSLQMIRDILMYMDRTFVNNFNKTPVHELGLNLWRDHIVRSPKIRDRLLRTLLDLVHRERTGEVINRGLMRNITKMLVELGTNVYQEDFERPFLDAASDFYRLESQQLIETSDCPDYLRKAEKRLNEEIERVAHYLDSKSEAKITQVVEREVIGNRMKLLVEMENSGLISMLIDDKYDDLGRMYSLFRRISTGLQTMRELMTAHLRETGRQLVTDPERLKDPVEFVQRLLDEKDKYDRIIQQSFNNDKMFQNALNSSFEYFINLNIRSPEFISLFVDDKLRKGLKGVSEEDVELVLDKVMMLFRYLQEKDVFEKYYKQHLAKRLLSGRTVSDDAERSLIVKLKTECGYQFTSKLEGMFTDMKTSRDTMQGFNATSAGTEGNEGPTLTVQVLTTGSWPTQSGARCNMPTEILAMCDKFKMYYLSTHTGRRLTWQTNMGTADLKATFGDGNKHELNVSTYQMCILYLFNQADRLTYKEIEQATDIPALDLKRSLQSLACVKGKNVLRKEPMSKDISEDDVFVFNDKFSSKFYKVKISTVVAQKESEPEKQETRQKVEEDRKPQIEAAIVRIMKSRRLLDHNNIISEVTKQLQARFMPNPAVIKKRIESLIEREFLERDRVDRKLYRYLA

SEQ ID NO: 38719 - protein, 126 aa, Litchi chinensis
MRTSNLSGLVLVISAVILAVHVAVSASSAVDFNAGHQFGFFPMKPECSGSIGECATVGDEELDLEFEMDSESNRRILATSQYISYGALRRNSVPCSRRGASYYNCQTGAQANPYSRGCSAITRCRR

SEQ ID NO: 38720 - protein, 436 aa, Arabidopsis thaliana
  misc_feature (343)..(343): Xaa can be any naturally occurring amino acid
MPEIEIAAGSGDNNDALFGKYELGKLLGCGAFAKVFHARDRRTGQSVAVKILNKKKLLTNPALANNIKREISIMRRLSHPNIVKLHEVMATKSKIFFAMEFVKGGELFNKISKHGRLSEDLSRRYFQQLISAVGYCHARGVYHRDLKPENLLIDENGNLKVSDFGLSALTDQIRPDGLLHTLCGTPAYVAPEILSKKGYEGAKVDVWSCGIVLFVLVAGYLPFNDPNVMNMYKKIYKGEYRFPRWMSPDLKRFVSRLLDINPETRITIDEILKDPWFVRGGFKQIKFHDDEIEDQKVESSLEAVKSLNAFDLISYSSGLDLSGLFAGCSNSSGESERFLSEKXSPEMLAEEVEGFAREENLRMKKKKEEEYGFEMEGQNGKFGIGICISRLNDLLVVVEARRRGGDGDCYKEMWNGKLRVQLIRVCDQTSSTNAAI

SEQ ID NO: 38721 - protein, 560 aa, Synechococcus sp. WH 8102
MALIHGLHTRNLRGDLLGGLTAAVVALPLALAFGNAALGPGGAIYGLYGAIVTGFVAALLGGTPSQVSGPTGPMSVTVAGVVSSLAAVGVSTDLSAGEMLPLVMAAVAIGGVFEALLGVLRLGRFITLVPYSVVSGFMSGIGIIILILQLGPFVGVTTTGGVVGCLSTLAELPIPNPSAISIGVMTLAVVFLTPARIRQWVPSPLLALLIVTPLSMLMFNDDRLQSLGLEPLNRIGAIPEGGLRFVLPDFSQYLPELLKAGLVLALLGAIDSLLTSLVADNITQTNHDSNRELIGQGIANTASGLLSGLPGAGATMRTVINIKSGGTTPLSGMTHSVVLLLVLLGAGTMAAQIPTALLAGILIKVGLDIIDWGFLFRAHRLSVKTAALMYAVMLMTVFWDLIWGVLVGMFVANLLTVDAITQTQLQGMDEDNPHKGNNLQIENLSAEERRLMESCGNQLMLFRLRGPLSFGAAKGISARMGLVSNYQVLILDITDVPRMGVTAALAVERMVEEAESLGRMVLVAGANERLRERLTNFGVRHILSKRIEALEIASKRLNHP

SEQ ID NO: 38722 - protein, 226 aa, Aspergillus nidulans FGSC A4
MNREEMIWEWFSADPERLRLSSSFMEADRGSRPSWVEWCSLPGQLAKVFDGGVEDDFMVDVAGGRGHDLKSFTDKFPDVKGQFILEDLGHVLEQSVDGLRAKKIAFDLFKEQPFKGAYVYYLKFILHDWSDGQCHRILTHIREAMRPESKLIIEEFILPEKDCPMLSAMWDWEMMVFCNSFERSESHWRKVLSKAGFQAKFYYPPGDGQVRFLQSKGTFSVLTILE

SEQ ID NO: 38723 - protein, 343 aa, Lactobacillus hilgardii
MTKDFRQNVFQGRSVLAEKDFSAAELEYLIDFGLHLKALKKAGIPHHYLEGKNIALLFEKSSTRTRSAFTTASIDLGAHPEYLGQNDIQLGKKESTSDTAKVLGSMFDGIEFRGFKQSDAEILARDSGVPVWNGLTDEWHPTQMLADFMTVKENFGKLQGLTLTFMGDGRNNVANSLLVTGAILGVNIHIVAPKALFPTEETQNIAKGFAEKSGAKLVITDDLDEGLKGSNVVYTDVWVSMGESNWEERVKELTPYQVNMEAMKKTGTPDDQLIFMHCLPAFHNTDTQYGKEIKEKYGITEMEVTDEVFTSKYARQFEEAENRMHSIKAMMAATLGNLFIPRV

SEQ ID NO: 38724 - protein, 490 aa, Thermobifida fusca YX
MRRGEEQVSLTERPQLFIGGRWVDSKGGRKVDVHNPATGAYVGSTVLASTADIDAAVASARASFNSGVWANTPPEERAAVLHRAADLLEERAPELAKLITSELGCPIWFSERAHVPNPIRHLRYYGTLAKDFAYDERRSDGTNTSLVTQVPVGVVAAITPWNGPLSTPSLKVAPALAAGCSVILKPPPETPLTAYNLADALSQAGLPDGVLNIVPADREEGAYLVSHPDVDKVAFTGSSAAGKKIMAACAERIARVTLELGGKSAAIILDDADVDTVVPALLPMAFMVNGQACIAQTRLLVPRSRKDEFIDAFAQAVAAQRVGDPIDPATQIGPMVSRRQQERVEGYIATGRQEGARVVVGGERPSLPSELAGGWFVAPTLLAEVHNSMRVAQEEIFGPVLAVIEYDGDDEAVAIANDSVYGLSGSVWSSDEERALAIARRMRTGMVSINGRPQAANSPFGGFKQSGIGREMGPEGFHAYLETMSIAVGS

SEQ ID NO: 38725 - protein, 282 aa, Thermobifida fusca YX
MTQRLRGRVAAITGGASGIGEATVRRFHTEGASVVIADIQAEAGRRLADELGDRAVFVRTDVSEEADVAALVDTAVDRFGQLDIMVNNAGIMGALGPIDATRMSDADLTIAVNLRGVICGMKHAARVMKPRRSGVIISTSSPAGVLGGIGPHIYSAVKVGIIGLSNSVAAELRQHGIRVNTIIPGSVVSPMTAGIVVDDAHNLAGAQEVLGRTALLGRPIQPADVAAGILYLASDDAAFVTGAVLPVDAGLTGASWPSPYTSGRYAKPVALLEAGRRIGGEE

SEQ ID NO: 38726 - protein, 176 aa, Bradyrhizobium sp. BTAi1
MAIYELDGQAPELPADGHYYIADNATVIGRVRLAKEVTVWFGAVIRGDNDWIEIGEGSNIQDNATCHVDPGFPLRVGRNCTVGHNVILHGCTVEDDALIGMGSIIMNGAHIRRGSVVGAGAIITEGKDFPEYSLIIGAPARVVRTLEPEQVERMGIAAKAYIAKGPRYTKGLKKIG

SEQ ID NO: 38727 - protein, 727 aa, Arabidopsis thaliana
MNANEEGEGSRYPITDRKTGETKFDRVESRTEKHSEEEKTNGITMDVRNGSSGGLQIPLSQQTAATVCWERFLHVRTIRVLLVENDDCTRYIVTALLRNCSYEVVEASNGIQAWKVLEDLNNHIDIVLTEVIMPYLSGIGLLCKILNHKSRRNIPVIMMSSHDSMGLVFKCLSKGAVDFLVKPIRKNELKILWQHVWRRCQSSSGSGSESGTHQTQKSVKSKSIKKSDQDSGSSDENENGSIGLNASDGSSDGSGAQSSWTKKAVDVDDSPRAVSLWDRVDSTCAQVVHSNPEFPSNQLVAPPAEKETQEHDDKFEDVTMGRDLEISIRRNCDLALEPKDEPLSKTTGIMRQDNSFEKSSSKWKMKVGKGPLDLSSESPSSKQMHEDGGSSFKAMSSHLQDNREPEAPNTHLKTLDTNEASVKISEELMHVEHSSKRHRGTKDDGTLVRDDRNVLRRSEGSAFSRYNPASNANKISGGNLGSTSLQDNNSQDLIKKTEAAYDCHSNMNESLPHNHRSHVGSNNFDMSSTTENNAFTKPGAPKVSSAGSSSVKHSSFQPLPCDHHNNHASYNLVHVAERKKLPPQCGSSNVYNETIEGNNNTVNYSVNGSVSGSGHGSNGPYGSSNGMNAGGMNMGSDNGAGKNGNGDGSGSGSGSGSGNLADENKISQREAALTKFRQKRKERCFRKKVRYQSRKKLAEQRPRVRGQFVRKTAAATDDNDIKNIEDS

SEQ ID NO: 38728 - protein, 336 aa, Marinobacter sp. ELB17
MQIGMIGLGRMGGNMAQRLMAAGHDVVVHDGDAEALGRLAALGAEPARTPDELVERLAVPRVVWLMVPAIAVANVIDTLSPLLGTDDILVDGGNSHHHDTRYRAKRLAEKGISFVDVGVSGGIWGLEQGYCLMIGGADAPVARLAPLFRTLAPGKGSAMAPVLLENNSGTALEGYLHCGPAGSGHYVKMAHNAIEYVLMAAYAEGFELLRNAGHDRQSPDELPASCDDPEAVDYDFDLAEIAQLWRQGSVIRSWLLDLTGEALAVDPALAAHDGRVADSGEGRWALQTAIATETAAPLLAQALFQRFTSRDQARYGNRLLSAMRDGFGGHGPSSRR

SEQ ID NO: 38729 - protein, 217 aa, Aspergillus nidulans FGSC A4
MALTTEETALVETATVTINSIPVSEDYSVASAALSSDGRIFTGVNVYHFTGGPCAELVVMGVAAAAGVTHLKHIVAVGNNDRGVLSPCGRCRQVLLDLQPGVRVIIGKKGSEQSVPPSELLPCSYLYADPVIFKALVSSGPVVVDFFATWCGPCKAVAPVVGKFSETYTGVKFLQVDVDKARSIAQEHQIRAMPTFVLYKDDYQTAMRKPKANQKRN

SEQ ID NO: 38730 - protein, 304 aa, Escherichia coli O6
MRLPIFLDTDPGIDDAVAIAAAIFAPELDLQLMTTVAGNVSVEKTTRNALQLLHFWNAEIPLAQGAAVPLVRAPRDAASVHGESGMAGYDFVEHNRQPLGIPAFLAIRDALMRAPEPVTLVAIGPLTNIALLLSQCPECKPYIRRLVIMGGSAGRGNCTPNAEFNIAADPEAAACVFRSGIEIVMCGLDVTNQAILTPDYLATLPELNRTGKMLHALFSHYRSGSMQSGLRMHDLCAIAWLVRPELFTLKPCFVAVETQGEFTSGTTVVDIDGCLGKPANVQVALDLDVKGFQQWVAEVLALAL

SEQ ID NO: 38731 - protein, 129 aa, Brassica napus
  misc_feature (5)..(5): Xaa can be any naturally occurring amino acid
  misc_feature (31)..(31): Xaa can be any naturally occurring amino acid
  misc_feature (38)..(38): Xaa can be any naturally occurring amino acid
  misc_feature (41)..(41): Xaa can be any naturally occurring amino acid
  misc_feature (59)..(59): Xaa can be any naturally occurring amino acid
  misc_feature (64)..(64): Xaa can be any naturally occurring amino acid
  misc_feature (72)..(73): Xaa can be any naturally occurring amino acid
  misc_feature (75)..(75): Xaa can be any naturally occurring amino acid
  misc_feature (80)..(82): Xaa can be any naturally occurring amino acid
  misc_feature (84)..(85): Xaa can be any naturally occurring amino acid
  misc_feature (87)..(87): Xaa can be any naturally occurring amino acid
  misc_feature (89)..(90): Xaa can be any naturally occurring amino acid
  misc_feature (98)..(98): Xaa can be any naturally occurring amino acid
  misc_feature (100)..(101): Xaa can be any naturally occurring amino acid
IYRTXATITVVKARKIFDSRGNPTVEVDVHXSTGVKVXAAXPSGASTGIYEALELRDGXSDYLXKGVSKVVXXVXTIIGXXXIXXDXTXXIDIDHFLXHXXDGTQNECPWVTAWSPLRTFPLPAFSSLP

SEQ ID NO: 38732 - protein, 177 aa, Glycine max
DPKLGENISGVILFHETLYQKTDDGTPFVELLAKRNIIPGIKVDKGVVDLMGSENECTTQGLDDLAQRCAQYKKDGCHFAKWRCVLKIGKNTPSYQAILENANVLARYASICQANRIVPIVEPEVLPDGDHDLDRAQKVTETVLAAVYKALNDHHVYLEGTLLKPNMVTPGQSCPKK

SEQ ID NO: 38733 - protein, 119 aa, Nicotiana benthamiana
MAEVKLLGVSLSPFSRRVEWALNIKGVEYEFIEEDLQNKSPLLLESNPVHKKIPVLIHNGKPISESMVILEYIDETFEGPSILPKDPYERALARFWANFLDVKCITTIGKALFGKGEEQ

SEQ ID NO: 38734 - protein, 1697 aa, Cryptococcus neoformans var. neoformans B-3501A
MSIANSSSSPEDQNITSLLENHSRETGELPSPPLVEDRAAPNGMKLDGENIVGQSNGISAAQAAVTTSRTSSLTSNLNRPQSVSGAQPAVASSSRSTINSPPRRYLLISQQSPSSRTTPCRSAGTASPTSRPPTPPLPPTQSTPVTVSGLSAPSILSPVPAASSAISPTIPSIPLHAPLPYPTLSLPPSATPALPNSFTLSASTILPADSSTSALPSTSAAGLPVMPVFISPATSSPAGPEPSTLQSASEVTKSSNQKESPRKTDSKQAPSPSSTHGLWTNTRPFHASSNLSATSGKSSAASSRSTSRTLLPGRAATSDNVAGPSKTTSVSSTHPPARAPSLSLPSEPEKQVHPRSPSHEGVGKREKKSKALSSGTGQSTPSRSSLSTYDVASNRKTKSTGLNALPQKPSSAGKTSSIPQRTSTLATAMAIRPFIRSPTSPCRPSSFEASGPIQSSGGAVKAAQTQDKIHPLSTTSSISSHSRETTTKAATPSHVTISSPSPSQSTSALTTVHVTQDAQKSATTSPTREKIHPSRRKSQTSDCVVAPTTSQTAASLSYPAGTSDGTGEAGKKAAETSVHAGPSSADFGAFVVPPTTAIASTTVSPSVTPPEDAPFLKSGPSVHPLFHAASAIGGQDTLTETGAVGDVLSQGSKGRASSPRITTTGAVSHLVLPIDVGSEIKPTAAPSLFASGVTIENVDDQAAAQPQNQAPLPSALSVLSKKNLGSSSKESSVKSAASSVSSSSTLGDSVSGLGRKSHHKSTQSIPQSPLPTTNTSNSSGIEVNSWLNPQPFGPSFAASHLNTHAKKKWKGKEREKEREKEKAREKEKAKEENEQLRRRRMADLEKISATLEKYKGRMGVESRTRSIPRADGENRKRPPSPGISASTDGEVRVVKRSKPAWAIGPENGHVAAAMEKETNDNKKTTDAIKINHQPAAFYTPQFATPTSAAKTTTTPLSVTAGLGPPVNSSSSSSTPSLLSRSINLDIPRETPEERMDDDDGNDSTGGLLVRKTGKNDAVEEQVEQVRLDLDDVSIHGSSPVGPISTFTSRFRNVSITPSQTQKILEQPGEDVPIRRSAIKINGKQKAQRSKDKSDGSESEDDVPLNWPSRKGKGKAAPEPQDNSETQRDDDGVNLGSSNGEEGSSDDHSNPVLPPFLFKDRPAHVRQPLQTLFKGGFVAKHSYQRPLVKSSAVSPVPNANRTSSEPSAKADLLPQKRKRRPKKLTREQWHHIAQNHLSDVDDLLDESSKKRLSPKSAEKLGADLSKLTSPRVFSIVSRSEPRSKGAPIEENDNEYFTDSDSHTSDIALFLQHPDPPPPPERIREAKRNFGTRTIDPWNRQKHTFRSNPALHRAIFEAYIMQSTSMEESGGDDIKVTNEVDADGGPPDFEFVYSDTMLYPDGIPPPELGLGCDCDGPCDPDSETCTCVKRQELYFYDLGLKGFAYDENGKIRENSASIWECNELCGCPPECMNRVIQRGRAKDTGIEIFKTKEKGWGIRARSFIPSGTYIGSYTGELIREAESERRGVTYTAIGRTYVFDLDGWQIRHPPKGLEKIDKRAAELAEAVKMRAKAAMRESQEDAYNAYSVDAFHYGNFTRYFNHSCDPNLAITQAYVKDFHPERPLLVIFTRRDIKKHEELCISYKGIPDDDVPSPEPVKKKKGNKGKKQMSKTSASAHPPEMIALNSDKGPVEVKDICRW

SEQ ID NO: 38735 - protein, 148 aa, Triticum aestivum
MAAAALRAQLNALLANMFTTGMVDEQFQQLQSLQEDGGSASGFVAEVATLFIDDADRIIADIAALLDQPVVDFDKVDAHVHQLKGSSSSVGAQKVKLACMHFRQFYEAKSKEGCLMALALVRSEFCDVRNKFQTMMQLEQQIEACSPK

SEQ ID NO: 38736 - protein, 357 aa, Spinacia oleracea
MTAYRGKYADELIANASYIATPGKVILAADESTGTIGKRFPSINVENVESNRRALRELLFTTPGALPYLSGVILFEETLYQKTADGKPFVDAMKDGGVLPGIKVDKGTVELAGTNGETTTQGLDGLAQRCAQYYTAGARFAKWRAVLKIGPTEPSPLAILENANGLARYGIICQENGLVPIVEPEILVDGTHDIDRCAEVSERVLAACYKALNDHHVLLEGTSLKPNIVTPGSESKKVTPEVIAEYTVRTLQRTVPQAVPGVMFLSGGQSEEEATLNLNAMNKLETKKPWTLSFSYGRALQQSTLKAWQGKEENVAKAQEVFLARAKGNSEATLGKYQGGAGGADASESLHVKDYKY

SEQ ID NO: 38737 - protein, 288 aa, Triticum aestivum
  misc_feature (130)..(130): Xaa can be any naturally occurring amino acid
MEWDRKLVDGLSQDALCDVIIAAKFLHIKGLLDAACQKVAVVDMVNCKTPEQMHQMEEEDMCTWFSGLTPFSEKGTAAAEGARRGRTVGQRPEEKGAMAEETEQVAGENDTFFFRASGKIITLKSSEWDXFPKVSEAAARLSVLLADMIDQGCAKGIIQLPNVDARALATVIEYCNEHAAAAATANPDANHGVAEGSSSCNSEASGEALKEWDRKLVDGLSQDALYDLIMAVNFLHVKGLLDAACQKVADMIKGKSVEQTRKMFGIATDFTEEEEEKLRKESPWAFEE

SEQ ID NO: 38738 - protein, 241 aa, Prochlorococcus marinus str. MIT 9301
MRKSVIAGNWKMHMTCAEAKSYLEEFIPLIKNIKDDRKVVIAPPFTAISTFSDHSDFEYLDISSQNIHWEDQGAFTAEISPKMLLEHGVSYAIVGHSEPRKYFSESDEQINKRAVFAQSSGLTPIVCVGETLEQRERGEADRVITRQVEQGLENTDPSNLIVAYEPIWAIGTGKTCEAEDANKICSLIRKLIGFDDVIIQYGGSVKPNNIDEIMSMSDIDGVLVGGASLDPNSFARIANYQ

SEQ ID NO: 38739 - protein, 210 aa, Arabidopsis thaliana
MAIQKILFASLLICSLIQSIHGAEKVRLFKELDKGALDVTTKPSREGPGVVLDAGKDTLNITWTLSSIGSKREAEFKIIKVKLCYAPPSQVDRPWRKTHDELFKDKTCPHKIIAKPYDKTLQSTTWTLERDIPTGTYFVRAYAVDAIGHEVAYGQSTDDAKKTNLFSVQAISGRHASLDIASICFSVFSVVALVVFFVNEKRKAKIEQSK

SEQ ID NO: 38740 - protein, 339 aa, Microcystis aeruginosa PCC 7806
MFGLIGHLTSLEHAQSVADDLGYPEYANQGLDFWCAAPPQIVDDFHVTSITGQTITGKYIESCFLPEMLSNRWVKSAIRKVLNAMALAQKSDINITALGGFSSIIFEEFNLKDNRQVRNIELDFGRFTTGNTHTAYVICTQVQTLADKMGIDLAQSTVVVCGATGDIGSAVCRWLNEKTDTKELICVARNQERLQSLQEELGRGKILPLEEALPLADIIVWVASMPKGVEIDPDKLKRPCLIIDGGYPKNLGTVLNAPDVSVIKGGIVEHSLDIDWKIMKIVNMDIPSRQMFACFAEAILLELEGWQTNFSWGRNQISVSKMEQIGAASRKHGFQPLLF

SEQ ID NO: 38741 - protein, 131 aa, Zea mays
  misc_feature (35)..(35): Xaa can be any naturally occurring amino acid
  misc_feature (48)..(48): Xaa can be any naturally occurring amino acid
  misc_feature (81)..(81): Xaa can be any naturally occurring amino acid
MQWQGKTKERMASPIPSEWIGLQQFPAGTQTKLHXLLGKLKEEDVSTXTILAMGKGGVGKSSTGNYDRWERAAYVSGFQGXTLNIIDTPGLIVGGYINEEADDIIERLLLSMTIDVLLDLDRMDAYIMDTL

SEQ ID NO: 38742 - protein, 133 aa, Glycine max
MASFTASASTLSVARPALLLKPTVAVSAPVLGLPPMSKRKGGVKCSMETKQGNVSAVGAGVSAAATAALTAVMSSPAMALVDDRMSTEGTGLPFGLSNNLLGWILLGVFGLIWTFYFTYTSSLDEDEESGLSL

SEQ ID NO: 38743 - protein, 508 aa, Debaryomyces hansenii CBS767
MTKLDIQSIAIIGAGPGGLASLYEFLHTNKDGSSTIGSANSIDPKFTKIVAFEQKDKVGGIWATSGADSDLPIPPQDLLDTESYADPDIIHPSQPIPDNLQKTSVHKPVIRKLDPIARELEWNKSGVFPGLFTNIPSRFTRFSYLPNEAKYLDKSRTIYPFLSHDELSKRFSDFVDKENLDDYVRKNSRVEGLFKSNDKWVVTVRHTSTGNEEWYQEEFDAVVIANGHYTVPNIPHIEGLAKFNELHPDILIHSKSYRSAQSFKDKKVLIVGGSFSSANILQYVVPLAKETFISKRGPHLVFPWIDKAVESEGISTKPVIERFLPESNEVLFSDGTKEKDFDVILLATGYHYHYPFLNKYLKVIEPSNLSRVSGLYYDTFSIEDPTLATVGVAISTINFHTIEASASAIAGIWSNAKTLPTKEEQLAWEKNHIEGTANNLFFHYYTHDAVKGNFIDKLHTYSPKGRKNPFEEDSKFLNEINEGATYLESLFYKLKDRTLNIEDTLVSA

SEQ ID NO: 38744 - protein, 205 aa, Ehrlichia canis str. Jake
MNLITKQAIDFTAKAVMPDDKICEFNLKEYVNGKCAILVFYPRDFTFVCPTEIISLHNRIPQFMEKNTEIIGISTDSEFCHSHWRNVSVNKGGIDKISFPLIADDSHFISSSYGVLHNNSIALRATFIIDDKFIVRHQSINDLPIGRNVDELLRIIDAIKHYQIHGEVCPAGWMKGDPAMEASQHGIEDYLKSHIDNLEKSIMDK

SEQ ID NO: 38745 - protein, 291 aa, Brassica napus
  misc_feature (264)..(264): Xaa can be any naturally occurring amino acid
MSSFNQNGDAKNADTSDDIDDIDFSKLLEKPRPLNMERLRSLEERSLTELSTSPPHLRNGDNASASRLQDRAECVVSPSVGFNTPRSLPGFESHPMVGEAWDALRRSLVYFRGQPVGTIAAVDNSEEKLNYDQVFVRDFVPSALAFLMNGEPDIVRNFLLKTLRLQSWEKKIDRFQLGEGVMPASFKVFHDPVRNHETLIADFGESAIGRVAPVDSGFWWIILLRAYTKSTGDSSLADMPECQKGIRLILSLCLSEGLDTFPTXLCADGCCMIDRRMGVYGYPIEIQALFF

SEQ ID NO: 38746 - protein, 104 aa, Leuconostoc mesenteroides subsp. mesenteroides ATCC 8293
MAVKTVEDATFNQETNTGVSITDFWATWCGPCRMQSPVLDVLSDEVDDVKFVKMDVDANPETPAAFGIRAIPTLLIKKDGEVVERLTGFHNKEQLAKILAKYTN

SEQ ID NO: 38747 - protein, 398 aa, Ehrlichia canis str. Jake
MSLIAGRMDCIKPSPTLEIASQAQKLKMSGVDVISLSAGEPDFDTPQHVKQAAIDAINAGKTKYTAVDGIIELKKAIVDRFKQDHDLTYDVNQVSVGNGAKQCIYNLLMATINDGDEVIIPAPYWVSYPDVVKISGGNPVIVDCSETFKLTPDLLESVITEKTKWLIINSPNNPTGLMYTYEELQCIAEVLLKYPNIYIMTDDIYSKIVYDGFKFFTIAQVEPRLYDRVFTVNGVSKAYAMTGWRIGYVAGDSKVISAISVIQSQSTTNPNSIAQFASVHALTGDQEFLKERNKIFAERRDMMMNMVNNTSVLSVKKPQGAFYVFISCKELIGKSAKNGLVINSGIDFTRYLLEDYNVAAVPGEAFGVQGFFRISYATSTEQLSKACDRILDACNKLL

SEQ ID NO: 38748 - protein, 860 aa, Physcomitrella patens subsp. patens
MGLVLPLFVAIVHPLAPQWIEEESSIEAAVSILGSWSIVWVLMLGCFGHMPLPTKLCFSPYNVVLPHTACHPFLFLYDGSTKMGATGSTYSTSIFEESRNQLNSREVGNVVLQGPLLKRSETVRQWEWQWIDLHVLTGKLEYWTHGREAPSTGVVKLDAYSTVMISPVNVIKETQYDACCFCILFVVIVRLRLSRAVLKESKTLKLWLRVRLLRNWRSDIRVITRAAVSVRRAHNEASDLSSNNAHYKLGNVATVVAAANIISQDAAQVLQKSMTIAAVSPSASCIKPIPASASTPSACINKCISSPDVDSSYLMREELKVKDKEIRHLARDLKSRNKVIKELGDRLIETAEAAESTASSVHVVHKRYQESLSEVDRLRRQLAQAVKQIRDADARRAAALIVEEAALQEAHRCRLELGKFQERGVLLQAAMVHIDEDMRRLQDVHKTETAQRLEVPKSRIGRAPQLKIPVIDAILQVNNASEAGDVQSRSEEFNSENCGDDATLLYTSPASVLDLRVDESNAEALVKEVTLQVQSQFSDVDSKIDELILEAYDVQTEFSDTIQASELELAGTREGPTAALIMDSCPLPMNISTDCEAVLRTLIISTPELVSCATPTEDGGSPSVNGTDHREFAGDVCPTLSRLPEVSRSNGCKAVPSPPSFSASPLPDRELAGSCEDLALDPAPRLAVPSCQLPVNSFPDEVAGVTKSATSTQELFSGAVSSAVGASPSSSVANHHEKAASTYPTIPNLDDTALSSQSNSTTDCGGVLTTSVCTDSSSEAFHFANGSEDHCNTTFGNDVVETTGSDEVIRTTADGTEEVTRREVIVEKTVVKQQQYQAFTRYGLVLRSPISRLDFAEGSP

SEQ ID NO: 38749 - protein, 275 aa, Bradyrhizobium sp. BTAi1
MAMHQTNPQGGKLAALDPIWDRIRHEAEEIVRREPELATFIYSTVLHHSRLEDSVVHRVADRLDHSALSGDLIRQTFDDALRDEPDLGHAFRADLVAVYDRDPATARFIDPLLYFKGFHALQTHRLAHWLHRKNRKDFAFYLQSRSSAVFQTDINPAARIGRGIFLDHATGFVCGETAIIEDNVSILHGVTLGGTGKENEDRHPKIRHGVLIGAGAKVLGNIEVGHCARIAAGSVVVKPVPNNVTVAGVPAKIVGEAGCAEPSRTMDQMINAIGI

SEQ ID NO: 38750 - protein, 218 aa, Leuconostoc mesenteroides subsp. mesenteroides ATCC 8293
MSGIIAPSILSADYTNLERDVKLVEAAGAEYLHIDVMDGTFVPAISYGPNWVKQLRPETDLVLDVHLMIQNPERFVEEFADAGADIIGVHVEATPHIHRALQMIKNKGVKAEVVINPGTPVSAIEAVLDMVDQVLVMTVNPGFGGQKFLPSTLQKIEQLQTFREERGFDFDIEIDGGVNNETIKSAYDAGAKVFVAGSYVYDKVDPAAKIGILKDLIK

SEQ ID NO: 38751 - protein, 269 aa, Physcomitrella patens subsp. patens
LALLLILVLFPELALTQPNKDDIACLQGFQSMVKGADPALFINWTSSAFPCNTTQDGRGPTFVGVTCSSSRVVSLVLSNKGLTGTISPNLSLCRNLGILDLSQNSLTGTLPSTLGMLSYLMTLNVSHNQISGPIPAEIANCSYLHELDLEQNRFSGELPAALATLQKLQTFDVSHNNLEGPIPTGLSNTSDGRPRFNASSFEGNPGLYGFPLPYAKGHNLSILAIVGIGLGSGFLSLIVSFTAVCIWLRVTEQRLAAEEGKISQLVPEY

SEQ ID NO: 38752 - protein, 120 aa, Nicotiana benthamiana
IPVLIHNGKTICESIIAVEYIEEVWKDKAPNLLPSDPYDRAQARFWADYIDKKLYDVGRKLWATKGEEQEAAKKDFIECLKVLEGALGDKPYFGGESFGFVDIALIGYYSWFYAYETFGN

SEQ ID NO: 38753 - protein, 122 aa, Nicotiana benthamiana
TKEPILIHNSKPICESLNILEYIDEVWHDKCPLLPSDPYEKSRARFWADYIDKKIYSTGRRVWSGKGEDQEEAKKEFLEIFKTLEGELGNKTYFGGDNLGFVDVALVPFTSWFYSYETFANF

SEQ ID NO: 38754 - protein, 193 aa, Ipomoea batatas
MATAMLKRTTMVKPMVNRLRSYASVAVGSDLISAAPNASLQKARSWDEGVSSNFSTTPLKDIFKGKNVVIFGLPGAYTGVCSAQHVPSYKNNIDKFKAKGIDSVICVAVNDPYTMNGWAEKLQAKDAIEFYGDFDGSFHKSLDLTIDLSGALLGIRSHRWSAYIADGQAKGLNIEQAPSDFKVSGGDVILGQI

SEQ ID NO: 38755 - protein, 473 aa, Bacillus sp. PS3
MTRGRVIQVMGPVVDVKFENGHLPAIYNALKIQHKARNENEVDIDLTLEVALHLGDDTVRTIAMASTDGLIRGMEVIDTGAPISVPVGQVTLGRVFNVLGEPIDLEGDIPADARRDPIHRPAPKFEELATEVEILETGIKVVDLLAPYIKGGKIGLFGGAGDGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAIGYQPTLATEMGQLQERITSTAKGSITSIQAIYVPADDYTDPAPATTFSHLDATTNLERKLAEMGIYPAVDPLVSTSRALAPEIVGEEHYQVARKVQQTLERYKELQDIIAILGMDELSDEDKLVVHRARRIQFFLSQNFHVAEQFTGQPGSYVPVKETVRGFKEILEGKYDHLPEDRFRLVGRIEEVVEKAKAMGVEV

SEQ ID NO: 38756 - protein, 351 aa, Oenococcus oeni
MEQKLGNLVKKNVVNSVFQGRSLLAEKDFTPMELEYLIDFALHLKALKKLGISHRYLEGKNIALLFEKTSTRTRSAFTTASIDLGAHPEFLGSNDIQLGKKESVEDTARVLGSMFDGIEFRGFKQSVVDDLARYSGVPVWNGLTDEWHPTQMLADFMTIKENFGHIKNINLSYMGDGRNNTANSLLITGSMLGANIRIVSPKELQPSEKTTELAKKFAEKSGSRFLITDNIDEGVSKTNVLYTDVWVSMGESDWEDRVKLLKPYQVNMETIRKTSTPDDQLIFMHCLPAFHDINTDYGHEIFEKYGIKEMEVTDEVFRSIYARQFEEAENRMHSIKAIMAATLGNLFIPHV

SEQ ID NO: 38757 - protein, 98 aa, Vitis vinifera
LLQDANLNDLTQLSWGIVNDTYKMDLILIYPPHLIALACIYIASVHKDKETTAWFEELRVDMNVVSFFELKCYLAITSLCLVIYVTWTWVQVLGVDVH

SEQ ID NO: 38758 - protein, 310 aa, Bacillus thuringiensis
MAIRKHLITLEDLTDSDINQIVTRGVEFATGKSQPNQILAGNIIGIYFRKTSTRTRSAFSVAALKMGAQIVTYGPNDLQENTGESIEDTTQVLSRMLDALVARTADSQKEMEKLASQSRMAVINAMSTEEHPTQALTDLTTMKQKFGEIAGLRVLYMGEGNNSAAALALSLSRFPGTELYLFTPAGYGVSPSVLEKSKEYARLSGAKVIECHDIKMLPSEVDVVYTTRWQTTGTSKIDPLWKDAFNPFAVTERILTLYPEATFMHDLPAHRGEEVAATVIDGPKSIVFTQAENKLNSAMAVLEWCLAYRY

SEQ ID NO: 38759 - protein, 476 aa, Bartonella quintana str. Toulouse
MLFDEKHNKLKRSLQNRHVQMIALGGVIGTGLFYGSTESIRLAGPSTILAYLFGGLIMYFIMRMLGEMSVEEPTSGAFSFFAYKYWGSLAGFITGWNYWFLYILVSMTELTVIGFYLDHWLLIDHWKSSFIVLLLVTLINLLNVRFYGEFEFGLALIKVAAVVGMIVFGIFLIVTEIGENQASISHLWDHGGFFPYGAMGVVLATCVVMFSFGGTELIGIAAGEVSNPQKTIPIAIRKVMWRIVIFYIGSISVIMMISPWNMIGKDVSPFVKIFEIIGIPAAGHILNFVVIMAAISVYNSGIYSNGRMLYSLAIQKNAPHIFSKLSAARVPYVAILFSSICTAIIIVMNAFVPNNSFMRIMALATAAAIITWSIIVIVHLKFRKVHKDRKGAFIYAFALYPYANYLCLCFLAALFCIMFVSGFGKNGLMAQLFNVVGISASSVESYIPAQMPDMSLAVIIIPLWCLLLLLGYKLKR

SEQ ID NO: 38760 - protein, 244 aa, Photobacterium profundum SS9
MISITFPQESIMSSIKQNIEQVISQITSSTEKCGRTADSVQLLAVSKTKPIAAIDDAIAVGQRAFGENYVQEGVEKVQHFAGHAQAEEIVWHFIGPIQSNKTRPIAEHFDWVHSVDRIKTARRLNEQRPSSMAPLNILLQVNTSGEESKSGIHVTDLAALADEIATMPNLVLRGLMSIPQKADSYDSQYAAFKLLADAQQQLHIKYPQIDTLSMGMSGDMDAAIAAGSTIVRIGTAIFGARDYT

SEQ ID NO: 38761 - protein, 325 aa, Bacillus thuringiensis
MLKKLESLERVIGNTPMIKLEHEKINLYAKLEYHNLMNSVKVRAAHHILKSAISRGEVTENSTIIESSSGNFAVALATLCRYIGLKFIPVIDPNINDSYENFLRATSYQVAKVDERDETGGYLLTRLNKVEELLNTIPNAYWTNQYNNADNFEAHYQGIGGEISNDFKQLDYAFIGVSTGGTIAGVSTRLKEKFPNIKIIAVDSQGSIIFGDKPRKRYIPGIGASMIPGMVKKALIDDVMIVPEVHTVAGCYELFNKHAIFAGGSSGTSYYAIQKYFENKDVQNTPNVVFLCPDNGQAYTSTIYNVEWVEWLNTQKSVEDQLVSL

SEQ ID NO: 38762 - protein, 214 aa, Arabidopsis thaliana
MGVKRAPNMCASVGIQGIAWAFGGMIFALVYCTAGISGGHINPAVTFGLFLARKLSLTRAVFYIVMQCLGAICGAGVVKGFQPNPYQTLGGGANTVAHGYTKGSGLGAEIIGTFVLVYTVFSATDAKRSARDSHVPILAPLPIGFAVFLVHLATIPITGTGINPARSLGAAIIYNKDHAWDDHWIFWVGPFIGAALAALYHQLVIRAIPFKSRS

SEQ ID NO: 38763 - protein, 272 aa, Photobacterium profundum SS9
MEQRSITFIGAGNMARSIIAGLVASGYPANKITATAPSEARREPLARDYGIHTDADNLRAAQQADVIVLAVKPQLMESVCSALQDIDFSNKLVISIAAGISASRLNEMLNTELNLVRVMPNTPSLIGKGMSGLFASQSVSENDKVYAEQLMQAVGEACWVQQESGINGVIAAAGSAPAYFFLFMEAMQKEAIKQGFDADTARLLVQQSALGAAELVKANPETELSTLREQVTSKGGTTAEAIRTFNEHQLSDIVAKAMRAAVSRAEEMEKLF

SEQ ID NO: 38764 - protein, 503 aa, Coprinopsis cinerea okayama7#130
MLSNLLPLAILAVSLRPLIVPVTAQAIPPVATMTVSNINASPDGFTRPVVAVNGQHPPPPILANKGDDFQITVVNNLDDPTMLRQTSVHWHGIFVHKAAWADGPDGVTQCPIAQSGDSFTYSFDAGNEAGTFWYHSHYGTQYCDGLRGPLVIYDDNDPYKNLYHLPTPSIAGIALSDATLINGKGRRPGGPLTDIEIVNVQPGTRYRFRLISMACEPTYKFSIDGHNMTIIEADGQLTEPHTVQEITIFTGQRYSFILEANQPVGNYWIRAIPNLGARNLPDFSSGGINSAILRYAGARPRNPTTRAPRNPVVLKEANLRTLLNPGAPGGSGPADENIVFNLALNAEETGFVMNGVAWANPDIPVMVQLMNGVPAEDIIPQGAYRTLPRNSVVEVSIPGFEIAGPHAFDVVRSAGSDTYNYVNPVRRDVVDIGGAGDNVTIRFRTDNPGPWFFHCGLAMVFLEAPGDIASNSPPPPSWDALCPKFKSLPANATSIQIVPTPTP

SEQ ID NO: 38765 - protein, 500 aa, Thermoplasma volcanium GSS1
MDIFHIFSDKRLNTVYLSKNMEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 38766 - protein, 482 aa, Neisseria meningitidis
GSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASARKITKANFPWAASGRAIANGCDKPFTKLIFDAETGRIIGGGIVGPNGGDMIGEVYLAIEMGCDAADIGKTIHPHPTLGESIGMAAEVALGTCTDLPPQKK

SEQ ID NO: 38767 - protein, 334 aa, Shewanella sp. ANA-3
MLKNNLNDGLQLDRTFSIAPMLDWTDRHYRYFARLMSANALLYTEMVTTGAILHGRGDYLAYNQEEHPLALQLGGSNPAELARCAKLAAERGYDEVNLNVGCPSDRVQNGRFGACLMAEPELVAECVDAMKQAVDIPVTVKTRIGIDEQDSYEFLTHFIDTVMAKGCGEFIIHARKAWLQGLSPKENREIPPLDYDRVYQLKRDYPTLNISINGGITSLEQAKTHLQHLDGVMVGREAYQNPYILAQVDQLLCGSQKAVMSREAVIETMLPYIEAHLQAGGRLNHITRHMIGLFQGLPGARAWRRYLSENAHKNGAGIEVVKQAYQSIQSEITA

SEQ ID NO: 38768 - protein, 355 aa, Physcomitrella patens subsp. patens
MTGLTPPPKLAYLILGAGGDGLRMQRMLQALYHPHNYYLLHLDRESSEDERKNLDRYVKHEQVFQEAGNVYMVAKPNLVTYKGSTMIAATLHGAAILLKKAKDWDWFINLSASDYPLLTQDDLLHVFSYLPKDLNFLEHTNDLGWKEEQRVKPIIIDPALYQNTKTDVYWVTEKRAVPTAFRLFTGSAWIALSRAFMEHTIMGWDNLPRTVLMYYANFVSSPEGYFHTVICNSEEFRNTTVNHDLHFIAWDTPPKQHPISLTVNFFEAMTTSGAPFARKFDKDDPVLNKIDAELLNRTRDGFSPGGWCVGSHNNPCSVRGDYSVLRPGPGARRLEDLIVQLLLPERFRSSQCAGV

SEQ ID NO: 38769 - protein, 306 aa, Photobacterium profundum SS9
MKPTKELLAGILDEVRPLIGQGKVADYIPALAGISATKLGIAVCYNDGEIIQAGDTQERFSIQSISKVMSLTLAMSLYEPEEIWRRVGKEPSGHAFNSMIQLELENGIPRNPFINAGALVVSDLLHSRLAAPQYRMLELVRKLSCNPHLTYDKAVAASEMQHSDRNASIAYLMRSFGNFENEVMPVLTNYFSYCSLNMSCIDLARTFSYLANKGLPLGAKKTIISQTQSKQMNALLATCGLYDGAGEFAYRVGMPGKSGVGGGIVAIVPGEMSITVWSPELDPSGNSLAGTAALELLAERIGRSIF

SEQ ID NO: 38770 - protein, 172 aa, Staphylococcus aureus subsp. aureus
MDLKQYVSEVQDWPKPGVSFKDITTIMDNGEAYGYATDKIVEYAKDRDVDIVVGPEARGFIIGCPVAYSMGIGFAPFRKEGKLPREVIRYEYDLEYGTNVLTMHKDAIKPGQRVLITDDLLATGGTIEAAIKLVEKLGGIVVGIAFIIELKYLNGIEKIKDYDVMSLISYDE

SEQ ID NO: 38771 - protein, 628 aa, Oryza sativa
MTCGERDGSQVFGGDLMGRSGLGFGGEPRSVTGGAKSSWVHGTDKGRLWKEDPKGMFTDNIQTNGASITWEEGLMPESLQLKLGGFWANPTPPLKMSRRSRRGEELMGLPEKRHLVTRLTKRFSQKKPCRRNTSTHDCCRFPQRSRKPSVDEQFARFVEVIQKIHINVPLLDAMQVPTYASYLNDILNNKRPLPTTEVVKLTEQCSNVILHKLPEKKKDPGCPTISYDQTLCDLGASVSVMPKDVFDKLNFTVLAPTPWKAMPSKGSSQMTMTNQRNLSDRRAQQPLSQVYVDVDSEHGTAERQEIGTTKRARWSHQMKMFLIELLTDHDVPGFRTQNAWSKEAWTNIVCRLNTKFGTSFTTNQVKQKEQDLKKDYRSVKDLLDQSGFGWDSDRMMVSAPQSVWDTFADRKNKDAIHWRDKSFPYFDDLAPLYDGRYAEGRTRHGMDHYARKTKNAPAHSTQEANAVDTYQSPSPNSNAPGESGLQFPFGEEVETANLDFSQHSPTPVHLTKVPPSSAQTPSEVPESRPGKKQKIKSVSPDDGFHERYLKLKKEEIDRFAAIEEKKLEDPYSINKCITVLEGLHGLQIGDILVAADIFKGKDNREVFLSFSSDALRLAWIRKEIAALE

SEQ ID NO: 38772 - protein, 147 aa, uncultured Geobacter sp.
  misc_feature (132)..(132): Xaa can be any naturally occurring amino acid
IGGGNMAEAIIKGLLAGGVPAANLAVSEPADARRKLLSDRYGIKAISDNVELCRMSETVVLAVKPQICSDALWEIGGVSAGRLFISIMAGVKCEAIEGMLQSEEARVVRVMPNTPALVLEGATAISRGSRAXDEDLLLTRRIFDLVG

SEQ ID NO: 38773 - protein, 1221 aa, Lotus japonicus
MLTKFETKSNRVKGLSFHTKRPWILASLHSGVIQLWDYRMGTLIDRFDEHDGPVRGVHFHNSQPLFVSGGDDYKIKVWNYKMHRCLFTLLGHLDYIRTVQFHHENPWIVSASDDQTIRIWNWQSRTCISVLTGHNHYVMCASFHPKEDIVVSASLDQTVRVWDIGSLKRKAGPPADDILRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDATKRTGIQTFRREHDRFWILATHPEMNLLAAGHDSGMIVFKLERERPAFAVSGDSLFYAKDRFLRFYEFSTQRETQVLTIRRPGSLSLNQSPKTLSYSPSENAVLLCSDVDGGSYEFYCISKDGIKDSFGRGDTQDPKKGLGGSAVFVARNRFAVLDKGSNQVFVKNLKNELVKKSVLPIATDAIFYAGTGNLLCRSEDRVFIFDLQQRLVLGDLQTPFIKYVIWSNDMESVALLSKHAIVIASKKLVHQCTLHETIRVKSGAWDENGVFIYTTLNHIKYCLPNGDSGIIKTLDVPIYITKVVGNTIFCLGRDGKNRAITIDATEYVFKLSLLKKRYDHVMNMIRNSQLCGQAMIAYLQQKGFPEVALHFVKDERIRFNLAIESGNIQIAVASATAIDEKDHWYRLGIEALRQGNAGIVEYAYQRTKNFERLSFLYLITGNVEKLSKMLKIAEVKNDVMGQFHNALYMGDIRERVKILENVGHLPLAYITASVHGLHDVAERLATELGDNVPSLPEGKVPSLLIPPSPVLSGGDWPLLRVMRGIFDGGFNQTDRDADEEEYEAADGDWGEELDMVDVDGLQNGDVAAILDDGEVGEEGDEEGGWEMEDLELPPEAETPKASVSSRSSVFVTPTPGMAVSQIWIQRSSLAADHAAAGNFDTAMRLLNRQLGIKNFAPLKSLFLDLHSGSHSYLRAFSSAPVVSLAVERGWNESSSPNVRGPPALPFKLPQLDEKLKAGYKATTAGKFTEALRTFVNILNTIPLIVVESRREVDDVKELIIIVKEYVLGLKMELKRREIKDDPARQQELAAYFTHCNLQTPHLRLALLNAMTVCYKAKNLATAANFARRLLETNPNIENQAKTARQVLAAAEKNMTDATELNYDFRNPFVICGSTYVPIYRGQKDVSCPYCTSRFVPSQEGQLCAVCDLSVVGADASGLLCSPSQVR

SEQ ID NO: 38774 - protein, 525 aa, Synechococcus sp. WH 8102
MADHNVDLLVIGAGASGASVAMEAVRRGLTVALLDAGDIGGGTSCRSTKLLHGGVRYLELAFKTFDLAQLQLVREALLERGHWLEQAPFLAHRLELVLPTDTLWGQLYYQAGLGLYDLLAGQQRIGRSRGISRDALQESLPMLKPGRGGVAYSDGQFDDARLNLLLARTAEQGGASLRTRCRVVGFERSADGRLSAAISETDTGMQEHWAAGVIVNATGIQADSIRQLADPQAAPRMLTSRGCHLVLKQNLCPGGQGLLVPSTADGRVLFMLPFHGRTLVGTTDAPCAIDAATTPTNEEEAYLLGYVRQWFPAVSDPTVTSRWAGGRPLLRPAGDSLNSSRVVREHEVEQLPCGLVSVMGGKWTTCRPMADDTLQAVAAQMGRPLGAPQQLNLLGSADTPSETRQLLMEQAGQLKDLLPDGPLRDQQITHLQSNHGLQALPMISRVDPTLRQPLSSVIPLCQGEIDHAIQREHSRSASDVLSRRCRLAMVDLAEARRLQPLVEERLDQLTGTAVSTSPINHQLMP

SEQ ID NO: 38775 - protein, 263 aa, Debaryomyces hansenii CBS767
MNNKIEFALITGASNGIGLELSRVFAKNNYGIIAVARNRDNLEILKNELQNYGSEVHVLVADLSDFNEIKKVEAEVENHKWNIDTIVLNAGQGLGGDFIEHTDLEAELKLIRLNVDSYVHLSKIFFPKLIERGRGSVLMTSSVSGTTPIPYEAVYGATKAFVNSFFWAVRNELKGKGINMTLLMPGATETNFFINAGLGETTIGSGEKDDARDVAERAWYALQSGHEYVYGSEKAEYEGDVLNRIQSELQKAQRHRIVSEPKK

SEQ ID NO: 38776 - protein, 147 aa, uncultured Geobacter sp.
IGGGNMAEAIIKGLLREDSPATLMVAEISVERRSHLAKTYPGIRVVENSAQAAAWGDVIILAVKPQQAATVLTTIRQAVGPGKLVVSIMAGVRSASLEETLESGARVVRVMPNTPALAGSGATAICAGQNASKADLDCVETIFARTG

SEQ ID NO: 38777 - protein, 459 aa, Synechococcus sp. WH 8102
MTLSIDELRRMQDSVGRGLTRAATWRQEQLQRLSELVEQHEQEVLAALAADLGKPPTEAFFEIVALRQELKLAQRQLRRWMRPRRVTVPLAQRPGRADVIPEPLGCVLIIGPWNYPFSLTLQPLICALAAGNTAVLKPSEHAPAVAALISRLIAEHFEPEVVRVDLGDGAVAAALVALPFDHIFFTGGGAIGRKVLEGAAAHLTPVTLELGGKSPALVLEGADLTVSARRLIWGKGLNAGQTCIAPDHLIVQPGLKAELLKAMDSARTEMYGTAPLASEQLACIVNDRQFQRLEALLDQAQQAGRVLIGGEINRDQRRIAPTVIRVDDRQDPLMADELFGPLLPVLELADLPQTLAEIRQGPKPLALYLFGGNEAQQQQVLETTSSGGVCLNDVVMQAGVPDLPFGGVGGSGMGSYHGQAGFDTFSHAKAVLRRPFRLDFKLRYPPYGIDLNLLRRLAG

SEQ ID NO: 38778 - protein, 147 aa, Leuconostoc mesenteroides subsp. mesenteroides ATCC 8293
MTKYNDEELRARLTPEEYEVTQHAATERPFTGKYDQWWEDGIFVDVVSGEPLFSSTDKYDSGCGWPSFTKGIDDDEHLQENTDRSLGMTRTEITSKEAASHLGHVFNDGLPDRGGLRYCINSASLRFIPKKDLEKDGYGKYLKLFKD

SEQ ID NO: 38779 - protein, 166 aa, Triticum aestivum
SKLAGGFPRAKETSSNRQPASPSHLISLDRTPCAEPFQHKTTAKMSSTATVTRAHLENKLALAKRCSREATLAGAKAAAVATVASAVPTLASVRMLPWAKANLNPTGQALIVCTVAGMAYFVAADKTILSLARRHSYESAPDHLKDTSFAGAAAAARPRPPAFFRP

SEQ ID NO: 38780 - protein, 146 aa, uncultured Geobacter sp.
IGGGNMAEAIIKGLLAGGVPAADLAVSEPSEQRRNVLSGRYGIQVTGDNAALCEMSDTIILAVKPQVATQALTGIGHGTANKLFISIMAGVKSAAIEGILGSNARVVRVMPNTPALVLAGASAISRGYHATDEDLTLTRRIFDLVG

SEQ ID NO: 38781 - protein, 360 aa, Thermobifida fusca YX
MRAVRYDGTGLYLSDIPAPVAGPGQVVLEVTAAGLCHSDLAVMSRPPEALPYKLPITLGHEAVGVVVDVGAGISGLAEGDTVAVYGPHGCGACRTCRSGAENHCPHARAAGILPPGLGADGALADYLLVPHSRHLVPLRGLDPVRAAPLTDAGLTSYHAVRSALPRLPPDGTALLIGIGGLGHLAVQILRALSSAQIIAVDMAADKRELALRCGADTALPSTDTVPDQVRDLTEGVGADVVFDFVASDATLRMAARSLRPGGEISIVGVGEGRLPVAVNLVPLGAVVRTPYWGTQSDLVDVLALAREGRITVEVEEYALEETPLAYERLARGNVRGRAVVNPARAPGNAPGQACAEEQRG

SEQ ID NO: 38782 - protein, 194 aa, Leuconostoc mesenteroides subsp. mesenteroides ATCC 8293
MDVHNVEMVMSAVSASQYPTDGKPEIALVGRSNVGKSSLTNTLIQRKNFARTSSQPGKTQTLNFYDVEDKLYFVDVPGYGYAKVSKAQREAFGVMIEEYITSRKQLRGVISLVDARHEPSEDDISMYEWLHYYNIPILVVATKSDKISRGKFNKAESVIKKALGFDNEDSDFQFFSSETKYGKDEVWHWIEQHI

SEQ ID NO: 38783 - protein, 318 aa, Vibrio vulnificus YJ016
MNKAHSRAEEYPMNKLVVLGSVNADHVLQVPSFPRPGETLHGRNYQVIPGGKGANQAVAAARLGADTGFIACVGDDSFGINIRENFKLDGIQIDGVKMQPNCPTGIAMIQVSDSGENSICISAEANAKLTEAAIESDLPRIRDARFLLMQLETPICGIELAAREAKAAKTNVILNPAPARTLSDELLACIDVITPNETEAQVLTGIEVVDNESAQQAANVLHQKGIEIVMITLGSKGVWLSENGRGQRICGFKVDVTDTTAAGDTFNGALVTGLLEDMPLESAIKFAHAAAAISVTRFGAQTSIPTRKEVDEFLAAHS

SEQ ID NO: 38784 - protein, 223 aa, Oryza sativa Japonica Group
MAPQKRTTLVYSFVARGAVVLADHAEVSGNFASVAAQCLQKLPSTNNRHSYNCDGHTFNYHVHDGFTYCVVATESAGRQLPVGFIERVKEDFSKKYSGGKAKNATANSLKREYGPKLKEHMKYCDAHPEEIDKLAKVKAQVTEVKGVMMQNIEKVLDRGEKIELLVDKTEDLRSQAQDFRKAGTKIRRKMWWENMKMKLIVFGIVVALILVIILTVCRDLNCW

SEQ ID NO: 38785 - protein, 673 aa, Aspergillus nidulans FGSC A4
MHRMLFVCGLFLLSVQGLLIRHDGSFQPDHILRVNSKNYMQACSPRYSVLVNGSFPGPEIRVQEGQTSWIRVYNDMENLNVTMHWHGLTAITAPFSDGTPMASQWPIPPGHFFDYEVKVEPGYAGTYFYHSHVGFQAVTAAGPLIVESTKPPPYFYDEERIIALSDFFSKTDKEIEHGLMSSQFQWSGETEAVLVNGHSLSPSPMNGTGSCRREVLQVEPGKTYRLRIIGATALSFISFVIESHDVEIIEADGHYTQKLKTHNLQIAGGQRYSVLLKAKDNAALEQLSQRHFIIQITTLARPTTLTTYAILQYPSNAPASLTNVSATPLMPVPSIAYGWLDYQLQPLERDPDFLTSDSVTRRIVIDVHQNFSDHVLWLQSGYDWVETFPETPYLVQIQRGELNVTESLQKAISAGNNFDKDYRIFPAQLGEVLEIVWQNRGAVGNSTVRNRGVETHPFHGHGRHFYDIGGGDGEYNAAENEKRLQETQPVLRDTTVLYGYSREVAPGAPSGWRAWRIRVTNPGVWMMHCHTLQHMIMGMQTVFVFGDQDDMKENMGTYNSGYLTYGGSAYGNETFFPETFCMILHNGVQDAVIVFQRPEEDGDNLAMSEVLDGPLLEKYIELIKQQYGVRFFRKALSGFWTLSAIASGVNVLQVPGLSMKSIMEVFCVDYHHN

SEQ ID NO: 38786 - protein, 335 aa, Propionibacterium acnes KPA171202
MTVKVGINGFGRIGRNFFRALAEQGADLEVVAVNDLTDTKTLAHLLKYDSIMGRFSGEVSYDDDSITVDGKTIKVLAERNPADLPWKELGAEIVVESTGLFTDGEKAKAHFEAGAKKVIISAPGKNVDGTFVMGVNDGDYDNAKHNIISNASCTTNCLAPLAKVLNDAFGIERGIMTTVHAYTGDQRLQDAPHKDLRRARAAALNMIPTKTGAAQAVALVLPELKGKFDGLAVRVPTPTGSLTDLTFQTSKETTVEEVQAAVKKAAEGPLKGILAYTEDPIVSKDIEGDPHSSIFDATETKVIGNLVKVLSWYDNEWGYSNRLVDLTKLVASKLA

SEQ ID NO: 38787 - protein, 332 aa, Ipomoea batatas
MARSISCFFMAITLLAFAPVSLCYKGYGGSLYPQYYEKSCPRALEIVRSEVAKAVAKEARMAASLIRLSFHDCFVQGCDASILLDSGNGITSEKNSNPNRNSARGFDVIDDIKAALEKECPQTVSCADIMQLAARDSTHLSGGPFWEVPVGRKDSRSASLSGSNNNIPAPNSTFQTILNRFKNQGLDLVDLVALSGSHTIGNSRCVSFRQRLYNQAGNNQPDSTLDQYYAAQLRNRCPRSGGDSNLFFLDFVSPTKFDNSYFKLLLANKGLLNSDQVLTTKNEASLQLVKAYAENNELFLQHFASSMIKMANISPLTGSNGEIRKNCRKINS

SEQ ID NO: 38788 - protein, 402 aa, Propionibacterium acnes KPA171202
MKSVEDLGDLRGKRVVIRCDFNVPLDGDKITDDGRIKAALPTLTQLHEAGARTTVLAHLGRPKGAVDPKYSLAPVAKRLGELMNLDVKLAGDVVGPSATKTSESLADGEIALVENVRFEKGETSKDEAERAELAQKYASFGEFYVSNGFGVVHRKQASVYDVAKLLPSAAGSLVAKEVEVLEGLTADPKRPFVVVLGGAKVADKLAVIDNLLKAADTLVIGGGMAYTFLKAKGLEVGDSLLDEDSIDACTKYLEQAKAAGKQILLPVDVRVVSDIDFEARTVGQIDVVPADEIPSDKMAVDIGPETEKAYANAIKGAKSVFWNGPMGVFEIKGLELGTKAVAQALTEVDGLSVVGGGDSASAVRTLGFADDQFGHISTGGGASLELMEGKELPGIAVLKENN

SEQ ID NO: 38789 - protein, 1049 aa, Glycine max
TRPGNNVNGDPFIACDVCAFPVCRACYEYERKDGNQSCPQCKTRYKRHKGSPAILGDQEEDGGADEGASDLNYNSENQNEKQKIERMLGWQMAHGRAEEAVAPNYDKEVSHNHIPLLSGGQEVSGELSAASPERLSMASPGGRGKRVHNLQYSSDLNQSPNIRVGDPGLGNVAWKERVDGWKMKQDKNVAPMSTGQATSERGAGDIDASPDVLVDDSLLNDEARQPLSREVSIPSSRINPYRMVIALRLVILCIFLHYRITNPVPNAYALWLISVICEIWFAISWIFDQFPKWLPVNRETYLDRLALRYDQEGEPSQLAAVDIFVSTVDPLKEPPLVTANTVLSILSVDYPVDKVSCYVSDDGAAMLTFEALAETSEFARKWVPFSKKYNIEPRAPEWYFAQKIDYLKDKVQPSFVKDRRAMKREYEEFKIRVNGLVAKAQKVPEEGWVMQDGTPWPGNNTRDHPGMIQVFLGQSGGLDTEGNELPRLVYVSREKRPGFQHHKKAGAMNALVRVSAVLTNGPFLLNLDCDHYINNSKALREAMCFMMDPNLGKHVCYVQFPQRFDGIDRNDRYANRNTVFFDINLRGLDGIQGPVYVGTGCVFNRTALYGYEPPLKPKHKKPGLLSSLCGGNRKKSSKSSKKGSDKKKSSKHVDPTVPIFNLEDIEEGVEGTGFDDEKSLLMSQMSLEKRFGQSAVFVASTLMENGGVPQSATPETLLKEAIHVISCGYEDKTDWGSEIGWIYGSVTEDILTGFKMHARGWRSIYCMPKRPAFKGSAPINLSDRLNQVLRWALGSVEILFSRHCPIWYGYGGRLKWLERFAYVNTTIYPVTAIPLLIYCILPAVCLLTNKFIIPQISNLASIWFISLFLSIFATGILEMRWSGVGIDEWWRNEQFWVIGGVSAHLFAVFQGLLKVLAGIDTNFTVNSKASDEDGDFAELYMFKWTTLLIPPTTLLIINLVGVVAGISYAINSGYQSWGPLFGKLFFAFWVIIHLYPFLKGLMGRQNRTPTIVVVWSVLLASIFSLLWVRIDPFTTRVTGPDVEECGINC

SEQ ID NO: 38790 - protein, 259 aa, Propionibacterium acnes KPA171202
MSRTPIMAGNWKMNLDHVAATSLVQDLGEALKAAGYDSSKSEAVVIPPFTDIRPVAIIIDGDKLPIAYGAQDISAHDDGAYTGEVSGAMLSKLGCRYVVVGHSERREYHNESDELVNAKAKKVIENGMTPIICCGEALEVRKAGKHVEHTVGQIKADLDGIPAEQVAKLVIAYEPIWAIGTGETATADDAQEVCQAIREAVKELYDAPTAEAVRIQYGGSVKPANVAEIMAKPDVDGALVGGASLKAGDFSKIVTFYEA

SEQ ID NO: 38791 - protein, 336 aa, Ipomoea batatas
MAVSIRCFFMAITLLAFAPLSLCHKGYGGGGGSSLYPQYYEKSCPRALEIVRFEVAKAVAKEARMAASLLRLAFHDCFVQGCDASILLDSGNGITSEKNSNPNRKSARGFNVIDDIKAALEKECPHTVSCADIMQLAARDSTHLSGGPFWEVPLGRKDSRSASLSGSNNNIPAPNNTFQTILTKFKRQGLDLVDLVALSGSHTIGNSRCTSFRQRLYNQSGNSKPDSTLDQYYAAQLRNRCPRSGGDQNLFFLDFVSPKKFDNSYFKLLLANKGLLNSDQVLTTKSEASLQLVKAYAENNELFLQHFASSMIKMANISPLTGSKGEIRKNCRKINS

SEQ ID NO: 38792 - protein, 330 aa, Eucommia ulmoides
MSGIGYFGIVVLALLGLVVGSVHGDLRMNYYARSCPNAEKIVQDYVKRHIPNAPGLAATFIRMHFHDCFVRGCDGSVLLNFTASTGNQTEKVVVPNQTLRGFDFIDRVKSLLEAECPGVVSCADVISLVARDSIVTTGGPFWRVPTGRRDGSISNASEALSNIPAPFFNLSALQTSFANKGLDLRELVLLSGAHTIGISICTSFANRLYNFTGVLGTQDPSLDSEYAANLIANKCRTITDNTTIVEMDPGSFRTFDLSYYRLVLKRRGLFQSDAALITSSTTRSYIDQILNGSLENFFAEFARAMEKMGRIEVKTGSQGEIRRNCAVVNS

SEQ ID NO: 38793 - protein, 252 aa, Coccidioides immitis RS
MAPPAIIAPSILSADFANLGAECSNLMKADSDWIHVDIMDGHFVPNITFGAPVVSNIRAHVQKPASIGGKGTFDCHMMIAEPQKWVKEFKQAGCDLYCFHWEAAMTSTAAKDPTDKETTARTSPKELIRYIHETGMQAGIALKPATSVDVLWDILENPVEIERPDMVLIMTVNPGFGGQKFMASELPKVAALRKKYPDMNIEVDGGLGVGTIDQAADAGANVIVAGSAVFGAKDPAEVIAKLREAVEKRRSA

SEQ ID NO: 38794 - protein, 199 aa, Oryza sativa
  misc_feature (10)..(10): Xaa can be any naturally occurring amino acid
  misc_feature (26)..(26): Xaa can be any naturally occurring amino acid
CPNNHQVRLXDTASQRRPVISVDFRXESPIKPVAEDPNGHAVYIGTGRGDLASFDMRTGKLLGCFAGKCSGSIRSIVRHPELPLIASCGLDSYLRIWDTNTRQLLSAVFLKQHLTAVVIDSHFSTEELEETKSKQPDPVGAEVRKERKEKKNRTSEMDEDETRMLDHDDSDSEMHTSKRKKSGEKSKGMKKKSKKQQVA

SEQ ID NO: 38795 - protein, 361 aa, Arabidopsis thaliana
MIPFPLLPTPIETNYRACTIPYRFPSDNLKKATPTEISWINVFANSIPSFKKRAESDTSVPDAPARAKIFEQRYAGFLEGWKKDPESNGGPPDGVILGRVREHLLRELGFRDIFKKVKDEENAKAISLFPEVVSLSDAIEDDGERLENLVRGIFAGNIFDLGSAQLAEVFSRDGISFLATSQNLVPRPWVIDDLNKFQAKWVKKPWKKAVIFVDNSGADIILGILPFARELLRRGIQVVLAANELPAINDVTYTELTDIVSQLKDGNGQLIGVDTSKLLIANSGNDLAVIDLSRVSHELAYLSSDADLVILEGMGRGIETNLYAQFKCDSLKIGMVKHVEVAQFLGGRLYDCVFKFNEVQS

SEQ ID NO: 38796 - protein, 476 aa, Bartonella quintana str. Toulouse
MFNKRKFYINGLWDDPSTPHDLHVIDPSTEEVCAVISVASTKDADKAINAAKAAFQNWRTTLPNERLSFVEKILEIYEKRSEDMAKTISMEMGAPIDMALNAQTATGSSHIRNFIKVYKEFTFQDVLVEGNEQSILHYDPIGVVGLITPWNWPMNQVTLKVIPALLAGCTMVLKPSEIAPLSAMLFAEILDEAALPAGVFNLINGDGDNIGSYLTAHPDLEMISFTGSTRAGKDISKNASSTLKRVCLELGGKGANIIFADADTNALQRGVHHCFYNSGQSCNAPTRMLVEQAIYDKAIRIAKDIAEKTKVGPGHQTGNHIGPVVSKQQYDKIQDLIQSGIDEGATLVAGGTGLPIGMERGYYVRPTVFADVKPNMRIFREEIFGPVLSILPFNTENEAVALANDTEYGLTNYIQSQDRNKCRRIAAQVRSGMVEVNGHELPRESYFGGVKFSGRAREGGQWGIKEFLDTKAISYW

SEQ ID NO: 38797 - protein, 180 aa, Spinacia oleracea
MASSVLSSARVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 38798 - protein, 435 aa, Ralstonia metallidurans CH34
MSSAAPTQNVSNGHTLPSYLNADNLGPWGIYLQQVDRVTPYLGSLARWVETLKRPKRAMIVDVPIELDNGTIAHFEGYRVQHNLSRGPGKGGVRFHQDVTLSEVMALSAWMSVKNAAVNVPYGGAKGGIRVDPRTLSHGELERLTRRYTSEINIIIGPSKDIPAPDVNTNAQVMAWMMDTYSMNSGSTATGVVTGKPISLGGSLGRHEATGRGVFVVGSEAARNLGMDVKGARVAVQGFGNVGAVAAKLFHEAGATVVAVQDHRTTLFDPAGLDVPKMMEYASHSGTIEGYRAEVISTEQFWEVDCDILIPAALEGQLTASNAPKIKAKLVIEGANGPTTPEADDILRERNILVCPDVIANAGGVTVSYFEWVQDFSSFFWTEEEINERLVRIMQEAFRAIWQVAQDNKVTLRTAAFIVACTRILQAREMRGLYP

SEQ ID NO: 38799 - protein, 521 aa, Frankia sp. EAN1pec
MAGGPLSQMAQPTVLFERNTSLSDVTIRHWVDGQPFNGTGTRWAEVTNPATGHVTGRVALASSKDADHVIAVAARAAGSWSRTSLAQRTRILFAFRELLDSRRDELAAIITAEHGKLPSDALGEIARGQEVVEFACGVSHLLKGGHSESVSTGVDVHSKRDPLGVVGIISPFNFPAMVPMWFFPLAIATGNTVVLKPSEKDPTAALWIADLWKQAGLPDGIFNVLQGDKEAVDALIESPVVQSISFVGSTPVAQYVYEASSRHGKRVQALGGAKNHMIVLPDADLDLAADAAVNAGYGSAGQRCMAVSVLVAVGEIADDLVARIADRTRTLVVGDGAEADMGPLITRAHRDRVASFVDAGEQDGAAIEVDGRDVQKGGIQDGFWLGPTLLDHVTPAMKVYQEEIFGPVLCVVRVNTYDEAVVLVNGNPYGNGAALFTNDGGAARRFEADVQVGMIGVNIPVPVPVAYYSFGGWKQSLMGDTHAHGTEGVQFFTRGKVVTTRWIDPANRPQGGLELGFPRNV

SEQ ID NO: 38800 - protein, 473 aa, Bartonella quintana str. Toulouse
MKNGKQMKSKGSKPVSQFLKNLRGVDNWEQVSQWLALRNVEDIECITPDQAGVARGKMMLSKKFISETSLALPSAVFMATISGDYPEDGHGFEYPKTDGDLRLEPDLSTLSIVPWEEAPTAQVICDLVYQNGQGVDYTPRNVLRKVINFYTKMGLKPVVSPEIEFYLVEKNPDPDYPLVPPIGRSGRSIGGGQGYSIAGVNEFDDLIDDIYHFSEAQGLEIDTLIHEEGAGQFEINLRHGDPIELADQVFIFKRTIREVALKHNMYATFMAKPIQGQPGSAMHIHQSVVDKKTGMNIFTQEDGKENIRFRHFIGGLQRHIPGVLVMLAPYVNSYRRLVPDLSAPVNLRWGYDNRTTAFRVPRSSPQGRRVENRLPSSDANPYLALAASLACGLIGLQQELEPDEPTTKNVNTDNIELPRGLIEAVNLFEQDTAIRAILGDVFVSTYAAIKRQEFETFMEVISPWEREYLLLNV

SEQ ID NO: 38801 - protein, 95 aa, Microcystis aeruginosa PCC 7806
MSTEVIEKRSTATIRKPAPRYRVLLHNDDFNSMEYVVQSLMQTIAGMTQPQAVDIMMEAHTNGTALVITCIQEHAEFYCETLKNKGLTSSIEPDE

SEQ ID NO: 38802 - protein, 382 aa, Haloarcula marismortui ATCC 43049
MRLHEYQAKQVFADAGIPTPASQLAETVDEAVDAAEEIGYPVAIKAQVHVGGRGKAGGIKLVESKEEAREAAEDIIGMDLKGYHVSKVLVEEAVDFVNELYVGVTMDRGEGRPVAMVSTKGGVNIEEVAEEDPDAIAREHIDPAFGMHPFQARKVVYEAGVDREVANDVASVLTTLYQLWDDRDGADTEINPLMITSDDEVIAADAVMNVDGDALFRQPEIAEMGEEAAEGDELEQKADEYGFDYVRLDGNVGIIGNGAGLVMTTLDLVDYYDGEPANFLDVGGGAKADRIANALDMVFSDENVDSVVFNIFGGITRGDEVANGINQALEQFDEIPKPVTVRLAGTNAEEGMEILNEDLVTVEHTLEDAVQRAVEYAKEVEA

SEQ ID NO: 38803 - protein, 570 aa, Bacillus subtilis subsp. subtilis str. 168
MQELKGIGASAGIAIAKAYRLEEPDLTVEKKNISDSEAEVSRFDEAIARSKEELEKIKEHALKELGQDKADIFSAHLLVLSDPELLNPVKEKISTDSVNAEFALKETSSMFVTMFESMDNEYMKERAADIRDVTKRVTGHLLGVEIPNPSMISEEVIIVAEDLTPSDTAQLNREFVKGFTTDIGGRTSHSAIMARSLEIPAVVGTKAATGTIQNGVTVIVDGINGDVIIDPSAETVKEYEEKHNAYLAQKAEWAKLVNEPTVSKDGHHVELAANIGTPDDVKGVLENGGEAVGLYRTEFLYMGRDQLPTEDEQFDAYKTVLERMEGKSVVVRTLDIGGDKELPYLQLPKEMNPFLGYRAIRLCLEEQEIFRTQLRALLRASTYGNLKIMFPMIATVNEFKEAKAILLEEKEKLVKAGQAVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKQEAESFKEKILSMSTTEEVVAFVKETFK

SEQ ID NO: 38804 - protein, 332 aa, Ralstonia metallidurans CH34
MDATARRFGIDFQWDHFDFSSYAYYERHGKMLPDDWFDTLVKYDAIYFGAVGWPAKIADHVSLWGSLLQFRRSFDQYVNLRPVRLMPGIKSPLADRKPGDIDFYVVRENTEGEYSSIGGRMFPGTEREIVMQETVMSRHGVDRILKFAFELAQKRPKKHLTSATKSNGISITMPYWDERVEAMAANYPGMKVDKYHIDILTAHFVQHPDWFDVVVASNLFGDILSDLGPACTGTIGVAPSGNINPDKVYPSLFEPVHGSAPDIAGQGIANPIGQIWCGAMMLEHLGHAEAGAAVLAAIEQVLAAGPGHAPLTRDIGGTASTADLGQAIAEAL

SEQ ID NO: 38805 - protein, 433 aa, Borrelia burgdorferi
MGFHIYEIKARQIIDSRGNPTVEADVILEDGTYGRAAVPSGASTGINEAVELRDGDKSVYMGKGVLKAIENIKNIIAPELEGMSALNQVAIDRKMLELDGTPTKEKLGANAILAVSMATAKAAAKYLGLRPYQYLGAYKANILPTPMCNIINGGAHSDNSVDFQEFMIMPIGAKTFSEAIRMAAEVFHTLKGILSGKGYATSVGDEGGFAPNLKSNEEACEVIIEAIKKAGYEPGKDIAIALDPATSELYDPKTKKYVLKWSTKEKLTSEQMVEYWAKWVEKYPIISIEDGMAEEDWDGWKKLTDKIGNKIQLVGDDLFVTNTSFLKKGIEMGVANSILIKVNQIGTLTETFEAVEMAKKAGYTAIVSHRSGETEDTTIADLVVALGTGQTKTGSLSRTDRIAKYNQLIRIEEELETTAEYHGKSVFYSIKQK

SEQ ID NO: 38806 - protein, 152 aa, Triticum aestivum
  misc_feature (69)..(69): Xaa can be any naturally occurring amino acid
  misc_feature (101)..(101): Xaa can be any naturally occurring amino acid
MAPTVMASSATSVAPFQGLKSTAGLPVSRRSNGASLGSVSNGGRIRCMQVWPIRGHQEFETLSYLPPLXSTEASLSRSDYLDPSKWVPCLRFSKLGSSSRXAQPSPGYYDGRYWAMWNCLFPDHRRHVEGWKEVKKDTLTLFRIISQIVSHA

SEQ ID NO: 38807 - protein, 408 aa, Oryza sativa Japonica Group
MHSTNLLLEEPIRMASILEPSKPSFFPAMTKIVGTLGPKSRSVDTISSCLKAGMSVARFDFSWGDAEYHQETLENLKVAIKSTKKLCAVMLDTVGPELQVVNKSEASISLEENGTVILTPDQGQEASSQVLPINFAGLAKAVKPGDTIFVGQYLFTGSETTSVWLEVSQIKGDDVVCVIKNTATLAGSLFTLHCSQIHIDLPTLSDEDKEVIRKWGAPNKIDFLSLSYTRHVEDVRQAREFLSKLGDLSQTQIFAKIENVEGLNNFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKHVGEPMTHLESIASSAVCELLLK

SEQ ID NO: 38808 - protein, 145 aa, Prochlorococcus marinus str. NATL2A
MLNISHYKIIAIGKIKKKWIQEGIEMYLKRLPGLEVKEIKDSTQLKEEHTIKEIISKNEFLVTLNENGQSFTSKQLATKLLNSHNQNITFVIGGASGLSSSLNNLASWQLSLSPLTFPHEIARLLLIEQLYRAKAITQGGPYHKE

SEQ ID NO: 38809 - protein, 685 aa, Lotus japonicus
MPLLSSQNYITVTQNQSIQDDETLVSAEGTFEAGFFGLGNSQRQYFGIWYKSISPRTIVWVANRDAPVQNSTATIKLTDKGNLLILDGSKGIIWSSNGSRAAEKPYMQLLDSGNLVVKDGGKRKKNLIWESFDYPGDTLLAGMKIKSNLVKGPTSYLTSWRNTEDPASGEFSYLIDTRGFPQLVITRNATAYYRAGPWTGKLFSGSSWLRLRKILTFSMQFTSQEISLEYETANRSIITRAVINPSGTTQRLLWSDRSQSWEIISTHPTDQCTYYGLCGANSMCDISNNPICHCLEGFRPKFQAKWNSFDWPGGCVPMKNLSCQNGDGFLKHTGVKLPDTSSSWYGKNKSLDECGTLCLQNCSCTSYAYLDNDIGGSACLIWFGDILDLSIHPNPDQGQEIYIKVVASELDHRRNKKSFMTKKLAGSLAGIVALVICIIILGLATSTCIQRKKNERGDGDSTRSKLLDWNKRLQIIDGIARGLLYLHQDSRLRIIHRDLKTSNILLDNEMNPKISDFGLARIFIGDQVEARTKRVMGTGYMPPEYAVHGSFSIKSDVFSFGVIVLEIISGKKIRKFYDPHHHLNLLSHAWRLWIEGSPLELVDKLFEDSIIPTEILRYIHVALLCVQRRPETRPDMLSIVLMLNGEKELPKPSLPAFYTGKHDPILLESPSRRCSTSVTISLEAR

SEQ ID NO: 38810 - protein, 151 aa, Ashbya gossypii ATCC 10895
MSDERTFIAIKPDGVQRGLISKILSRFESRGYKLVGIKLVTPTENLLKQHYAEHVEKPFFPKMLAYMTSGPILATVWEGKDVVKQGRVILGATNPLNSAPGTIRGDFALDMGRNVCHGSDSVESAQREIDLWFKKEELVDWKLNQLSWIYE

SEQ ID NO: 38811 - protein, 484 aa, Synechococcus sp. WH 8102
MAGGFTEQSQRFRPSSKEEHVVQKAEEHFERTLITIRGELAGSVAALEHPSDDEALNYGEIFLRDNVPVMIYLLLKRRFSIVRQFLTVCLDLQSTSVQTRGVFPTSFVEENEELVADYGQRSIGRITSVDASLWWPILCWIYVKRSGDTEFGRSAEVQRGLQLLLDLVLHPSFEGTPVLFVPDCAFMIDRPMDVWGAPLEVEVLLFAALRSSIELMELCQRHESSVLLEERLRLSRRWMHDLRQYLLKHYWVTSKTMQVLRRRPTEQYGDNQYQNEFNVQPQVIPDWLQDWLDNRGGYLIGNMRTGRPDFRFYSLGNSLACLFGLLTAPQQRALFRLVQHNRQHLMAQMPMRICHPPMEGVEWENKTGSDPKNWPWSYHNGGHWPSLLWYFGGSILLHERIHPHADMLLMTQMKTLVEECYWSQLNQLPRQQWAEYFDGPTGTWVGQQSRTYQTWTIVGFLLLHHFLRVEPNDVLMLHLDAGLS

SEQ ID NO: 38812 - protein, 479 aa, Dehalococcoides sp. VS
MHRRQRVHGQERRSDLGRAPRRAAGHHPRHHDRAVGRGLARGDLARVAGRRRSLRLRHRGRGLRDQRAGPPRVRRQPGHPRTGRAVRPGRARPGRPLRALADGGLSMDGDVVRTETTVGAADLLAAQARLRRYLAVTPLHHAERFGCWLKLENLQRTGSYKVRGALNALLAARERGDHRPVIAASAGNHAQGLAWAAYRLGVNAITVMPRCAPQTKIAGVAHWGATVRLHGETYDEAKAFAIELAQQHDYSLLSAFDDPDVIAGQGTVGLELAAFAPDVVLVPIGGGGLAAGVALALKSQGVRIIGAQVEGVDSMARALRGDRRLIEPAATLADGVRVKDPGRLTERLLSQLLDDVVIVREAELRETLVRLALEEHIIAEGAGALALAAGRRIAAKRKCAVVSGGNLDALVLAQLLSDVRPRAPRRPRRRNRDTSLSRAGATIEADIYKLANLPPPRAAASSPSSSPSPHRTVTEDVPA

SEQ ID NO: 38813 - protein, 277 aa, Shewanella sp. ANA-3
MTEAYQNRFSGIGRLYGQKALAKFAASHVVVIGIGGVGTWAAEALARSGIGQITLIDLDDICVTNTNRQIHALSSTIGESKVAVMAQRIRSINPDCQVNEVEDFITVDNLGEYLLGAKAGGNIDYVVDCIDAVKQKAALIAWCKRQKIKIVTVGGAGGQTDPTQIQLTDLAKTYQDPLLAKVRNILRREYNFSKNVQRRFAVDAVFSSEQLVYPQADGSVCSSKATADGSMRMDCASGFGAVTMVTGTFGFVAASRVLARLAQIANEPVANEPAASE

SEQ ID NO: 38814 - protein, 168 aa, Symbiobacterium thermophilum IAM 14863
MEIDPSKRYRATLRTTKGEIVIDLFADEAPLAVNNFVFLARQGYYDGVKFHRVIKPFMIQTGDPTGTGRGGPGYRFPDELPPKHPYEPGIVAMANAGPNTNGSQFFICSGPQAAGLNHFPHYTQFGRVVEGMDVVEALASVPVGPAFNGEMSRPLEEIRIESVRISEL

SEQ ID NO: 38815 - protein, 496 aa, Coriolopsis gallica
AIGPVADLTISNGAVSPYGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGSIVVYDPQDPHKSLYDVDDDSTVITLADWYHLAARVGPAIPTADATLINGLGRSINTLNTDLAVITVTKGKRYRFRLVSLSCDPNHTFSIDGHSLTVIEAERVNLKPHTVDSIQIFAAQRYSFVLNADQDVDNYWIRALPNSGNTNFDGGVNSAILRYDGAAPVEPTTSQAPSTNPLVESALTTLEGTAAPGSPTPGGVDLALNMAFGFAGGRFSINGASFTPPTVPVLLQILSGAQSAQDLLPTGSVYSLPANADIEISLPATTAAPGFPHPFHLHGHAFAVVRSAGSSTYNYENPVYRDAVSTGTPGDNVTIRFRTDNPGPWFLHCHIDFHLEAGFAVVMAEDIPDVAATNPVPQAWSDLCPTYDALLPDDQ

SEQ ID NO: 38816 - protein, 336 aa, Pseudomonas mendocina
MAFNMHNRNLLSLMHHSPRDVRYLLDLSRDLKRAKYTGTEQQHLKRKNIALIFEKTSTRTRCAFEVAAYDQGANVTYIDPNSSQIGHKESMKDTARVLGRMYDAIEYRGFKQEIVEELATYAGVPVFNGLTAEYHPTQMLADVLTMREHTDKPLHDITYAYLGDARNNMGNSLLLIGAKLGMDVRIAAPKALWPHDDHVAACKKFAEESGARITLTEDPKEAVKGVDFVHTDVWVSMGEPVEAWGERIKELLPYQVNVEIMKAAGNPRVKFMHCLPAFHNSETKVGKQIAEQYPNLKNGIEVTEDVFESPWNIAFEQAENRMHTIKAILVSTLADI

SEQ ID NO: 38817 - protein, 266 aa, Bacillus clausii KSM-K16
MPSILFIGAGRMAEAIFSGLLRQPKQPFDSIYVTNRTNKERLGELAQRYAITPVDTHGAIAAKADVLLLAMPPSAHGEVLSELAPMIRGQLIITVAAGIGPSDMEAQLPEGTAAAWIMPNTAAQVGTSISLYAFGKNVAEKQKLLVKEIVHAIGAGEELSEEQIHDLTAITGSAPAFVYEFALQLEKMALSYGITDKQARHLVKTMLAGSVKMLETGAPPQELRDQVTTPGGATEAGLVSLGNDHFSAMLERAVHAVTDHAKNKRN

SEQ ID NO: 38818 - protein, 346 aa, Glycine max
MQKMMKPPSSSSFPSLLRVKPRLSSYLFTLLAFILFAAILYGHDFVFIFQNTEENKTAGTKSKREEEEECDVFNGRWVRDELTRPLYKESECPYIQPQLTCEEHGRPDKEYQRWRWQPHGCDLPTFSARLMLEKLRGKRMMFIGDSLNRSQYAYWAPFLLESNSDNAVIHRVTDRIVRKGSINTHGRHWKGADIVVFNTYLWWITGSKMKILLGSFNDKVKEIIDMPTEDAYRMAMKSMLRWVRLNMDSNKTRVFFISMSPSHAKSIEWGGEAGGNCYNETTTIDDPTYWGSDSKKSIMQVIGEVFRKSKIPITFLNITQLSNYRKDAHTSIYKKQWNRLTPEQLA

SEQ ID NO: 38819 - protein, 142 aa, Propionibacterium acnes KPA171202
MLGLMSDEERTLVLLKPDAVKRRLMGEIIGRYEAKGLTVRAMELSTIDTKIARKHYAEHVGRDYYAALEEFITSGPLVAMVLEGRRAISVVRAMNGTTDCAEALPGTIRGDFGTEKNHNLVHASDCLESAEREIGLWFPHLV

SEQ ID NO: 38820 - protein, 283 aa, Treponema paraluiscuniculi
MRNPQLAQCRYSFAPQKGHRRVSALVEKAIHERNTTTNTPLDVTAQKLLVAQRSVDTLVQEGVLHAHMSIGLGTGSTAMPAVKRIADHLARGTLSDIAAVPTSFQTALICERYNIPLFSLSSKRVGGKLDVTIDGADEIDTQNFVIKGGGAALLQEKIAAYNSAHFVIIVDETKVVETLGTRAALPIEVVPEARMSVMRTLQDWGLSVHIREAVRKKGPVVTDHGNFILDARWQSLPTRTPQDMERALNALPGVIENGLFTERTVRVFVAHADGSVEERSASF

SEQ ID NO: 38821 - protein, 427 aa, Zea mays
MALISFIFSVVKGKKKLRARFRKRLNLGGAECGSPIRKRVWFIKGGRWKRLCSAATRVWILLLCSLDPSTSERVTMSAFVGKYTDELIKTAKCLATPGKGILASDESTGTIGKRLSSINLENVESNRQALRELLFTAPGVFDYLSGVILFEETLYQKTSDGKPFVDVLIAGGVVPGIKVDKGTVEIAGTDGETTTQGLDSLGARCAKYYEAGARFAKWRAVLKVGPAGQGQPSELAVRQNVEGLARYALICQENGLVPIVEPEILTDGGHDIGTCAAATERVLAALYKSLSDHKVLLEATLLKTNMVSAEVIAEYTVAALRRTVPPAVPGVVFLSGGQSEEEATQNLDAMNKLEVLKPWTLSFSFGRALQQSTLKKWVGKKENVAAAQATFVIRCKANSEAALGKYAGSGAGDAAASESLYVKGYKY

SEQ ID NO: 38822 - protein, 305 aa, Thermoplasma volcanium
MAKRDILSVLDMKNDLDEIINLSIELKKNRYRSYESLRNKMLGLIFEKPSTRTRTSLEVAIDQLGGHAVYLNPSEMQLGRGETISDTGHVLSRFLDAIAYRAFDHKNVVELARSTSIPVINALDDVEHPLQIVADFMTVKEKKGKFSGLKFSYIGDGNNMANSLMLGAAILGVDIYVATPHGYEPKSEFVDKAKQVAKERGSKVIITNDAIEAAKDADVIYTDVWISMGEESKRGEKEKAFTKYQINSDLVSNAKKDYIFMHCLPAHRGLEVTDDVADSINSVIFDEAENRLHSEKGVLYKLLSY

SEQ ID NO: 38823 - protein, 289 aa, Escherichia coli
  misc_feature (17)..(17): Xaa can be any naturally occurring amino acid
  misc_feature (42)..(42): Xaa can be any naturally occurring amino acid
  misc_feature (64)..(64): Xaa can be any naturally occurring amino acid
  misc_feature (74)..(74): Xaa can be any naturally occurring amino acid
  misc_feature (93)..(93): Xaa can be any naturally occurring amino acid
  misc_feature (171)..(171): Xaa can be any naturally occurring amino acid
  misc_feature (217)..(217): Xaa can be any naturally occurring amino acid
  misc_feature (270)..(270): Xaa can be any naturally occurring amino acid
  misc_feature (272)..(272): Xaa can be any naturally occurring amino acid
HHHHHHSSGLVPRGSHXSCEELEIVWNNIKAEARTLADCEPXLASFYHATLLKHENLGSALSYXLANKLSSPIXPAIAIREVVEEAYAADPEXIASAACDIQAVRTRDPAVDKYSTPLLYLKGFHALQAYRIGHWLWNQGRRALAIFLQNQVSVTFQVDIHPAAKIGRGIXLDHATGIVVGETAVIENDVSILQSVTLGGTGKSGGDRHPKIREGVXIGAGAKILGNIEVGRGAKIGAGSVVLQPVPPHTTAAGVPARIVGKPDSDKPSXDXDQHFNGINHTFEYGDGI

SEQ ID NO: 38824 - protein, 388 aa, Mycobacterium avium 104
MTDRVSLRAGIPPFYVMDVWLAAAERQRSHGDLVNLSAGQPSVGAPEPVRAAAAAAVHSNELGYSVSLGTPELRAAIAADYRRQHGLEVEPDAVVITTGSSGGFLLTFLACFDVGDRVAVASPGYPCYRNILSALGCEVVEIPCGPQTRFQPTAAMLAELDPPVQGVIVASPANPTGTVIAPEELAAIASWCEASGARLVSDEVYHGLVYEGAPPTSCAWQTSRNAVVVNSFSKYYAMTGWRLGWLLVPVELRRAVECLTGNFTICPPVLSQLAAVAAFTPEATAEADGHLHHYAKNRALLLDGLRGIGITRLAPTDGAFYVYADVSDFTDNSMEFCSKLLEQTGVAIAPGIDFDTTRGNSFVRLSFAGPTTDIEEAVRRLGSWLRAR

SEQ ID NO: 38825 - protein, 341 aa, Oryza glaberrima
MDHRELWPYGLRVLVIDDDCSYLSVMEDLLLKCSYKVTTYKNVREAVPFILDNPQIVDLVISDAFFPTEDGLLILQEVTSKFGIPTVIMASSGDTNTVMKYVANGASDFLLKPVRIEELSNIWQHIFRKQMQDHKNNNMVGNLEKPGHPPSILAMARATPATTKSTATEALLAPLENEVRDDMVNYNGEITDIRDLRKSRLTWTTQLHRQFIAAVNHLGEDKAVPKKILGIMKVKHLTREQVASHLQKYRMQLKKSIPTTSKHGATLSSTALDKTQDHPSRSQYFNQDGCMEIMDYSLPRDDLSSGSECMLEEQNDYSSEGFQDFRWDSDKQEYGPCFWNF

SEQ ID NO: 38826 - protein, 77 aa, Oryza sativa
VFEFEKFASGTKATLDAVVDAVQKDGKIVIIGGGDTATVAKKYGVEDKLSHVSTGGGASLELLEGKELPGVTALSSK

SEQ ID NO: 38827 - protein, 491 aa, Bartonella quintana str. Toulouse
MVRKIIPVSPFDCIVFGGNSDLASRKLIPALYHCQCVGQFSEPTRIIGVSRSSLSCEEYQNFVRSSLEKYVHPKDLNRIELNRFLARLTYVSVDITSNWGWEDLAFLLSRESADIRAFYLAVSSSLFGDIAMRLGQNGFVTQQTRIIIEKPIGHNVKTAVELNDTFASVFDEDQIFRIDHYLGKETVQNLMALRFVNTLYEPLWNSKYIDHVQITVAESLGLEGRAEYYESAGALRDMVQNHMLQLLCLVAMEIPFTNSANAVRDEKLKVLHSLMPLNVHNVEEHTVRGQYLSGLSDGVAVKSYLDDLGKKVSQSETFVALKIKIDNWRWADTPFYLRTGKRMFTRMSEIVIVFKPIPHNIFDTDSNEIFSNRLVVRLQPDEGVKQWLMIKDPGPGGMRFRHIPLDMSFASAFSERNPDAYERLLMDVIRGNQTLFMRRDEVEAAWLWIDPILEGWEAIKQPVYGYSAGSWGPSASTILMERDGRIWNNLV

SEQ ID NO: 38828 - protein, 236 aa, Nostoc sp. PCC 7120
MTVTADPVTLMKQEVGKAAAALVKSGSIVGLGTGSTTAYTIQYLGDRLKSGELTDIVGIPTSFQSEVLSKQYGVPLTTLDAVDHIDIAIDGADEVDPHKNLIKGGGAAHTREKVVDYLANQFIVVVDSGKLVDRLGSVFAVPVEVIPMAITPVTNAIKQLGGKPELRMGVKKAGPVITDQGNFVLDVRFDSIDDPVNLEKILNNIPGVLENGIFVNCADIVLVGEVKDGQPLVRRL

SEQ ID NO: 38829 - protein, 423 aa, Arabidopsis thaliana
MRCLWKAGKKAAVYLMKSDCEDVVGKVSGSGSGGGGLPLAPKNIKDLQSNPGYENVDIFTYEEMKIATKQFRPDYILGEGGFGVVYKGVIDESVRVGFKSTKVAIKELNPEGFQGDREWLAEVNYLGQLSHPNLVKLIGYCCEDDHRLLVYEYMAMGSLEKHLFRRVGCTLTWTKRMKIALDAAKGLAFLHGAERSIIYRDLKTANILLDEGYNAKLSDFGLAKDGPRGDQTHVSTRVMGTYGYAAPEYVMTGHLTSRSDVYGFGVLLLEMLLGKRAMDKSRACREHNLVEWARPLLNHNKKLLRIIDPRMDGQYGTKALMKVAGLAYQCLSQNPKGRPLMNHVVEVLETLKDDGDAQEEVMTNLHSRGKSVTLYEASSDSQGTRDGNGQRRRRPESGRSKSEAAVDTEKYVSTLSEPDTTKI

SEQ ID NO: 38830 - protein, 193 aa, Triticum aestivum
TASAIRPTQVRWYNKFVQKSRLVPAPEFPGYRRPTRPSSFIDETNEVILKGFHNIGVAMATEQGLVVPTIKKVQSLSILEITKELSRLHEMALQNRLSTNDITGGTITLSNIGAIGGKFGSPVLNLPEVAIIALGRIQKLPRFDDDENVYPSSTINVTVGADHRVVDGATVARFCNEWKSLVEKPELLLLHMR

SEQ ID NO: 38831 - protein, 139 aa, Glycine max
MASACLKLRNLSRGGGAFRCGRYSKLIHAEREREEEEEEVPSSRISRPLSEILKELNKKVPDSLVKTRLQKDQDASPIRFIPWHVVNRILNLHAPEWSGEVRNITYSADAKSVSVVYRVTLYGTDAEVRANYKAGHDVE

SEQ ID NO: 38832 - protein, 500 aa, Oryza sativa Japonica Group
MENSQVWLLWGALSVAVLFYLSTLRRRHAGGKPLPPGPTPLPLIGNLHLAGGTSFHHKLRDLARVHGPVMTLKLGLATNVVISSREAAIEAYTKYDRHLAARATPDTFRACGFADRSMVFIPSSDPRWKALRGIQGSHVFTPRGLAAVRPIRERKVGDLMAYLRAHAGEEVLLGQAMHTGLLNLVSFSYFSIDIVDMGSQMARDLREVVDDIISVVGKPNISDFYPFLRPLDLQGLRRWTTKRFNRVFSIMGDIIDRRLAHIRDNKPSHNDFLDSLLELMAAGKIDRVNVLDMLFEAFVAGADTMALTLEWVMAELLKNPGVMAKARAELRDVLGDKEVVEEADAARLPYLQAVLKEAMRLHPVGALLLPHFAVEDGVEVGGYAVPKGSTVLFNAWAIMRDPAAWERPDEFVPERFVERAPLLDFRGKDAEFMPFGSGRRLCPGLPLAERVMPFILASMLHTFEWKLPGGMTAEDVDVSEKFKSANVLAVPLKAVPVLIK

SEQ ID NO: 38833 - protein, 283 aa, Brassica napus
MAKDVEGAEGVTARDYEDPPPTPFFDAEELTKWSLYRAVIAEFVATLLFLYVTVLTVIGYKISSDTKAGGDDCGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 38834 - protein, 453 aa, Physcomitrella patens subsp. patens
MGNSGSSSSSSSFNNDPRRVSRSRGYEGSSSQAYGGYSHPSSSRYGDAYEEPPSEPPYVPRPVPKKPLKREFSFIRDNYSSVEEVQNALGQAGMESSNLIVGIDFTKSNEWTGKNSYGGRSLHAIGGEPNPYEKALSIIGRTLPKFDDDNLIPCFGFGDSTTHDKYVFSFNADHRPCEGFEEVFSRYRTIVPHLRLAGPTSFAPIINAAIDIVEESGGQYHLLIIIADGQVTRSVDVAYGQQSPQEAATIRAIVNASSYPLSIVLVGVGDGPWDMMREFDDNLPERSFDNFQFVNFTEIMNSRNLNAHQKEAKFALNALMEIPLQYRATLELSMLGNQVGTSPGIKPLPPPPKVLQNDGIYPGPPPSSTRDYHPHSPHHSFDSYPSFNNHNYSTQPSAPASSVDGSNMDCPVCLTDRKDMAFNCGHQTCRQCGVGLLNCPMCRQLITTRIHLY

SEQ ID NO: 38835 - protein, 472 aa, Symbiobacterium thermophilum IAM 14863
MRNDDRSKLIRGLICVAVGLIIWFLPAPGDLEPVAMHLLGIFVATILGLILQPLPQGAVVITAVAVTAITGTLSIGDALNGFKDSTVWLIVTAFLFARGLIKTGLGRRISFMLVKRFGKSTLGLGYALALSDTVLAPATPSNTARAGGILFPIVRALCSSMGSEPGPTAKRVGQYLMYNSFQICCITSALFFTGVAPNSLIATLAKENFGYEITWLGWLWAALLPGVICIAILPRIYYKIFNPELKYSPEAPALAEKELAKMGPMSTAEKGMLAVFLLTLVLWATSQWTNLNATAIALLGVAILLVIGVLDWQDVLAEKGGWDALIWFGGLVGLATGLSKVGIIGWLASILETSLGGISSWFLAFILVVIAYTYSHYFIASMTAHATAFFVPLALVAISAGAPLEITVLVLGFFNSLNAVMTHYGTGPAPIYFGAGYIDQGTWWKWGFVTSLINLVVWLGAGSLWWKVIGLW

SEQ ID NO: 38836 - protein, 552 aa, Bacillus clausii KSM-K16
MAFSAKTREKAIASMEGKQLDLLIIGGGITGVGAALDAATRGIDVGLIEMQDFAAGTSSRSTKLIHGGLRYLKQFEVKLVAEVGTERAIVYENAPHVTEPVRMMLPFYKGGTFNALTTSIGLAVYDRLAGVKKAERRTMMKAKDALKKEPILAKDGLRGAGMYVEYRTDDARLTIEIAKTAAEKGAKLANYVKAEGFIYDKGKITGVIARDLLTGEAVTIQAKKVVNATGPWVDHLREQDRSKTGKTIHLTKGVHLVLSKKRLPLNQALYFDTPFGDGRMMFAIPRGEKVYVGTTDTNYKGDKREPGVTKEDVDYIMKATNALFPGYQLTTADIESSWSGLRPLIHEEGKSPSDISRKDEIFHSDSGLMTIAGGKLTGYRKMADNIVSIVAKELEQETGAVYKPCQTKKLVLSGGEVGGSDQLDMFNAAHIEAGKTLGLEEAEAAELVTRYGSNVTHVFAFLNDGEAEKYGLPKAVWASLRYAMAYEMALTPVDFLLRRSSYMLFDIDKANAYKDKIVEAMASVLKWSDKQRAIYEAELAEQWRIHTLEDIG

SEQ ID NO: 38837 - protein, 340 aa, Cryptococcus neoformans var. neoformans B-3501A
MLPIQKDVSMGAEPLPIPISHLSTPIRHFTYITDSELGHGAPLSITHPLLPDCDHLKQPPSSPISSTGSGSSSDAEDVWTCTCTSYYESEKQTYLCSAECGDLCDCVAQFGNFYSSTNPQTLKLDALPDNWPLVECSPSCLCGLSCSNRVTQQGVRTPLTIRPTPPKGYGLFYTPSTPQFLPRGAFISLYAGEYILPSEIRSRWSPRSTTDLASDKEGYGEEGQGNYVLSLRLPDQTIHIDPRWKGNVGRFLNHSCGANCVVHYVKWGRGRGWPRAAIFTNRDIHPEEELTFDYANASGEPQRAIQLIQESKTKEDTKGRTRCLCGAEQCRGWIPFDETL

SEQ ID NO: 38838 - protein, 207 aa, Orobanche minor
KGGAKKVVISAPSKDAPMFVVGVNEKEYKKDIDIVSNASCTTNCLAPLAKVLNDRFGIVEGLMTTVHSITATQKTVDGPSMKDWRGGRAASFNIIPSSTGAAKAVGKVLPALNGKLTGMAFRVPTVDVSVVDLTARLEKAASYDEIKAAIKEESETNLKGILGYTEDDVVSTDFVGDCRSSIFDAKAGIALNGNFVKVVSWYDNEWG

SEQ ID NO: 38839 - protein, 487 aa, Oryza sativa
CEEKMEFLSSVSYLFKALCTCGVAFVTGWFAHWVYRWMNPQCDGKLPPGSMGLPLVGETFRFFRASASIDMPSYYKERLKRYGPIFKTSLVGQPLVISLDPEVNRFVFQQEGKLFRSWYPETTNTIFGKKSLTTYSGAVNKFVRSFASKLFGPTNLKESLLPELESAVRESFATWVMNPSIEVKDGISNMIFDLVAKKLIGFNPTKSRELRKNFQEFFQGMVSFPIYFPGTSFYRCMQGRRNVHKTLTDLLKERLSAPGEKYNDLIDQIIEELQSENPVIDVNFAVDVLSALLFASFATLSSTLSVGFKFLTDNPKVVKELKEEHTTILNKRGSLNSGFTWEEYKSLMFTSQVVHEITRISNVAPGIFRKTLADVKVKGYTIPAGWLVMISPMAVDLNPTLFEDPLEFNPWRWTDKTKQSELLRNYMPFGGGIRLCLGAEFSKLFIALFIHVLVTEYRWKEIKGGDVLRISEVIFPQGYHIQLIPHT

SEQ ID NO: 38840 - protein, 319 aa, Coccidioides immitis RS
MSAGGEHLKDEGQRYQVVAAGAIAGMVSRFCVAPLDVVKIRLQLQIHSLSDPLSHKNIRGPVYKGTISTLKAIFREEGITGLWKGNIPAELLYIFYGAIQFTTYRTVTQSLHTLPPPYRLPQPAESFVSGATAGGIGTFTTYPFDLLRTRFAAQGNDKIYPSLLTAIRSIHAHEGSRGFFRGVSAAVAQIVPYMGLFFATYESVRVPISSLHLPFGSGDATAGVIASVIAKTGVFPLDLVRKRLQVQGPTRSRYIHQNIPEYNGVLSTMKMVLRDGGVRGLYRGLTVSLIKAAPASAVTMWTYERVLKILKEINQEAIQ

SEQ ID NO: 38841 - protein, 389 aa, Nostoc sp. PCC 7120
MKAVCWYGANEVRVETVPDPKILNPRDAIIKITSTAICGSDLHIYGGYIPTVQQGDIIGHEFMGEVVEVGSRVDNLKIGDRVVVPSTIGCGRCHYCEHDMWSLCDNSNPNGWLEEKLYGNITSAIYGYSHLLGGYAGAQAEYIRVPFADVGVVKVPPDLPDEMLLFISDAIPTGYMGAEMCDIQPGDTVAVWGCGAVGQFAMISAYMMGAEKVIAIDRFPERLEMAKKYAKAEVINYEEVNAGEALKEMTGGRGPDACIDAVGLEAHGVGLEDFYDQTKQKLKLESDRPHVLREMMVACRKGGTLSIMGVYGGFVDKIPFGAAFNKGLTFRMGQMHGQKYMNLLLQLILDGKLDPSFVVSHQLPLEQAPLGYHIFQQKKDNCIKVVLKP

SEQ ID NO: 38842 - protein, 392 aa, Synechococcus sp. CC9605
MKAMILAAGKGTRVQPITHVIPKPMIPILQKPVMEFLLELLKEHGFTEVMVNVSHLAEEIENYFRDGQRFGVEIAYSFEGRIEDGELIGSALGSAGGLKKIQDFQHFFDDTFVVLCGDALIDLDLSEAVRLHKDKGAIASLVTKRVPKDQVSSYGVVVTDDQNRISSFQEKPSVNEALSDTINTGIYIFEPEVFEHIPSGQSFDIGSDLFPKLAELGAPFYAIPMDFEWVDIGKVPDYWQAIRSVLMGDVRQVGIPGKEVRPGVYTGLNVAANWDKINVSGPVYVGGMTKIEDGATIVGPTMIGPSCHICEGATVDNSIIFDYSRIGPGVQLLEKLVFGRYCVGKDGDHFDLQEASLDWLITDARRQDLVEPSPQQKAMAELLGTDLTQAAS

SEQ ID NO: 38843 - protein, 389 aa, Nostoc sp. PCC 7120
MKAVCWHGTNDVRVETVPDPKILNPRDAIIKITSTAICGSDLHIYNGYIPTMQSGDILGHEFMGEVVELGSAVKNVKVGDRVVVPFTISCGSCFFCQRDLWSLCDNSNPNAWLVELQMGHSPAGLFGYSHLFGGYAGGQAEYARVPFADVGLLKIPDNLPDEQVLFLTDIFPTGYMAAENCNIKPGDIVAVWGCGPVGQFAIKSAYMLGAERVIAFDRIPERLQMAKEQCNAEVLNYEEVNIGEALKEMTGGRGPDACIDAVGMEAHGTDLMAFYDQVKQAVRLETDRPTALRQVIVSAAKGGHVSLAGVYGGFLDKIPMGSAMNKGLTFKMGQTHVHKYLKPLLERIQNGEIDPSFVITHTIPLEQAPHGYEIFKHKKDNCIKVVLKP

SEQ ID NO: 38844 - protein, 418 aa, Bartonella quintana str. Toulouse
MARIVMKFGGTSVANIERIHNVARHIKREVDAGNEVAVVVSAMAGKTNELVQWTRDASPMHKDADEYDVVVASGEQITAGLLALKLQAMGVNARSWLGWQIPIHTDNVHGSARITDINGSFLIQRFQEGQVAVIAGFQGLAPDNRISTLGRGGSDTSAVAIAAAVQADRCDIYTDVDGVYTTDPRIEPKARLLPKVAFEEMLEMASLGAKVLQVRSVELAMVHKVRTFVRSSFEDPDALGMDDPINSSGTLICDEDEILEQQNVTGIAFAKDEAQISLRRLADRPGISAAIFGPLAEERINVDMIVQNISEDGSKTDMTFTVPSVDVEKAVTLLEKNRKEIGFDVLQFERNLAKVSVIGIGMRSHAGVAATAFKALSEKGINIQAITTSEIKISILIDHAYTELAVRTLHALYGLDKG

SEQ ID NO: 38845 - protein, 163 aa, Triticum aestivum
MKEGGQKKNILAKTLQKCRSLGHRRQPAAYGGGGAGSSASAPASPRAADGRAAWAVPAGYVAVLVGPEKERFAVRARCANHPLFRALLDEAETEYGFAGCVGPLELPCAVDDFMEVVWEMEQGGGVASSPSCARFAGRGHHQQQQRHGYHLLSPGTFVVAGRS

SEQ ID NO: 38846 - protein, 224 aa, Ralstonia metallidurans CH34
MSQSTGPQSLAYTHLIVIRHGETAWNRERRLQGQLDIPLNDTGRAQARALAEALAGEPIDAVYSSDLGRAMQTAAPLAETLGLQVRPERRLRERCYGDLEGMTYAEVAEKRPEDFARWQARVPDYAPPEGESLREFHDRAVEVALYLSRRHPGERIALVAHGGVLDCLYREAAGMTLEAPREHELLNASVNRLRCDTAHLTLLQWADVSHLEALALDEVDRRVP

SEQ ID NO: 38847 - protein, 315 aa, Oryza sativa
  misc_feature (69)..(69): Xaa can be any naturally occurring amino acid
MKKRARVRGTLAAKNGLIFNGCDTLPQICSPEAKFNPSPNVPANPTPPHRRRHRRHPPLTCSIPGAVRXDPDDERCLSSLQQSLSGLRNWSKASFSAPCEGFISHLQGVTCNNGRVYKLSLPGLSLAGTIPPDLSNCTNLQSLDLSSNALSGAIPPELSGLLNLAVLNLSANRLSGAIPRDLARCAYLNVIDLHANQLTGSIPDELGLLVRLSTFDVSYNRLSGPIPVLLANRSGTTGRFNATSFVGNKDLYGYPLPPMRGHALSVLAIVGIGLGSGLLSLVLSFSAVCLWLRATDRTATMPGEEGKISHLMPDY

SEQ ID NO: 38848 - protein, 787 aa, Ashbya gossypii ATCC 10895
MKSNVFVGIKGHGVLEGAAYREKYDYVLEGVTNGRYRDAVRAAAAAGVAVSPPELAEVGGGPGGGAGRLGLAAPWLELESAEPAIGEVSLRVLEHEYEYARAEGVKQLIVAPPRELGRLNLYAQRLGRLWERAGRGPPLVSVSLPLFEAGDPLSTWELWNTVRRLCRYHPNLTATLAVPRGRTPGHVLRRWLAEPVSCLLVSSSILVTNQYNYPVLHKHNQELIGLFQRLNGRAESVLGELTIVLHGIEKHAERVRGGEPIYLEYINYLLKKGDRALLQAPGEDGAPRVMQPLQPHAVDLSSEVYQIFEQDKTKYDLYAKAITAALRSIRSTMNKMWLHDDLNIIVVGAGRGGLVDRAYTCLRQLGISRFKLVALEKNPQAVIHLQKKNIEKWGNSVDIVSANMREWSSKVKFDLCISELLGSFGCNELAPECLEAFEKTNCTDRTIFIPQSYTSYVAPVSAPLLYQMLRNKEDNALESPWVVRNVPSCLLSTKVYELWSFKHPGGTSNTARSTVTNMKIKHKGEVHGLLGFFTAEIYGDIRLSILPDDCKIKLRGSAPDSDGRRKSVDLDSKLGHTPNMSSWSPIFFPLLYPMFVGDDTELELTMLRNRCMRGVWYEWSLSSYVYNAISQDRKPGSFLKGTQQLLNSKPEPNFKDTFTRSKKHDGLNSVMLDLQNTATILNAGDLGEPREAQYDGNIEENSASTELLKRTFVGKSEFISPELTGWQSVHDVHELGQTMTEKPNKGDYNNSEYEDKDYSNYEEYHVRVRTNTTELHNIGGHAYMIKL

SEQ ID NO: 38849 - protein, 221 aa, Zea mays
MGEEASCNATGAMQAATNARPAKENGRAPAVAEVVAQEAAADPRLQGISDAIRVVPHFPKHGIMFNDITTLLLRPRVFKDAVDLFVERYRGMRIDAVAGIEARGFIFGPAVALAIGAKFIPLRKPRKLPGEVISEKYVLEYGTDCLEMHVGAIERPGERVLITDDLVATGGTLCAAIRLLERAEADVVECACLIGLPKFKDFYKLNGKPVYVLVESRESDK

SEQ ID NO: 38850 - protein, 297 aa, Bacillus subtilis subsp. subtilis str. 168
MRTKKRTKEMLPIFDQKKVAFIGAGSMAEGMISGIVRANKIPKQNICVTNRSNTERLTELELQYGIKGALPNQLCIEDMDVLILAMKPKDAENALSSLKSRIQPHQLILSVLAGITTSFIEQSLLNEQPVVRVMPNTSSMIGASATAIALGKYVSEDLKKLAEALLGCMGEVYTIQENQMDIFTGIAGSGPAYFYYLMEFIEKTGEEAGLDKQLSRSIGAQTLLGAAKMLMETGEHPEILRDNITSPNGTTAAGLQALKKSGGGEAISQAIKHAAKRSKEISEDIEKTAAPLSGVIK

SEQ ID NO: 38851 - protein, 553 aa, Synechocystis sp. PCC 6803
MRNFPEIQNTAYDLIVIGGGINGVGTARDGALRGLKTLLIEKDDFASGTSSWSTRLIHGGLRYLEYFEFNLVRESLREREVLLHTAPHLVQPLQLTIPVYDWSSRAYWEIQAGMILYDILSFDKTLPSHRMLSPQQFQQLFRAAEKKGLKGGAQYFDGQVEYAERLDLEVTLSAQKAGAAMLNYVAVKGLEKGENNLITAIHCQDQLSGEKFTVNSAQAIVINTTGPWVDEVCGLAHRGGEPVAIVQERKIGGTKGSHIVVDPFPGAPASALYVEAFVDKRPYFIIPWLGKYLIGTTDHRYDGSLDRVKASDDEIDYLIAETNRVMPAAQLTRQDVRFTYSGVRPLPYTDGKKAGSITRNHILYDHSQDGVNNLISLIGGKLTTYRQVGEEMVDKVYGKLRRSAPPCPTLTQPLPGAEAYPLSLETAMDKYGNHLERHSIQHLFCLYGARAGDILALVHGAPELGERIIPSLPDIKAQVVFAVQAEMAHTLVDICRRRTAIAMVTNDYGFSALAGICQTLTDHCGWTQEQCDKQIQKYHEYMEQNCIPDYCLH

SEQ ID NO: 38852 - protein, 536 aa, Bacillus clausii KSM-K16
MNHDPHLHPYPSTRMPVYAKNGMVATSQPLAAQAGLEILKQGGNAIDAAIATAACLTVVEPCSNGIGGDAFAIVWTEGKLHGLNGSGPAPASISIDNVKQKGFEEIPKYGMIPVTVPGAPASWAALSERFGKLPLIDVLQPAIRHAEEGFALSPTVARQWKASYDKFKAENNTEEFQAWFETFVPNGHLPKAGEIWKSPDHAETLRSIGETKGASFYKGDLAAKIAAFFEKHGGFLSKADLENFQPEWVDPIHVNYRGYDVWEIPPNGQGLVALMALNMLNQVDIGDKEAVDTYHMQIEAIKLAFSDGQKYITDTNNMSEKIEDLLSDTYAKERLRLISDEALLPTAGKPKASGTVYLSTADADGNMVSFIQSNYMGFGSGLVIPGTGIAMQNRGHNFSMDPNHDNCLAPNKRTYHTIIPGFLTKDGKPIGPFGVMGGFMQPQGHVQVIMNTIDFHLHPQAALDSPRWQWVEGKNILLEPTFPRHIAEALARKGHNISIANDTMPFGRGQIIWKDEEKGTYVGGSESRTDGAVAPW

SEQ ID NO: 38853 - protein, 778 aa, Physcomitrella patens subsp. patens
MAGGRTQKNKAHKTRFASKSSRNAHKLAAGEKVIGKGPARVPLPGQAARDIRLQRNKNIREQKRAGVLAEKRATSSSSSAPRILVKANGTTGQNDNSMDMDSAVVRESKETGSITVVVPRFKLRLTIIQAPRNDLQGCLEVAKVADIVAFVGHVMPEEGGYIDQIGKKSLSMLRSLGLPVTTGLLVVNDVSAKKKSEVKKSAQAALQSELLEDTKMHVADSQEECQQVLRHLAEQRLSNPAWRAQRPFVVGNQVYIEDSSSPGTGILRLAGYVRSRAISVNQLVHLAGVGDFQLKQIDMVEDPCPLRQQKRHTSGDVMQVENDPGAQKASSSVAANAAVQEPLIVENTPDDLAGEQTWPTEEELAQAGKANRRKKKRVLPKGTSEYQAAWIVEDSDQEEGGDDDDAMEGDGLDDQAMDDDREGSEISEDDRKTSVWDDDDDTRSEMMDEENLTLEQRKAEIERLKAAHAADEEFPDEVDTPSDIPARQRFAKYRGLKSLRTSPWDPKESLPFEYAKIFDFDNFVRTQKTVLAKAKELDSCTQEGCFAAGCYVRLHVLKVPASKAELLLKSYKTNPVVVCGLLQHESKMSVLHYSIRKSEGYTDPIKSKELLVFHSGFRRHHTRPIFSTDDLNMDKHKFERFLHPGRFSIASVFAPISFPPLPLIVFKESDLPEGVSMVATGSLRSVDPDRIILKKIVLSGYPLRVQKRKAVVRFMFHNPEDVRWFRPLELWTKYGRRGRIKEPVGTHGSMKCVFDGVVQQRDAVCVNLYKRVYPKWPQ

SEQ ID NO: 38854 - protein, 244 aa, Ehrlichia canis str. Jake
MFNLSQKRFLITGASGGLGQAITKALSNAGATLCISGTRESVLEKIAEQYPNTYVLPCDLTNNEHVNSLINNACKAMSGIDGIVCNAGITLDKLTLRTTDEDWNKVINTNLTTTFKLNRNACRAMLKNNQGRVINISSVVAFTGNLGQANYSASKAGMIAMSKSIAREFASRNITVNCIAPGFIETPMTDVLSEEQRNNILTHIPMQRMGTPEEVAAAVLFLASDESRYITGQTLHVNGGMLMY

SEQ ID NO: 38855 - protein, 426 aa, Ashbya gossypii ATCC 10895
MQAISGQLTEFADNEQFYMRQQVQQTHPGQQQPGGLPQMFSPQVNHARLLGQQQQLMHGMEGGQDLQATYLLKQKMEAVNAVFGHQQQGLQPQQAQQQLLASGVLNAPPGVSLVHQGVGGMAPPPGALPPQLPLATGVHGSGLGLAPVPLIHHPNHLLVREVWANNLTAEFASIRRLVDQYNVIALTTEFVGTIVRPIGNFRSKNDYHYQTMRTNIDLLNPVQIGLSLSDAQGNKPDNVPSTWQFNFLFDMSKEMVSPESLDLLKKSGVAFDKHQSIGVNAYDFAQLLVDSGLLLTDEVTWVSFHAAYDFGFLVNILTDASMPNNKEDYEFWVQKFLPSFYDLNVLSKAVHDLKGQRSIPQPQHSLESLADELGIPRFPLFNTTGGQSLLALLAFVRLAKFPVFKLSNGSLDFAQFKNSIYGINKE

SEQ ID NO: 38856 - protein, 451 aa, Arabidopsis thaliana
AAIAENGNANVTAKGSSRELRHGRTAHNMSSSSLRKKSDLRLVQKVPCKTLKNILSNLQEVILGTKLTLLFLAIPLAILANSYNYGRPLIFGLSLIGLTPLAERVSFLTEQLAFYTGPTVGGLLNATCGNATELIIAILALANNKVAVVKYSLLGSILSNLLLVLGTSLFFGGIANIRREQRFDRKQADVNFFLLLMGLLCHLLPLLLKYAATGEVSTSMINKMSLTLSRTSSIVMLIAYIAYLIFQLWTHRQLFEAQQDDDDAYDDEVSVEETPVIGFWSGFAWLVGMTIVIALLSEYVVDTIEDASDSWGLSVSFISIILLPIVGNAAEHAGAIIFAFKNKLDISLGVALGSATQISLFVVPLSVIVAWILGIKMDLNFNILETSSLALAIIITAFTLQDGTSHYMKGLVLLLCYVIIAACFFVDQIPQPNDLDVGLQPMNNLGEVFSA

SEQ ID NO: 38857 - protein, 480 aa, Photobacterium profundum SS9
MSKEIKAQVVVLGAGPAGYSAAFRCADLGLETVLIERYSTLGGVCLNVGCIPSKALLHVAKVIEEAKALADHGIVFGEPQTDISKIRLWKEKVVNQLTGGLGGMAKMRKVTVVNGFGKFTGPNSIAVTNNSGEGEETTTINFDNAIIAAGSRPIKLPFIPHEDPRIWDSTDALELNEVPEKLLVMGGGIIGLEMGTVYHALGSKIDVVEMFDQVIPAADKDIVKVYTKRIKSKFNLMLETKVTAVEAREDGIYVSMEGKKAPAEPIRYDAVLVAIGRVPNGQLFDAGVAGIEVDERGFIHVDKQMRTNVPHIHAIGDIVGQPMLAHKGVHEGHVAAEVISGKKHYFDPKVIPSIAYTEPEVAWVGKTEREAKAEGINFETASFPWAASGRAIASDCADGLTKLIFDKDTNRVIGGAIVGTNAGELLGEIGLAIEMGCDAEDIALTVHAHPTLHESIGMAAEIYEGSITDLPNAKAKKKKK

SEQ ID NO: 38858 - protein, 576 aa, Saccharomyces cerevisiae
MSATLLKQPLCTVVRQGKQSKVSGLNLLRLKAHLHRQHLSPSLIKLHSELKLDELQTDNTPDYVRLVLRSSVYDVINESPISQGVGLSSRLNTNVILKREDLLPVFSFKLRGAYNMIAKLDDSQRNQGVIACSAGNHAQGVAFAAKHLKIPATIVMPVCTPSIKYQNVSRLGSQVVLYGNDFDEAKAECAKLAEERGLTNIPPFDHPYVIAGQGTVAMEILRQVRTANKIGAVFVPVGGGGLIAGIGAYLKRVAPHIKTIGVETYDAATLHNSLQRNQRTPLPVVGTFADGTSVRMIGEETFRVAQQVVDEVVLVNTDEICAAVKDIFEDTRSIVEPSGALSVAGMKKYISTVHPEIDHTKNTYVPILSGANMNFDRLRFVSERAVLGEGKEVFMLVTLPDVPGAFKKMQKIIHPRSVTEFSYRYNEHRHESSSEVPKAYIYTSFSVVDREKEIKQVMQQLNALGFEAVDISDNELAKSHGRYLVGGASKVPNERIISFEFPERPGALTRFLGGLSDSWNLTLFHYRNHGADIGKVLAGISVPPRENLTFQKFLEDLGYTYHDETDNTVYQKFLKY

SEQ ID NO: 38859 - protein, 292 aa, Frankia sp. EAN1pec
MKKNPMVNRALEDFSSESLARARGPVGFPVTREMASVSDEDADGVPVRIYQPEAKRTGLVVYFHGGGWCVGSVGLMDNVARELAHATGATVVSVEYRLAPEHPYPAGLDDCELVTRWALKNAKRFGTSPAQVVVAGESAGGNLAAAVTLRLRGSSAVPLAGQILIYPGLDSGVDPLPSRVEFINVMGGASMMTYYWDAYAAGRDLTRDPFVVPLQADSLAGLPPALILRGGCDFLRDEGLRYATRLSEAGVPVEDTCYPGQPHGFVNYMFPAAEKLFRQISQWSKRIFAEAN

SEQ ID NO: 38860 - protein, 266 aa, Methanosarcina acetivorans C2A
MKKMSEIIATLKKDYIYNLMIKGKRQDGRGFKDFRDLKLETNVIVKAEGSAKVTLGNTQVLVGVKLQTGTPFPDSQDEGVIITNLELNPIASPEFEPGPPREEAIEMARVVDRGIRESGAIDIKKLCITVGESVWIVFIDVHVLNDDGNIIDASCLAAIAALMTTMVPNEQQGLGEDVPLAMKEMPVGITIAKIGSKLMVDPSLDEEAVCETKLTIVSSSDGSVAGMQKMGISPLTEAELFEAIDLALEKAAELRGLYLEGLAKSE

SEQ ID NO: 38861 - protein, 627 aa, Bacillus clausii KSM-K16
MSLLRAEGLTKSFGDKICFESIHFSLEKGDRIGLLGVNGTGKSTLLKALAGVEGFDGGALFHANEFTLEYLPQQLDMPENETAIRYIYKSESTLMRTVASYEKALQDLEAHPHDNKSQTELLKWQEEMDRVGAWEAATQAKTILSKLGVSALSAKLGTLSGGQKKRVALARALIQPADLLLLDEPTNHLDHATVEWLEEHLKQYPGALIVITHDRYFLNRVANTIFELSEGALYRYVGNFETYLEEKAERKAQAEQAEDKRKNLLRRELAWLKRGAKARTTKQKARIQRVEALNAQTGPNANRQLDMPIGHKRLGKQVIELRQVSKSYQGKMLFSDLSFLMGKNERLGIIGENGSGKTTLLNMMAGRTVPDSGTVDVGETVRIGYYRQEDAELDGDLRVVEYIKEVAEVVYTTKGDAIYAEQMLERFLFPRPQQWTYIRRLSGGEKRRLYLLRVLMGEPNVLFLDEPTNDLDVETLAVLEDYLDTFPGAVVVVSHDRYFLDRVVDRMLIFEGNRLLRYDGDYSDYMTGRNDITDKQPQHEQVPTPQPKKEQKKLSYNEQREWEQIDGHIAALEEKQQIVEQAIADAGSDYGRIADLLKEKEMLDSELEAALNRWAELAEKIEALQSK

SEQ ID NO: 38862 - protein, 286 aa, Zea mays
HASTQALSSSMARLSHGLLGALNLVTLLLSLPVLCAGVYIVTRATTACERGLQIPVVAFGCGLLLLSLVGLAGACGRRGAARPFLWVYVAFMFLLAVLVFAFAVFAFVVTHRGAGGAVSGSGYREYRLGDYSGWLQARIAEPETWRRVESCLSEARVCGGREFYRQHLSPIQSGCCKPPTWCRFRYVNATFWEAPRSGLSAAAVSDGDCRAWSNDQQVLCFECDTCKGRVLETAKKKWKTVAIVNVSLLAFIVIVYTVGCFALRSKGGGRYFNGELNYGPVRFWRE

SEQ ID NO: 38863 - protein, 176 aa, Physcomitrella patens subsp. patens
VGLLGMGRTLQRDLDRIAGQADTITAEGLHYVLTETCLALLRHPDYCISGFTSHDINRSISMAEERFNSYSLEERGKFDEETLVNVSNLRKRMMGAPKADRFNNEYIVVTILVAAEGEYKLPAINGNADLKAALRKLGSISADSIQAVEVLWTPQDENDTLSERELLRDYPLLRSL

SEQ ID NO: 38864 - protein, 41 aa, Bacillus megaterium
AAAVEKFNLADKMSHISTGGGASLEFMEGKELPGVVALNDK

SEQ ID NO: 38865 - protein, 312 aa, Oryza sativa
  misc_feature (12)..(12): Xaa can be any naturally occurring amino acid
MAGGGSRRGAAXAAAEEARIGTSNVFAALDTLKRRKKPSSSSKKHAEKEKEVLWAPAPLTTRSWADVEDDDDDDYFATTAPPRPVWGTHHHAADAHDDDHDEQAALEQELESEDEEVDDDAEDEHEHETEDATPAEPAMNKAAAPPAPPKDTERQLSKKELKKKELEELDAILAELELSSKSNNDAQNETNGKKGAEQAADGENKEGAPAPAESKSSKKKKAKKDKSAKEAKETQELNGGVEEAAGAEPDEEVASMDVKDRIKKVASMKKKKSSKEMDTAAKIAASEAAARSAKLAAAKKKEKSHYNQQPVR

SEQ ID NO: 38866 - protein, 414 aa, Escherichia coli
SKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 38867 - protein, 193 aa, Bradyrhizobium sp. BTAi1
MTELTWRVENIETIANFLSAAECDDYVSWGEAIGFKDAPISTSMGMIMAKDVRNNERVMVDDRDRTQALYQRLAGHLAPSFQHRWQPVGLNERLRLYRYDVGQKFDWHRDGHFARDNGERSQFTFLIYLNDDFEGGATSFCDDTGLMPDGPLRVTPEKGMALLFHHPIMHRGDRVTRGRKYVLRTDVMYRRIK

SEQ ID NO: 38868 - protein, 366 aa, Lactobacillus sakei subsp. sakei 23K
MSLTAGIVGLPNVGKSTLFNAITKAGAEMANYPFATIDPNVGMVEVPDKRLDRIQEIIPAKKIVPTTFEFTDIAGIVKGASKGEGLGNKFLENIRQVDAIVHVVRAFDDDNITSVTGTVDPLDDIDTINLELSLADLESVTKRYARVEKIARTKDKEALAEFEVLKKIKPVLEEGGSVRSIEFNEDEAKMVKGFFLLTSKPVLYVANIAEDAMGDPDSVDYVKQIQDFAAKEGAEVIAISARTEEEIASLDDADKAEFLEAEGVTESGLDKLIRASYHLLGLATFFTAGGKETRAWTFRQGMKAPQTAGVIHSDFERGFIRAETVSFADLDQYGSMQAVKEAGRLRLEGKEYMVEDGDIIEFRFNV

SEQ ID NO: 38869 - protein, 71 aa, Schizosaccharomyces pombe 972h-
MIIPIRCFSCGKVIGDKWDTYLTLLQEDNTEGEALDKLGLQRYCCRRMILTHVDLIEKLLCYNPLSKQKNL

SEQ ID NO: 38870 - protein, 372 aa, Arabidopsis thaliana
MAATTSSGDEPPETKSPAQLIPLLSEDVALSCLARVPRCHYPILSLVSKTFRSLPTSPLLYATRALVGATENILYVAIRIPPESGACWFTLLHRTLSNSTNSKMLVPIPSCPSPSLVGSAYVVVDSEIYVIGGSIRDVPSSSVWVLDCRFHTWRRVSNMRVGREFAAAGVIDGKIYVIGGCVVDNWARSINWAEMFDIKTQTWEPVASPGMEVREKWMHASAVMEGKVYAMADRNGVVYEPKEKKWEMPEKRLDLGWRGRACVIENILYCYDYLGKIRGYDPKERIWRELKGVESLPKFLCGATMANRGGKLTVLWEGKAGSGGSRRMEIWCAEIDVGRRGEREIWGKIEWSGTVLTVPNESAIVNCLAATV

SEQ ID NO: 38871 - protein, 495 aa, Oryza sativa Japonica Group
MATAGALALVAICSYLAVTSNKQKRRRRPPVVGTVFHQLYNVRRIHDYHTALSREHTTFRMLVPAGGDQIYTCDPAVVEHILKTNFANYGKGPFNHGNAKDLFGDGIFAIDGEKWKQQRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSVVDYKYLRDIILNIVIAGKDTTAGALAWFLYMVCKHPEVQEKICHEAMVATSAGDTASVDEFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVSYRTTLTLAIDQGLHLTATAR

SEQ ID NO: 38872 - protein, 498 aa, Zea mays
HASSDAWVSMDYLAAAVPVTLALGVGAILLVLRWTYCRRRTSAEEARLPPGSRGLLFLGETLHYLAASSTPGVLPPFFQRRLERYGPIFRTNLVGEDLVVSLDAELNAHVLKQEERGFQIWYPPSFMRVFGADNITAKLGVLHRHMRTLVLRLFGHQTVRSVLLHDVQRSARDELRSWLGRPDVEVRTATSRMIFGVTANKLISHDDAASGGTLWRCFHDWTSGLLSFPVSIPGTTFYRCMQGRKKVMTMLKQQLVERRRNAAERETTEDFFDLVIDELNKPDPMMDESTALDLLFTMLFASHETTSMVLTVILKYLTDNPKALQELTEEHERILESRADPGSDLTWEEYRSMKFTSHVIHESLRLANIALAMFRKANQDVHINGYTIPKGSKIMMCALASHLNTEVYEDPSVFNPWRWKDIPEPVGTSKDFMAFGGGLRLCAGAEFSKMQMAMFLHYLVTNYSWKPVSGGTMLFYPGLQFPEGFHIQLLPKIPNVVP

SEQ ID NO: 38873 - protein, 569 aa, Oryza sativa Japonica Group
MDGDSSYSPALAAVAGAVALVAFCSYYLAVTRATGDGEARRRRRRHPPVVGTVFHQLYHVRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKVSACMPYQYQAHVLTYTTSIVFLMSKCSFLQGLLTRATMDSIFTIAFGQDLNTLDGSGEGRHFAKAFDDAGEYLLLRYLNPFWKLARLLNVGAEATLKERIKVVDEFVYKLIRARSDELSNTMAQDHRSRDDLLSRFIQATTSDSGTVDYKYLRDIVLNIVIAAKDSTSGSLAWFLYMACKRPEVQEKIFDEVMETTNAGDCASIDEFLTSLTDQALNKMHYLHAALTETLRLYPSVPLENKQCFSDDVLPNGFSVSKGDGVFYMPYAMGRMEFLWGKDAEAFRPERWLDEHGVFQQESPFKFTAFQAGPRICIGKDFAYRQMKIFAAVLIRSFVFKLRDKKDNVAAQNSPRLQPTTRTRKHQQQRQQRNQRTNTQHHRRRLGTRTKP

SEQ ID NO: 38874 - protein, 367 aa, Bartonella quintana str. Toulouse
MGFKCGIVGLPNVGKSTLFNALTKTATAQAANYPFCTIEPNTGEVAVPDSRMEKIASIAGSKEIIPTRISFIDIAGLVRGASKGEGLGNKFLANIREVDAIIHVLRCFQDDDITHVEGRIDPVSDATTVETELMLADLESLERRIVQIRKRATGKDKEALIILPIMEAALNLLQKGSPVRSLLKEISSDERRILDSLNLLTSKPVLYVCNVSENDAAHGNSFTQTVEKMATTQNAQSIIISASIEAEITQLNDAEAIEYLSALELFESSLNCLIRAGYHLLDLITYFTCGPKETRAWTIPRGTKAPQAAGIIHSDFERGFIRAQTISYEDYIALGGENGAKEAGKARDEGKEYIVQDGDIILFKYNT

SEQ ID NO: 38875 - protein, 121 aa, Coprinopsis cinerea okayama7#130
MKPTSGTEQNRMAESLILFESVINSRWFLRTSIILFLNKIDVFKNKLPKVPLERYFPEYTGGPDINKAAKYILWKFMQANRARLSVYPHLTQATDTTNIRLVFAAVKETILQNALKDSGIL

SEQ ID NO: 38876 - protein, 310 aa, Bartonella quintana str. Toulouse
MKLFCGNSNPRLAEDVATYLNTPLGKATVKRFADQEIFVELHENVRGQDVFVLQSTSYPANDHLMELLIMIDALHRSSARRITAVIPYFGYARQDRKPGPRTPISAKLVANLITEAGAHRVLTLDLHAGQIQGFFDIPTDNLYAVPVISRDVKVHYSLENVIVISPDVGGVVRARSLAKRLNSLLAIVDKRRERPGESEVMNIIGDVSGKDCLLLDDIVDSGGTLCNAASALLKHGANSVTAYITHGVLSGNAIERITNSEMKELVVTDSIMPTAAVENAHNIRVLPIADLIGEAIARTAAEQSVSSLFG

SEQ ID NO: 38877 - protein, 407 aa, Pseudomonas putida
MAIEIKAPTFPESVADGTVATWHKQPGEAVKRDELIVDIETDKVVLEVLATADGVLGAIVKGEGDTVLSDEVLGSIVEGGAAAAAPAAAPAAAAPAAAAADAGEDDPIAAPAARKLAEENGIDLAAVTGTGKGGRITKEDVVAAVANKKSAPAAAPAAKPAAAAAAPVVVAAGDRTEKRVPMTRLRAKIAERLVEAQSSMAMLTTFNEVDMTEVMALRSKYKDLFEKTHNGVRLGFMSFFVKAATEALKRFPAVNASIDGNDIVYHGYADVGVAVSSDRGLVVPVLRNAESMSLAEIENGIATFGKKARDGKLAIEEMTGGTFTITNGGTFGSMMSTPIVNPPQAAILGMHNIIQRPMAINGQVVIRPMMYLALSYDHRLIDGKEAVTFLVTIKNLLEDPSRLLLDI

SEQ ID NO: 38878 - protein, 386 aa, Polaromonas sp. JS666
MKIHEYQGKEILRNFGVPVPRGIPAFTVQEAVEAAQKLGGPVWVVKAQIHAGGRGKGGGVKVAKTIDDVKRIAGEILGMQLKTHQTGPEGQKVRRLYIEDGADIQKEYYVSAVTDRESQKVAFIASSEGGMDIEEVAHSNPEKIIKVFVDPLVGMTDAQAKEVAAGIGMPADSVAQTVDVLQKLYKCYMETDASLVEINPLNRNSKGEIMALDAKFNFDANALFRHPEIVAYRDLDEEDPAEVEASKFDLAYISLDGNIGCLVNGAGLAMATMDTIKLFGGEPANFLDVGGGATAEKVTEAFKIMLKNPEVKGILVNIFGGIMKCDTIADGVITACKAVNLSVPLVVRMKGTNEDLGKKMLADSGLPIIAADTMAEAATKIVAAVK

SEQ ID NO: 38879 - protein, 386 aa, Brassica napus
KMKKKYYSWDECINLREVKSLRRMDHPNIVKLKEVIREHDILYFVFEYMDYNLYQLMKDRQKLFTEAVIKKWCFQVFHGLSYMHQRGYFHRDLKPENLLVSKDIIKIADFGLAREVNSSPPFTGYVSTRWYRAPEVLLQSYVYTSKVDMWAMGAIMSELLSLRPIFPGASEADEIYKICGVIGSPTEETWLEGLNLANTINYQFPRLSGVPLSSLMPSASEDAIDLITRLCSWDPCNRPTAAEALQHPFFQSCFYVQPSLRPKPSVARTPPPVGPRGSFEHQTVKRQTLSLAKAKTFNSHSSPKSNAAFGSGVHRKLDLAKQDATRNTKPVRSSVKDTIYRPPGRKSPSGSSVNKNRVARGVSETGDKLSNMSIRGTVSRRHSVSV

SEQ ID NO: 38880 - protein, 431 aa, Yarrowia lipolytica CLIB122
MDKVIQKKEQWGEKLENLICFHPWIRIIFFSKAQIKHYPKKRFNTNAKERGWTRPIIIVGWFLVYLYAASKAIAEHVYPTMAPLATSHFSGLSLLSSQAVVQSSIFIVTRPAFAKISDHIGRLEGWTLVILAHLLGSVLFAAAPNIGCYFAGTVFWEIGTVGGHLMTELYASDTSTINTRIIFSSFIQSPNIWGPYAAAPIVGAILKVATWRWGYGMFAIILPVCSLGIIVLFSMMRVKEIRLGARGDFYTPGGVKRFLLSFDIVGLVMLCAGTILFFFPITLAAGTEKWSKPSFIVMLTLGSFLMAVFPLWELYGARSPLISWKLFRNRVMICSCIILFFSSMSNKLSVPYYITWLLVVRGYSPKAATNISSALTVSNNAFGILFAAPYLWWNGKPKHMMVLGTCLYFVGTGLTYRFRRAHSGLGILIIS

SEQ ID NO: 38881 - protein, 286 aa, Chlamydomonas reinhardtii
LTQNMLMLRFANPIFSAFFNRHYISNIQITFKEPFGTEGRGGYFDSYGIIRDVIQNHLAQVRGRVCIHFACVCVCVCVCVKTLRVGQCMRCRITAADYLKSRRVCVGRGAGGGRQGQPGYLDDPTVNPGSRTPTFAAVRVFVRNERWDGVPIIIKAGKALNERLAAVRIQLRTPPASIFGPLDHMRNELVVRFQPGEAIYAKMVVKKPGLEMDFEMSELDLSYPERYKGVVIPDAYERLILDCIRGDQQHFVRRDELRAAWAIFTPLLHAIDAGAVPLHPYPYGAR

SEQ ID NO: 38882 - protein, 491 aa, Afrostyrax sp. Cheek 5007
  misc_feature (3)..(3): Xaa can be any naturally occurring amino acid
  misc_feature (5)..(5): Xaa can be any naturally occurring amino acid
  misc_feature (31)..(31): Xaa can be any naturally occurring amino acid
  misc_feature (485)..(485): Xaa can be any naturally occurring amino acid
  misc_feature (488)..(488): Xaa can be any naturally occurring amino acid
  misc_feature (490)..(490): Xaa can be any naturally occurring amino acid
NPXIXKSGVSALEKKNLERIAQIIGPVLDVXFPPGKMPNIYNALVVKGRDTVGQEINVTCEVQQLLGNNRVRAVAMSATDGLMRGMEVIDTGVPLSVPVGEATLGRIFNVLGEPIDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEQNFAESKVALVYGQMNEPPGARMRVGLTALTMAEYFRDVNKQDVLLFIDNIFRFVQAGSEVSALLGRMPSAVGYQPTLSTEMGSLQERITSTKEGAITSIQAVYVPADDLTDPAPATTFAHLDATTVLSRGLAAKGIYPAVDPLDSTSTMLQRRIVGDEHYKTAQRVKQTLQRYKELQDIITVLGLDELSEEDRLTVERARKIERFLSQPFFVAEVFTGSAGKYVGLAETIRGFNLILSGELDSLPEQAFYLVGNIDEVIAKAXNLXMXR

SEQ ID NO: 38883 - protein, 503 aa, Zea mays
MMLAILARRRAAEAVLRRPQAAAGAAVSAWRAYAAAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLSSPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDPCGDGVKLTLEPAAGGEQNILEADVVLVSAGRTPFTSGIGLETLGVETDKAGRILVDKRFMTNVKGVYAIGDAIPGPMLAHKAEEDGVACVEFIAGKEGHVDYDTVPGVVYTHPEVASVGKTEEQVTALGIPYRVGKFPLLANSRAKAIDDAEGVVKVIAEKETDKILGVHIMAPNAGEIIHEAVIALQYGASSEDVARTCHAHPTVSEALKEACLQTFNKAIHI

SEQ ID NO: 38884 - protein, 453 aa, Bacillus clausii KSM-K16
MYETLLAVQKEHVFTGATKAVAYRKQQLQKLKTMLQTYEKELLSALRADLNKQEPEARMVEMAFLHQEIDLALESIDEWVKPMKVKTPTSHAGSKSWVATEPYGSVLIISPWNYPIQLTFAPLIGALAAGNAAVLKPSELTPRTSSIMAAAVRATFPKELVTVVEGDAKTAETLLNLPFDSIFFTGSAAVGKIVLEKAAKHMTPCTLELGGKSPVIVDGEAKLKLAAKRIAWGKFLNAGQTCIAPDYALVDEDVYEPFLEQLKTQTYTLFSDKTKEGTYTQIVNDKHFERLRRYLDNGHIALGGQISPQARLMSPTILTNVPWDAPIMQEEIFGPILPVFRYKTPAEAIQKVRSLPNPLALYVFSENERVQRLFTEQLSFGGGCINDTLMHAANPYLPFGGKGASGIGAYHGYESFRTFSHQKSLLKQSTTFDVPFRYKQGKIANTFIRNICK

SEQ ID NO: 38885 - protein, 428 aa, Dehalococcoides ethenogenes 195
MSAVVKSIKAREILDSRGNPTVEADVVLSDGSFGRAAVPSGASTGSHEAVELRDGDKSRYNGLGVQKAVTNVNTAIAKAISGFKASDQQGLDNLLIELDGTPNKAKLGANAMLATSLAVAHAAAASCHMPLYRYLNNCDEYILPVPMFNILNGGKHASNSTDFQEFMVMPTGAKSFAEALRMGTEVYHSLKKVLKGMNQNTTVGDEGGFAPSLPTNKDAVEVILKAIEKAGYRPGEDIFIALDPASSELYQDGKYTLATENKTLSSAEMVDYWCGWVEKYPIISIEDGLFEDDWDGWKMLTKKIGSKVQLVGDDFYVTNIKRLERGIKENASNSILIKLNQIGTLSETIAAIKMANNSAWTAVVSHRSGETEDTTIADLAVAMNAGQIKTGAPCRAERTAKYNRLLRIEEELGGKAKYPGKEAFFNLK

SEQ ID NO: 38886 - protein, 975 aa, Ashbya gossypii ATCC 10895
MSGYYNHVKHQGYSRYGQNSTVRNGQHDGLRYRNPSPAHNGTNEGEGLQGSRYENAGGVTHARRPPPVVKWGEAAFRAKYHYFDVEERKLLHLDEMKHWQNGRLPANGYVLVADAGSKGRPVMRERNPEEQAVDPRGARAAHTVRRVRSLLTALPRIPYDAHWVGPEPPKEVVVFPKQREQALSVQDPIIKNFFGTFGEVAHFESFNDPNNALPLNIYLVRYINVEGNPDSPYKAAYKAVKQFAKQDYLVSGARFAVRLNMNGFLQKTIDKFVTENLQRAAKLRHEQAKQQSTVQKVTNVSAVPSGVPPPKIPLGLERIVNNKPILRVSARFCALHGITSEDFKYGLKNYHWTRVINHYSGIYIIFDDIAEAEKCLQMESLRLTFFSRRRKIPVKIKFMLIEPSHQPPASQPLTDQDEVPKVYETEAELIEETLKHIINELKTTLYKDIRRRLLGPTIFDALNPGNYPDIVARRQKEEEAKKEKEKAMVEKTKKEAPSAAAFDIFNLYGTAYKKRDGTKGKKRHVAEGRPEESSGRRRIQSKGTAPMAHMLNYESLKVNGTASPIKEAESETCSSDEEDDDNFDVEMTDQSSIKKLKRESTATTPEQEPLQERVAGLSAERTKELLSYPEKYRPLAGDQPEPIYPEFLIEKYDDLLLSLVDLQRSVKDKEVMELLKKVIAYDREEVKDVINDIEFFAWRLHRDYKEHKENMQHQSKLSESTYKNLLNAHGGCFKQQGFRKMPDKLKSIYLPHRRKLNQPLNTVYHHGIEDFANTDNNKMDTDPPEDTFTPEQTSSRVNRALQRRFQQDIEAQKAAIGTESELLSLNQLTKRKKPVTFARSAIHNWGLYALEPISAKEMIIEYVGERIRQPVAEMREKRYLKSGIGSSYLFRVDESTVIDATKKGGIARFINHCCDPSCTAKIIKVGGMKRIVIYALRDIAANEELTYDYKFERETDDEERLPCLCGAPNCKGFLN

SEQ ID NO: 38887 - protein, 384 aa, Synechocystis sp. PCC 6803
MDNKQMLMIPGPTPVPEKVLLAMAKHPIGHRSGDFSKIIAELTANLKWLHQTENDVLMLTTSGTGAMEASIINFLSPGDRVLVGNNGKFGDRWVKVAKTFGLAVEEIKAEWGKALDPNDFKTLLEADSDKTIKALIITHSETSTGVLNDLAAINAAAKAHGGALMIVDAVTSLGATPVAIDDLGLDVVASGSQKGYMIPPGLGFVSVSAKAWQAYETATIPRFYLDLKKYKKSTDEDSSPFTPPINLMYGLQASLQMMKAEGLDAIFTRHQRHTNATRGAMKALNLPLFAPDNAASNAITAVAPLGVEAEKIRSTMRKKFDIAMAGGQDHLKGKIFRIGHLGFVCDRDILSCIGALEATLIELGYEGVTPGSGVAAAAGVLAKG

SEQ ID NO: 38888 - protein, 137 aa, Leuconostoc mesenteroides subsp. mesenteroides ATCC 8293
MVERTFMMIKPDGVSRGKIGEIIQRIEHKGYAIKAMKMVQPTPELLAKHYAEHVGKSFYPSLVQYMTLGPVIAMIGEGTNIVSGWRTIMGTTNPTLAAPGTIRGDLGREWEGEAVMNIVHGSDSVEAAEYEIKLWFA

SEQ ID NO: 38889 - protein, 283 aa, Lactobacillus sakei subsp. sakei 23K
MTTLTTTYTLANGVQIPVLGFGTWQTPDGDTAIKSVKAALEAGYRHIDTAQAYQNEASVGTAIQESGVARQDLFLTTKIWNANHSYDLTMQSFEESLQKLQTDYVDLLLIHWPNPIDFRDNWETANAETWRAMEELYNAGKAKAIGVSNFRAHHLEALKKTAKVQPMVNQIFLAPGELEAETVQYSRDNGLLLEAYSPLGTGKIFDVPEMKTLAAKYQRSIPQIASRWSLQHGFLPLPKSVHANYIQENTQLFDFELTPEDMQTIDQLDGVVGKAKDPDTATF

SEQ ID NO: 38890 - protein, 454 aa, Schizosaccharomyces pombe 972h-
MSNSLNDQTRPPDSSVVDSTSSNFPNASNDSVHDKPVKQDEQSNPNVREAIANSDGQESLAVKENKDTESSSSHFVPNGVSNSKKRKLVATDLDVDFDISSVRVTEKPSVLEEKSGVIQFRVVSNDDTADSMIMLTGLKNIFMKQLPKMPKEYITRLIYDRNHLSMTIVKDNLHVVGGITYRPFEQRGFAEIVFCAIASNEQVRGYGSHLMNHLKDYVRGTTTIQHFLTYADNYAIGYFKKQGFTKEITLDKSIWVGYIKDYEGGTLMQCTMIPKIKYLEANLILAIQKAAVVSKINRITRSNVVYPGLDVFKDGPAHIEPSQVPGLMEVGWCKEMEELSKKPRPKPFFAVLEMLFTEMQNHPSSWPFMQPVSKEDVPDYYEVIEHPMDLSTMEFRLRNNQYESVEEFIRDAKYIFDNCRSYNDSNTTYYKNADRLEKFFQKKLRETEYSHLAD

SEQ ID NO: 38891 - protein, 232 aa, Oryza sativa Japonica Group
MAGGGDELKLLGMWASPFALRAKLALSFKGLSYDYVEEDFKNKSELLLSSNPVHKKVPVLIHNGKPICESQVIVQYIDEVFPDAGVTLLPADPHDRAVARFWASYIDEKLFGAWIPVFRGKTEEEKAEGVKQTFAVAEKLEGALSECCKGKPFFGGDTVGYVDVVLGGFVAWVHAIEEVFGLNQFDAAKTPLLAAWLERFDELDAAKEAMPDIGRLVELEKMRQAQAQAAVY

SEQ ID NO: 38892 - protein, 218 aa, Oryza sativa Japonica Group
MSSTNSSGDPAAVRVVGGWASPFMNRVVVALKLKGVEHEMLQETVGKKSELLLRSNPVHKKIPVLLHHGKPIAESLIIYIDEVWPASNGAPSILPRDPYGRAVERFWAKYIDDKIPPGIRVLRGSVEEDKDKAAGEMSTALQHLEEAFVKCSQGKQYFGGDNIGYLDIALGSFLGWIRAVEKIAGVELLNETKVPNLAAWADRFCAHPAVVDVVPDAD

SEQ ID NO: 38893 - protein, 135 aa, Zea mays
MAAAAKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELTQSIKAKGMRPGVSLKPGTPVEDVFPLVEAET

SEQ ID NO: 38894 - protein, 858 aa, Gibberella zeae PH-1
MALLQRFVAPSARGALRQSPAITLMITRKASNASPPKLKDPSLFKQDVCYVNGKWVKAKSGKTFKVNDPSTGDLIGTCPEFDSKDAQLAIRAAADAFPSFRNKTGRERSKLLRAWYEQMTANAEDIAKLITWENGKPMADAKGETTYAANFLEWFSEEAPRVYGDTIPSSVPGNRVWTLKEPVGVCGLITPWNFPAAMITRKIGPALAAGCTVVAKAPAETPFTSLALAELAHRAGIPKGVVNVVTSHENTPELGELLTSDPTIRKVSFTGSTNVGKLLMKQSAGTLKKLSMELGGNAPFIVFDDADADAAVAGAITSKFRSSGQTCVCANRIYVQRGIYDEFVSKFTEKVKSFNVGHGFDQGVTHGPLIHDKAIEKVEAHVKDAEKKGGKVTIGGKRLSDLGSNFYAPTVIRDMTPEMDMASQETFGPVAGLFPFETEEEVVKMANNTEVGLAGYFFSRDLERVHRIAEALEVGMVGVNTGLISDAAAPFGGVKESGFGREGSLYGISEYQITKMITYGVYYGEGSNEYNIHTLNHENVVVITFALQIIERAKCRRFEPCHDQRNFDLYLDPRNAQNRFNHNTLFEMAFSLANAPLRTCLRQLVRSKGPAPLRSIAASPRAFSTSHVLLKKRKISAPANSPNTATAKAAAGSMNKAEYDTAKVPAPDPEDPLDFTAVIAAYAPIDAHFKTQLAGMIHGGRFNPTNLGSLPVTIKDEEGADATFPLRELAQVVPRSGRAISLLVNDKEYIKPIMSAVQSSREFNQQPQRSEDNELELLLKVELERKDDVERRVKEAVQQWKDRIRNARSRHEKTLKDWKKNGTVLPDIVKKAEKELQKVQDKKMKEIDQEEAQTIRQL

SEQ ID NO: 38895 - protein, 514 aa, Coprinopsis cinerea okayama7#130
MTSRLLGYLQLAIVLYNSVARGQMILSPSDTMVISNANVSPDGVTRSLTHLKNTNLNSTSRAVVVNGVHPGPDDVFAINVVNELTDPTMLRSTSVHWHGLFQRGTNWADGAEGVNQCPISPERSFLYRFSPAGHAGTFWYHSHFGTQYCDGLRGPMVVYDPDDPYKNEYDVNTIITLADWYHTPAPSIRGPFFPDSTLINGIGRTPGGPKVDLAVVNVEAGKKYRFRIVSLACDVNFQFSIDKHKLTIIEADGQLTDPLEVDRIQIFTGQRYSVILNANQTPDVYRIRAIPNAGVHGLTDTTAGGVNSAILRYANAEATELPQEDELPSNLVDLQEWMLHAYAGGDPAAPGRPEAGGADVRIPLRFTFSGGRFFVNGTAYSSPSVPTLLQIMSGANPGELLPENSIYYLPRNQVIEVEIPSAGISASGPHAFSVIRSAGNTSYNYVNPVKRDVVNIGGDSDLVTIRFVTDNPGPWFFHCGLAIVFAEAMKDTMSANPDVPGESTLGISPPNEFR

SEQ ID NO: 38896 - protein, 71 aa, Brassica napus
MIIPVRCFTCGKVIGNKWDTYLDLLQADYTEGDALDAIGLVRYCCRRMLMTHVDLIEKLLNYNTLEKSDAN

SEQ ID NO: 38897 - protein, 461 aa, Thermoanaerobacter tengcongensis MB4
MENLHTREYDLAVIGGGPGGYVAAIKAAKKGAKVALFEKDKLGGTCLNRGCIPTKAYARAAEVYGILKKAKEFGFDIQINYFDYAQVVKRKDTIVGELVEGIKALLKANKIEVFNKEAKVDKEKNVIFEGEKIKAKNIIIATGSSPAELPIEGIDSKNVLNSDTILEITSLPKSLCIIGGGVIGMEFAFIMNQFGVEVYVVEMMPNILPSLDKKVSSAVKFAAQKRGIKIYTSSTVEKVEEEGENSVVTIRSGDDIKKISVDKVFVSIGRKLNTSIGPIVDLLEFDKKAIKVDEHMRTNIEGVWAVGDVTGKMMLAHVASSQGEVAVDNIFGKSRTLDYYKIPAAVFTEPEIGYFGYTEEEAKEKFGEIKVGRFDFKHNGRAKTYGETEGFAKIISTEDGEVVGAWVVGSGASELVHIISTACQSGAKAEELKDVVYAHPTKSETIMEAFKDIFKEAIHKI

SEQ ID NO: 38898 - protein, 515 aa, Coprinopsis cinerea okayama7#130
MVISNANVSPDGVPRSAVVVNGVHPGPVLVGQKDDNFAINVVNELTDPTMLRSTSVHWHGLFQRGTNWADGAEGVNQCPIAPERSFLYRFSPAGHAGTFWYHSHFGTQYCDGLRGPMVVYDPEDPYKDEYDVDDVNTIITLADWYHTPAPSIRGAFRPDATLINGLGRTPGGPPVDLAVVNVQEGQKYRFRIVSLACDVNFQFSIDGHKLTVIEADGQLTDPLEVDRIQIFTGQRYSVILHANQAPNNYRIRAIPNAGVAGLTGTVDGGVNSAILRYAGAPVAEPTTEAPSNMIDLSESQLHAYAGGDPAAPGRPEAGGADVTIPLRFTFSGGRFFVNGTSYTSPSVPTLLQIMNGANPGELLPENSVYYLPRNQVVEVEIPSTGISGSGPHPFHLHGHAFSVVRSAGNSSYNYVNPVKRDVVSMGGDSDLVTIRFVTDNPGPWFFHCHIEPHLVGGLAIVFAEAMEDTAAAHPDIPTEWRDLCDIHHDLDPSLTSVSIVRRAEPTGLSAKFRGL

SEQ ID NO: 38899 - protein, 413 aa, Staphylococcus epidermidis RP62A
MAEHSFDVKAVIKDFPILEQKVNNKRLAYLDSTATSQTPVQVLNVLDDYYKRYNSNVHRGVHTLGSLATDGYENARETVRRFINAKYFEEIIFTRGTTASINIVAHSYGDANISEGDEIVVTEMEHHANIVPWQQLAKRKNATLKFIPMTKDGELQLDDIKATINDKTKIVAIAHVSNVLGTINDVKTIAKIAHEHGAVISVDGAQSAPHMALDMQDIDADFYSFSGHKMLGPTGIGVLYGKRELLQNMEPVEFGGDMIDFVSKYDATWADLPTKFEAGTPLIAQAIGLAEAIHYIENLGFNAIHQHEKELTEYAYEQMLTIDGLEIYGPPKDRRAGVITFNLADIHPHDVATAVDTEGVAVRAGHHCAQPLMKWLGVSSTARASFYVYNTKEDVDQLVQALKQTKEFFSYEF

SEQ ID NO: 38900 - protein, 245 aa, Frankia sp. EAN1pec
MGRLEDKVTIVTGAGSGIGKAAALLFAQEGAKVVCADMNGSEKDTAAEIGPNAVAVQVDVAVGAQVENMVDTAVREFGKLDVLYNNAGISGSFGPIHELDEETLDRLLAVNIKGVFFGIKYAVPVMLANGGGSIINTASNAGMVGWKHKAGYSAAKGGVVLLTKSAALDYAKSGIRVNAVCPGMTWTGLAAAQAPAPPEDLKVPNPMARFAKPSELAAAALFLASDESSFVTGVAMPVDGGYVAR

SEQ ID NO: 38901 - protein, 178 aa, Yarrowia lipolytica CLIB122
MSKILAKLFGSRECRILMLGLDAAGKTTILYKLKLNQGISTVPTVGFNVEVLTYKNIKFNVWDVGGQDKIRPLWRHYFTGTEGLIFVVDSADRARIDEARQELHRIINDREMKDVLLLVFANKQDLKEAMHPKEVTEKLQLNSLKGRTWCVVASTAKTGEGLVEGLSWLSSNLPSMDK

SEQ ID NO: 38902 - protein, 489 aa, Antirrhinum majus
INPTTSGSGVSTLEKKNLGRIVQIIGPVLDVAFPPGKMPNIYNALVVKGRDTAGQPINVTCEVQQLLGNNRVRAVAMSATDGLTRGMEVIDTGAPLSVPVGGATLGRIFNVLGEPVDNLGPVDTGTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKETLQRYKELQDIIAILGLDELSEEDRLTVARARKIERFLSQPFFVAEVFTGSPGKYVGLAETIRGFQLILSGELDGLPEQAFYLVGNIDEATAKAMNLE

SEQ ID NO: 38903 - protein, 388 aa, Synechocystis sp. PCC 6803
MKAMILAAGKGTRVRPITHTIPKPMIPILQKPVMEFLLELLRQHGFDQIMVNVSHLAEEIESYFRDGQRFGVQIAYSFEGNIVDGDLVGKALGSAGGLKKIQEFNPFFDDTFVVLCGDALIDLDLTTAVKLHREKGAIATIITKTVPQELVSSYGVVVTDDNGKILTFQEKPAVEEALSTEINTGIYIFEPEVIDYIPSGQEYDLGGDLFPKLVDSGLPFYAVNMDFEWVDIGKVPDYWQAIRGVLSREIKNVQIPGIEVRPGVYTGINVAANWDNIEIEGPVYIGGMTRIEDGVKIIGPSMIGPSCLICQGAVVDNSVIFEYSRLGPGARLVDKLVFGRYCVDKTGAAIDVQAAALDWLITDARHAAVQYRQEYPSQREISKLLQPE

SEQ ID NO: 38904 - protein, 254 aa, Bacillus subtilis subsp. subtilis str. 168
MLHQFSRNELAIGKEGLETLKNSTVAVLGVGGVGSFAAERLARSGVGRILLVDKDDVDITNVNRQLHALLSTVGQPKVDLMKARIADINPECEVIALKMFYTEETYEQFFDYGLDYVIDASDTICYKIHLMKECLKRDIPLISSMGAANKTDPTRFQIADISKTHTDPIAKVVRTKLRKEGIKKGVQVIFSDESPIVIREDVRKEVGNDEAKIRKAKMPPSSNAFVPSVAGLIMGGHVVMDLLKDIEIKRVKDK

SEQ ID NO: 38905 - protein, 932 aa, Oryza sativa
MPSSSMAAVEATLQSNGQADGARPPLSVALHVPTSAVDQVNSVQGGSAPLSGNPNRRSHIQQNVQALPMLPEASHANALNTATGPAPAALGLTVDLDPTTSAALNGLSPAQKTLTLSRSQGYDAIVLELANERWKDRWERLCLANPADLPSASGSSATPSPLSAVQMSSGGAMLARSSSRQGLNSFTPGGVRQSPSPAVSSAGQSPFGSIAREAEEWRKAPAFKRSEVNLTKLEETEGVIALASQWIELDSPDEGVRLDCELALRQELAYASYLGIPNVVIPPPSSDPARKPFLADYARAINSCLASGSAETAPAGSWMTLTIQLPVSSPYQLNKILQRQNGKNGFGLTASTTAGSNASASSQASHASATSSAALLRAEDDWAWETWEQIRQLCAYNTRLQIALDLGSPLPGPSILARWMAEPVSMLWVPSVSYLANAKGFPVLSKASQSFFRTMFKKNPTVVLSGVQSPPPTHSRGGPLAYLQYLRHLEKAAPPDGAVDSFARGYTDWLQAPLQPLMDNLEGTTYEVFERDPVKYALYEEAVYKALLDRPASASTLIWVCGAGRGPLVDRCLNAADRAGRSVKLVALEKNPNALVTLQERQALEWGDQVRVQCGDMRRHPVPPSMADRPDIVVSELLGSFGDNELSPECLDGAMRFLKPNGISIPSSYTAFLSPLSSAKLHTEVLNGSNAALTSAVQKAAETPYVVLFQNVALLAARGGRLNSEQVQESWTFEHRPSAVTPLVYDEQGLPASNGHNIRSAKHTFHIPQAGTCHGLAGYFEAHLYDNVVLSIHPDPVRGSKDMLSWFPIFFPFREPLYLPANAELDVHMWRMTASDRVWYEWSAEAFLPIPTAVDAAKQRPVSLDASSSIGSTSTAADQHFANAPNTPRIPSLNLPNGPDALQPSPMQISTRAKINMTRLHNPGGRSSWIGL

SEQ ID NO: 38906 - protein, 460 aa, Polaromonas sp. JS666
MASKASGKTHPAVEAVRKSGATKVKVAVSDIDGVLRGKYLHRDKFLGTAEPYPAGGFGFCDVVLGWDMTDSCYDNTTVTGWQHGFPDALARLDLNTARHVPWDDGVPFFLGEFVNADGTPHAVCPRQTLKRVLKRAEKMGFMVMTGMEFEWFNFLETPHSWAAKKGVGPEQLTPGMFGYSVLRMNQNREFFKAIMDEMLAFDIPIEGLHTETGPGVYEAAIGFSEALAQADRAILFKTGTREIGARFGIMPSFMAKPNQHLPGCSGHIHQSLSDGKNNLFYDAKNPRKMSKLFESYVAGQVACMMDFGPMIWPTINSYKRLVDGFWAPVKPTWGMDNRTASFRVIAGSPKATRLETRCPGADVNPYLAMAAVIAAGLDGVEKGLKLTTPPITGTNQGAEHIARAPRTLIETTRIFQQSSIARDWLGDTFVDHFAATRDWEWRQWLDGVTDWELKRYFEII

SEQ ID NO: 38907 - protein, 202 aa, Oryza sativa Indica Group
MPSARVQAGGGGNGGAGGGGSGRFKRALLRNLILGLRKGGVASGEMGFHERKSAIKRAADAALAAARGAAPCWSRSLAAELAQAPQQHRSPPSPSPRKMICRKIVRRSLIRRRRRPIRPANNTTAATTKAYGGGGGGGGVARAMVRKRASVLKEIVPGGKALDMCALLGETLDYAVSLKAQVDVMQLLVRTLQEQKLKNSGN

SEQ ID NO: 38908 - protein, 602 aa, Oryza sativa Japonica Group
MAAAATAAAAATSTFTAAVPRARGRRHPTRVAAAAAATASSPEAAMAAAAPPLPMMRVAPETLQRQSGYLVRGRGEEGIGEGEAEAVGGDAAGGLGAMEYLTSVLSSKVYDVAIESPLQLATKLSERLGVNLWIKREDLQPVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQVCDRFIIHQFPCCKVVLYENCNLMHLKSSFYCHLSCTIFPFHFHLTKMYI

SEQ ID NO: 38909 - protein, 239 aa, Oryza sativa Japonica Group
MAGGGEELKLLGMWASPFALRAKLALSFKGLSYDYVEEDFKNKSDVLLSSNPVHKKVPVLIHKGKPICESQVIVQYIDEVFPDAGVTLLPADPHDRAVARFWAAYIDEKLFSAWILVFRSKTEEEKAEAVKQTFAVVEKLEGALSECSKGKPFFGGDTVGYVDVVLGGFVAWVHAIEEVFGLNQFDAAKTPLLAAWLERFDELDAVKEVMPDIGRLVELAKMRQAQAAGAAAAAAGEAS

SEQ ID NO: 38910 - protein, 232 aa, Wolinella succinogenes DSM 1740
MILAANFKTNHTRKSTRHYLERLSNFLFETSCEHDIFLFPPPLALDFFDDIGGVCIGTQNAYPAPSGAFTGEVGSEQLEELAIQTILIGHSERRGILGESQAFCAEKFRYYASLGYTIFYCIGESLEVRRAGIEATIRHNLSQLEGIDLSYPKLIIAYEPIWAIGTGVSASLEQIQETHAALKAHLSCPLLYGGSVNLSNIAEILALPEVDGALIGSASLKVEDFCQMIQKI

SEQ ID NO: 38911 - protein, 381 aa, Citrobacter freundii
  misc_feature (252)..(252): Xaa can be any naturally occurring amino acid
MIRAAHIAHLRRESPFDGGMPPTPPTILRERLLAQQQARVEELRHAKYEGILDGNSAITVLHGEARFKDDQSLIVSLNEGGERVVMFDRCLVATGASPAVPPIPGLKESPYWTSTEALASDTIPERLAVIGSSVVALELAQAFARLGSKVTALARNTLFFREDPAIGEAVTAAFRAEGIEVLEHTQASQVAHMDGEFVLTTTHGEIRADQLLVATGRAPNTRSLALETAGVAVNAQGAIVIDKGMRTSSPHXYAAGDCTDQPQFVYVAAAAGTRAAINMTGGDAALDLTAMPAVVFTDPQVATVGYSEAEAHHDGIETDSRPLTLDNVPRALANFDTRGFIKLVIEEGSGRLIGVQAVAPEAGELIQTAVLAIRNRMTVQE

SEQ ID NO: 38912 - protein, 245 aa, Zea mays
QVSFLHLPPPLHSQVPTTPNPVSPLRRRLRFGSARLEQKKMQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 38913 - protein, 512 aa, Schizosaccharomyces pombe
MLNSVIKRSALCRFKFTCLQVSECRPAQIEISKRLYSAKASGNGEYDLCVIGGGPGGYVAAIRGAQLGLKTICVEKRGTLGGTCLNVGCIPSKALLNNSHIYHTVKHDTKRRGIDVSGVSVNLSQMMKAKDDSVKSLTSGIEYLFKKNKVEYAKGTGSFIDPQTLSVKGIDGAADQTIKAKNFIIATGSEVKPFPGVTIDEKKIVSSTGGPYLYQRYPKKMTVLGGGIIGLEMGSVWSRLGAEVTVVEFLPAVGGPMDADISKALSRIISKQGIKFKRSTKLVSAKVNGDSVEVEIENMKNNKRETYQTDVLLVAIGRVPYTEGLGLDKLGISMDKSNRVIMDSEYRTNIPHIRVIGDATLGPMLAHKAEDEGIAAVEYIAKGQGHVNYNCIPAVMYTHPEVAWVGITEQKAKESGIKYRIGTFGFSANSRAKTNMDADGLVKVIVDAETDRLLGVHMIGPMAGELIGEATLALEYGASAEDVARVCHAHPTLSEATKEAMMAAWCGKSIHF

SEQ ID NO: 38914 - protein, 421 aa, Zea mays
  misc_feature (253)..(253): Xaa can be any naturally occurring amino acid
MAMSASSSSRALLRRIGGALLRRSFSSSSAASAGYHVAGGPSYMRGAVFWEPGRPLTLEEFRMPRPKAGELLIKTKACGVCHSDLHVLKGELPFSTPCVVGHEITGEVVDHGTHTPVEIINRFPVGSHVVGAFIMPCGNCFYCVKGQEDLCESFFAYNRAKGTLYDGETRLFLRGNGKPVYMYSMGGLAEYCVVPANALAVLPDSLPYTESAILGCAVFTAYGALRHAAEMRPGDSVAVIGVGGVGSSSLFLXCLQIAKAFGASQVIAVDVLDEKLQNATTLGATHTVNAAKDDAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIME

SEQ ID NO: 38915 - protein, 277 aa, Xanthomonas axonopodis pv. citri str. 306
MQKPAVTVMVKAARLAGNVLLRGINKLDALNVVQKGRMDYASEVDADAEKVIIKELKRGYPEYAVFGEEGGVQGGKSGRYTWVIDPLDGTSNYLRGFPHYCVSIALVENGEPTDAVIFDPLRNELFTASRGAGAVLNDRRIRIAERKDLEGAMVHTGFPPRERARASAQLKCVDALLVQAEDVRRTGSAALDLAYVACGRADAYFEAGVKAWDIAAGVLLVREAGGRVCDYKGATPPRMDNMGPETQQIVAGNIKISDALQKVIVNTGYAREFDAKF

SEQ ID NO: 38916 - protein, 389 aa, Beta vulgaris
MAIDCMRNLSSTPKSYQNSKQEQNNPLIFDASFLNHQSHIPQQFIWPDGEKPDFIEPEELAVPLIDLQGFLSDDPEKTLKASKLIGEACLKHGFFLVVNHGVERDLIKDAHNLMDDFFEEPLSLKQKALRKLGEHCGYASSFTGRFSCNLPWKETLSFNYSPQESSSSKTHVQDYFNNKFGDSFNHLGTTYQQYCEAMSTLSLRIMELLGLSLGVGRRHFREFFEGHESVMRLNYYPPCQRPDLTLGTGPHCDPTSLTILHQDQVGGLQVFADGKWRSISPNFNAFVVNIGDTFMALSNGRYKSCLHRAVVNSEKPRKSLAFFLCPNKDKVVKPPRELVDEENNPRVYPDFTWPLLLEFTQKHYRADMNTLKVFSQWVQQQRSTQQVEK

SEQ ID NO: 38917 - protein, 214 aa, Vibrio angustum S14
MSENSHQCVIIGIAGASASGKSLIASTVYKELKEKVGDHQIGVITEDCYYNDQSHLTMDERVKTNYDHPNALDHDLLCDHLEQLIKGEAVEVPQYSYSEHTRMKETTLLTPKKVIILEGILLLTDPRLRDIMHASVFMDTPLDICLLRRLQRDVAERGRTMESVLVQYQKTVRPMFMQFIEPSKQYADIIVPRGGKNRIAIDVLKAHIAKLLRS

SEQ ID NO: 38918 - protein, 442 aa, Rhodobacter sphaeroides 2.4.1
MPGHIFGRSTRGSLPVAAEGEGCYILDTEGRRYLDGSGGAAVSCLGHSNAAVRAALHDQLDRLAFAHTGFFTSEPAERLADRLAAAAPEGIERVYLVSGGSEAVEAALKLARQYFMEVGQPGRHRVIARRQSYHGNTLGALAAGGNEWRRAQFAPLLVETSHVSPCYEYRGRAEDESLEAYGLRVADELEAEIQRLGPETVMAFVAEPVVGATAGAVPAVPGYLKRVREICDRHGVLLILDEVMCGMGRTGHLFACAEDGVAPDMITIAKGLGAGYQPIGALLVQGRIYDAIAAGSGFFQHGHTYMGHAMAAAAANAVLDEIEGRDLLQAVRRQGARLEALLQERLGQHPHVGDIRGRGLFRGIELVADRETKEPFDPARKLHARIKAEAFAGGLICYPMGGTLDGVRGDHILLAPPFIISDAELDELVDKLSGALDRALAA

SEQ ID NO: 38919 - protein, 197 aa, Synechococcus sp. CC9605
MLLVIDNYDSFTFNLVQYFGELAAQHPLAADLQVHRNDAISLEQIRALKPDAILLSPGPGDPDQSGVCLDILKELSATVPTLGVCLGHQAIAQVYGGRVVRAQQQMHGKTSPVLHKGDGVFAGLPQPLTATRYHSLIAERDTLPDCLEVTAWLEDGTIMGLRHREHPHLQGVQFHPESVLTDQGHQLLANFLLEAEG

SEQ ID NO: 38920 - protein, 287 aa, Glycine max
MEGRDEDVRVGANRYGERQPIGTAAQTQDAKDYREAPPAPLFEPRELTSWSFYRAGIAEFVATFLFLYVTVLTVMGVAKSPSKCSTVGVQGIAWSFGGMIFALVYCTAGISGGHINPAVTFGLFLARKLSLTRTVFYMIMQCLGAICGAAVVKGFQSNQYERLGGGANTLNKGYSKGDGLGAEIVGTFILVYTVFSATDAKRNARDSHVPILAPLPIGFAVFLVHLATIPITGTGINPARSLGAALVYNKDQAWDNHWIFWVGPFIGAALAALYHQIVLRAIPFKSK

SEQ ID NO: 38921 - protein, 297 aa, Triticum turgidum subsp. dicoccon
GFLGLSGAILVQVQRTLHIDPGSFILMLAILPTAIALLLMYFVDVHSAHQWYNKKFLDAFSLMAVTVAGFLMVVIICDQVFMISSAGQSVCFAILLLLIMSPVTIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 38922 - protein, 303 aa, Triticum aestivum
  misc_feature (29)..(29): Xaa can be any naturally occurring amino acid
AAAVARAAPAITAFGNVDVVGRPAAGTPXGSSGLAATLRAAAALLRLDAEWDWFVTLSAADYPLLTQDDLVHVFSSVPRHLNFIDHTSDIGWKESQRVQPVIVDAGIYLAGRNQFFQSTEKRATPDGFKFFTGSPWVILNRRFIEYCIFGWENLPRTLLMYFTNVMLPLEGYFHSVACNSDFRNFTVNNDLRYVAWDDPPQMEPRFLNITHYEEIVESGVPFARKFREKEHLLDRIDEKILQRWRHRPVPGAWCTGRKRWFSDPCSQWSNVNIVRPGPQAEKFRRYMDRILEESKSSNSSCAQ

SEQ ID NO: 38923 - protein, 893 aa, Gibberella zeae PH-1
MPSDNYNFGDVFQKIYVAKQKPPPIPVHENMKVVLQSSPPLGQVTSVRGRNVALTTVLEIPKFRANESWEVSAWHSVDDAAWKDVPLSSVQEASAPQTLQAFDDSMSRFYFSTSVPFEASLKFTLKFRHSPDADWRWIRDEQGLNDGLIVNTPVGLLSNNLSDLIPNINSDWTIKSHISQSPGTSLWSLEAVIASANGDDSTYRDITIGTPFGTFARWFSLVRLWSPWLAPRHGKSHFSLDKDGVLCCFLSPQGKSLVFLAVSGIGHVLPVFRSESDGKIQVHARNDGLSDETAVILVSEGDDFDCVMASVMYHARNLVSVMKQAKKEWSHELSALVDDFKPEWLEHWFDGLGFCTWNALGQKLTDQKISDALDKLGEHNIKVSSLIIDDNWQSIDYQGPSQFQYGWKDFEAEPKAFPQGLKATVSHIRKNHPHIQHIAVWHALLGYWGGIAPDGKLAETYKTIEVTREDADRRNLPLGGKMTVIAQEDVSRFYNDFYKFLSDAGVDAVKTDAQFMIDTWVEASPRRDLINAYLEAWTISTLRHFSAKAISCMSQFPQALFHSQMPTNRPTILVRNSDDFFPEIPASHPWHVWTNAHNAIFMSYLNVLPDWDMFQTVHEYSGFHAAARCISGGPIYITDVPGEHDMDLIGQMTGLTPQGKTVIFRPSSLGKTVDPYIGYDDDLLLKVGGHHRASHTGYPILGVFNVSSRPLTEFVPLSSFPGVTPGYYVVRAHTTGKVSQPTTLEGSGSLFTTSLPVRGFEILSAFSLTPLSSVKHGDVFVANLGLLGKMAGVAAVIMNDIKQERHNSRVLIVTRIKAFGTLGIYISALPNLTIEGDFLITIQEKVIPVHTVAISTVDKHVLEIDIGKAWKDMGLESRWSNDVEARAVYRVSE

SEQ ID NO: 38924 - protein, 368 aa, Bartonella quintana str. Toulouse
MTYDQKKFVSALRAFERGEILVVTDDNDRENEGDLTVAAVHCTEEKMAFIIRHTTGIVCAPMLKEEAQRFNLTPMVSDNNSAHRTQFTVTIDFKHGTTTGISAHDRTLAVRNLANSNAGASDFVRPGHIFPLIAHEGGVLMRSGHTEAAVDLCKLANLPPVGVIGELVNDDGSVKHGDEVTKFAQDNRLHIIKVSDLIAYRQRKEMLIKHVGEMHIETPVGPAVFQSYQLPWETVQHVAIIFGDIRDGEDIPVRLHRENIMSDIFGQSSDIITIMRRMMEKEKRGVFVYLREGSVGVQSAVGSQALAMRGLENHVQAIERGEEWRQIGLGSQILKHLGISSVIVYAANERHYLGLEGFGIRVSRTDIL

SEQ ID NO: 38925 - protein, 327 aa, Synechococcus sp. CC9605
MKRLLLLATGGTIAGCAENSAMLNDYTAGVLGGDALLAAVPQLQDLATISVEQIANVDSADLLFVHWRALVGRIRDAFAADPELAGVVITHGTNTLEETAWLLQLLIDDPRPVVLVGAMRPATALSADGPLNLFQGVQVALSPEARGQGALVVMDGQIHAAERVTKLATQGVGAFASPLSGPLGWVDDVGVHLSTARGLRQVPFADLALPEQWPQVPIVYGCVEPEPLLLSACLKAGVAGLVFTGTGAGQLSVAERSALQAWPGKRPLMLRANRCGSGSVHCDSEDQRLGLLSAGSLNPQKARVVLLMALLAGWDRDQLDALITASP

SEQ ID NO: 38926 - protein, 485 aa, Ginkgo biloba
MASIFVPVCVSVAVITITCLKKFNGWRYECGLSSKKPLPPGDMGWPLLGNMLSFLIAFKFNRPNSFVSAFVSRFGRTGLYKPFMFGSPTILATTPETCKQVLMDDAHFVPGWPVSTVQLMGRKSFVALSHEDHDRLRKLTAPSINGHEALSNYLGWIEQRVVSAYEDWANQDRIVLLNELKKVTFDIISYIFLSYESKTGTKLASLEREYTSLNMGIRAMAINLPGTAYHKALKARKNLVAILQSVTEERRSSPDPQAKSNKDVLNALLHVKDENGSLLTDEEIIDLLVMYLNAGHESSAHITMWAIIFLVSHPRLYAEAKAEQEKIVNKRPDGQTHLIMYEIREMNYLRKIIDESLRMVNISLMVFREAMDDVEINGYTIPKGWKTQVWLRSVHMDPQVYPNPTKFDPDRWDKLIPKSGMFIPFGAGSRLCPGSDLAKMEICVFIHHLLFHYKIERLNPDCPVRYLPHPRPTDYCKGRVRKLST

SEQ ID NO: 38927 - protein, 297 aa, Triticum turgidum subsp. dicoccon
GFLGLSGAILVQVQRTLHIDPGSFILMLAILPTAIALLLMYFVDVHSAHQRYNKKFLDAFSLMAVTVAGFLMVVIICDQVFMISSAGQSVCFAILLLLIMSPVTIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 38928 - protein, 334 aa, Dehalococcoides ethenogenes 195
MVTRIGINGFGRIGRITLRTINQYHRGELEVVAVNDLADNKSNAHLLKWDSTYGKYPGTVESDDCSIIVDGKPIKVFSERDPMQIPWETAGVDLVIESTGLFTDAAKASSHLRGSVKTVVISAPAKGEDITVVMGVNEEKYNCNTHRVISNASCTTNCVAPLIKVLHDKFGVKKGFMTTCHAYTNDQKIQDMFHKDIRRARAAAVNVIPTTTGAAKAVALVLPELKGKLDGISFRIPSASVSLVDFVGELARNVTVEEVNAAFKEAAQGKLAGILEYCEEELVSSDFKGNPASSIIDAPSTMVLDGNMVKVLSWYDNEWGYSTRLGDLIAYISK

SEQ ID NO: 38929 - protein, 586 aa, Ginkgo biloba
MITVRSIPCSFSKDTVQFIGFRKVLTVRNVVSCGVSSSFRLPGSKFFPRCESSSTERATKSNRTLLDNASNFLTNLLSGGQLGTMPIAEGAVSDLFGKPLFFSLYDWFIEHGSVYKLAFGPKSFVVVSDPIVVRHILRENAFAYDKGVLADILEPIMGKGLIPADLGTWKPRRKAIVPGFHAAFLEAMVKVFGDCSERTINKLQSLLLAAEADKTMHIDVDMEAEFSNLALDIIGLSVFNYDFGSVTRESPVIKAVYGTLFEAEHRSTFYIPYWKFPLARWLVPRQRKFHEDLKIINECLDSLIQGAKETRQEDDIEALQGRDYSKVKDASLLRFLVDMKGVDVDNGQLRDDLMTMLIAGHETTAAVLTWALFLLAQNTDKLVKAQAEIDTILDQRKPTFEDIKRLQYIRLIIAEALRLYPQPPLLIRRALRQDTIPGGYRGDKDGYLIPKGTDIFISVYNLHRSPYFWDQPHEFRPERFLIPKDNKGIEGWAGFDPYRSQGALYPNEVLADFAFLPFGGGPRKCVGDQFALMESTVGLAMLLQKFEVELKDPPESLRIVTGATIHTQNGLWCKIKRRKHYSESLQ

SEQ ID NO: 38930 - protein, 640 aa, Bartonella quintana str. Toulouse
MSRTLTPLLDRICLPQDLRALPESDLVRLADELRTETIDAVSVTGGHLGAGLGVVELTVALHYVFNTPEDRIIWDVGHQTYPHKILTGRRDRIRTLRQEGGLSGFTKRSESVYDPFGAGHSSTSISAGLGMTVASALKAEKRRNIIAVIGDGAMSAGMAYEAMNNAGALDARLIVILNDNDMSIAPPTGAMSAHLARLVSRPAYRSLRERIKMFSKKMPKFFLDKARRSEEFARGFLVGGTLFDELGFYYVGPIDGHNLKHLLPVLKNVREYPNGPVLVHVVTHKGKGYAPAEASSDKYHGVNSFDVVTGKQIKTQSNALAYTKVFSKALIEEATHDNKIVGITAAMPTGTGLDAFAEKFPERMFDVGIAEQHAVTFAAGMACEGYKPFVAIYSTFLQRAYDQVIHDVSIQKLPVRFAIDRAGFVGADGATHAGSFDIVFLATLPEFVVMAPSDEVELMHMVRTAAAYDQGPISFRYPRGEGVGMDLPQRGELLEIGKGRVLREGSRVALVCFGTRMSEVLVAADALIAEGLSTTVADARFAKPLDKDLMRRLACEHEVLVAVEEGAIGGFGAHLLQFLAKEGLLEHGLKVRTLKFPDEYLNHGSPEKVLSRIGLDAVGIVNTVFTALGREIRTVQKVRV

SEQ ID NO: 38931 - protein, 485 aa, Barbacenia elegans
GVSTLEKKNYGRIAQIIGPVLDVAFPPGKMPNIYNALVVKGRDTAGQPINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLNMEMKESGVINEKNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESN

SEQ ID NO: 38932 - protein, 130 aa, Glycine max
  misc_feature (51)..(51): Xaa can be any naturally occurring amino acid
  misc_feature (120)..(120): Xaa can be any naturally occurring amino acid
MGIFLAQNKKRHSGPVLTGTVPHPDEKDQSLNSTFASRYVREPLSHFIMPXNSIPTDSSFHIINDDLMLDGAPKLNSASIVTTWIDPAYHKLIMSSLNKNYGNIDKYPVTTVLQNLYLNXLSNLFHAPIS

SEQ ID NO: 38933 - protein, 386 aa, Bacillus subtilis subsp. subtilis str. 168
MTSYLSDYVQQIKPSGIRKFFDLAATMEGVISLGVGEPDFVTAWNVREASILSLEQGYTSYTANAGLYSLREEISRYLSNRFDLSYSPDNELIVTVGASQALDIAIRAIVNPGEEVIIPEPCFVAYDALVSLAGGIPVHVHTTADKGFKATAADFEAAVTEKTKAILICSPSNPTGSVYSKEELNEIAEFAKKHDVIVLADEIYAELTYDEEFTSIAALPGMKERTVVISGFSKAFAMTGWRLGFAAAPSLLRDAMLKIHQYAMMCAPAMAQFAALEGLKNGMEDVEKMKKSYRRRRNLFVESLNEIGLSCHHPGGAFYAFPSIKSMGMSSEQFAEELLTQEKVAVVPGSVFGPSGEGYIRCSYATSIEQLQEALVRMKRFLHKTT

SEQ ID NO: 38934 - protein, 415 aa, Ashbya gossypii ATCC 10895
MGLCASKDKGSATHAEKRRQDRHGASQKVETGAKRVDYGAEVKPETSPSHSTSGATAGGRKRSVVSGTSQQTTAVAGPGSMGQPSASNRALKVLLLGSGESGKSTVLQQLKILHQNGFTQEELLDFKPFIIDNIVETGKDLLNARAKFNVLLEPDCGLTENDLQQVLEYSRPAGSTPLLPRGLAGILSRIWQLPSTKELLTGPERSSFYLMDNAGYFFKSLDRISQPDYVPTVADVLRTRKKTSGIFDTTIEMDADLKLHIYDVGGQRSERKKWIRCFDNVTLIIFCVSLSEYDQTLIEDKTQNRLQESLILFDSVVNSRWFTRTSVVLFLNKIDAFAEKLQTVPLEKYFPDYTGGQDINRAAKYILWRFVQLNRANLNIYPHVTQATDTSNIRLVFAAIKETILENTLRDSGVL

SEQ ID NO: 38935 - protein, 469 aa, Candidatus Protochlamydia amoebophila UWE25
MLYSKERTCMNLLIIGVGYVGLVTATCFSEMGYYVTCLDINKEKIEQLKLGMIPIYEPGLDEMVKRNIKSKRLTFTTNYSSSVPLANICFIAVDTPTTPQGGADTSQVECVAKTLGEFINHYCIIVTKSTVPVGTTHRVSAIIQNALENRNCHVEFDVVSNPEFLKEGNAVQDFMKPDRIIVGSDHARSAKIMRELYSPFMLNHERLLEMDILSAELAKYAANAMLATRISFMNEMARLCENVGANIGWVRKAMGADDRIGHKFLYPGAGYGGSCLPKDVKALITQAKELGHPLSLLTAVDEINQHQKHIIGQKVKNYFADHGGLKGKTFGILGLSFKPDTDDMREASSLTLIKDLIAEEALLKVYDPVAIPKAQQILSAHTCITWCQTELEVADQADGLILMTEWKQFRFLDFPLLLKRMKGKAFFDGRNQYHPEEMARKGFDYFSIGRSAAYAEDLSLQVGNIGGDV

SEQ ID NO: 38936 - protein, 239 aa, Oryza sativa Japonica Group
MAGSGDELMLLGKWPSPFVTRVELALGLKGLSYEYVKQDLVNKSELLLASNPVHKKIPVLIHNGKPVCESSIIVQYIDEAFPDAGAGAALLPADPYERAVARFWVAYVDDKFVPAWVATFRGKTEEEKAEGMKQLLAAVETLEGALKDCSKGKPFFGGDTVGIVDVALGGLISWVKATEVLAGSKIFDEEKAPLLAAWAQRFGELDVAEKVLPDVDGVVEFAKMRLAEAAAAAAAASKN

SEQ ID NO: 38937 - protein, 502 aa, Oryza sativa Indica Group
MARGRGRWLLPTRLLNVCLAALCRGGSLAAAESVLVDAIRLGLPPDVVTYNTLLAAHCRAAGLEAGLAVMGRMREAGVEPDAVTYNSLIAGAARRGLPIHALDLFDEMLRAGIAPDSWSYNPLMHCLFRSGHPEDAYRVFADMAEKGIAPCDTTYNTLLDGMFRAGYAMNAYRMFRYLQRAGLPVSIVTYNTMINGLCSSGKVGYARMVLRELGRTDHAPNIITYTAVMKCCFKYGRFEQGLDTFLSLLDRGYISDVYPYCTVISALVKKGRLGEANNYCDLMLQNGSRLDSVCYNTLIHMRCQEGKLDDAFELVSMMEDGGLESDEYTFAILVNGLCKMGHIEAAEKQLFYMEIKGMQSNVVAYNCLVDALCKFQEVDAAIRLLQCMKLKDDFTYTSLVHGLCRVGRYHMASKFLRICLREGNNVLASAKRAVIAGLRSSGFKNDLRKVRSVKPKRNKIKHHGKLQTSPLVGERYRLSMCTKPPLTGVCLALDFVGKIDWV

SEQ ID NO: 38938 - protein, 617 aa, Beta vulgaris
MTTAEALLSGSALWNPTFQSDIFLKPKLTHSGVFSCTKRLKGLRGKRNKWEIDCRRKIYPVPPCRTRVKRPGCLSSDGLNGPLFSGESEKLNPSSADVNAKPHVSELIASEKLAAAAAKSEKALRVKADSLEDEAWELLNESIVNYCGSPVGTIAANDPTSTSILNYDQVFIRDFVPSAIAFLLKDDYDIVRNFLLNTLQLQSWEKTMDCHSPGQGLMPASFKVRTVPLDGDDSATEEVLDPDFGEAAIGRVAPVDSGLWWIILLRAYGKCSGDLSLQERVDVQTGMKMILKLCLADGFDMFPTLLVTDGSCMIDRRMGIHGHPLEIQALFHSALRCAREMLTPEDGSADLIRALNSRLLALSFHIREYYWLDMRKLNEIYRYKTEEYSFDAVNKFNIYPDQIPPWLVDWMPEKGGYLIGNLQPAHMDFRFFSLGNFWSIVSSLATSGQSHAILDLFEAKWVDLVADMPIKICYPALEDQEWRIVTGGDPKNTPWSYHNAGSWPTLLWQLTVACIKMNRPEIAEKAVKVAERRISKDRWPEYYDTKGARFIGKQSHLFQTWSIAGYLVAKLLLANPEKAKILINEEDSELVNAFSSLIPRGRKRSRKGVGAKQSYII

SEQ ID NO: 38939 - protein, 316 aa, Propionibacterium acnes KPA171202
MTYDISTIGEGQIRLTCYKGERLINAQQLRATAACSEANVSGLLSQLGRSTCWASVMPKGDLTDRVVNEFRSVGVDVSHICMKPEGRVALYFMEPGEYPMPARVLYDREHTPFRDVTVEDLDWEALLDTRLVFVTGITAALTENTAAVVRHFVDEAHRRGIAVALDVNYRSLLWGPEHAREVLEPIARMSNIVFCSVRDGKAVFGIESDGEQACRELRELFGVPTVVSTDQINGVYFSDAERGDCTFPVVQVPVIDRPGAGDSFVAGTLHGYLGGDVVQGIHYGQRTSAYALTHYGDLTRVSPSELNIPPNTDILR

SEQ ID NO: 38940 - protein, 233 aa, Oryza sativa Japonica Group
MAGGGDELKLLGMWASPFALRAKLALSFKGLSYEYVEEDLKNKSELLLTSNPVHKKVPVLIHNGKPVCESQVIVQYIDEAFPDAGVPLLPSDPYDRAVARFWAAYIDDKLLKSWLQASMCKTEQEKAAAMKETFAAVANLEAAFKECSKGKPFFGGDAVGYVDVTLGAVIGFVRVGEAVHGMRLFDASRSPLLDAWLDRFAALDAAKAVLPDTGRLAEYAKMKQAEWAAAATN

SEQ ID NO: 38941 - protein, 136 aa, Zea mays
MANSAAPGGVRSFLQAVSTVTEETRTPLRVVQMEGLAVLKIIKHCEEFAPALVTGQLLGLDVGSVLEVTNCFPFPMREEDDEADADGANYQLEMMRCLREVNVDNNTIGWYQSCLLGSFQTVELIETFMNYQVRGR

SEQ ID NO: 38942 - protein, 231 aa, Oryza sativa Japonica Group
MAGEGDDQLKLLGLWVSPYTHRVKLALSFKGLSYEYVEEDLSNKSELLLSTNPVHKKVPVLIHNGKPICESQVIVQYLDEEFPNSGVSLLPSDSYDRAIARFWAAYINDKLMPSWLQSSMGKTEEERAEALKQTLEAVANLETAFKECSKGKPFFGGDTVGYLDVSLGAMIGWMRAGEALHGRRTFDATRSPLLNAWMERFAALDAAKAAMPDNNKLVEFVRVRRAAAANN

SEQ ID NO: 38943 - protein, 458 aa, Xanthomonas axonopodis pv. citri str. 306
MNEFSALPLSPALAPGIDALGYTVLTPIQAHSLPPILQGLDVIAQAPTGSGKTAAFGLGLLQKLDPALTRAQALVLCPTRELADQVGKQLRKLATGIPNMKLVVLTGGMPLGPQLASLEAHDPQVVVGTPGRIQELARKRALHLGGVRTLVLDEADRMLDMGFEEPIREIASRCDKHRQSLLFSATFPDSIRTLARELLKEPVEITVEGADSAPEIDQQFFEVDPTYRQKAVAGLLLRFNPESSVVFCNTRKEVDEVAGSLQEFGFSALALHGDMEQRDRDEVLVRFVNRSCNVLVASDVAARGLDVEDLSAVVNYELPTDTETYRHRIGRTARAGKHGLALSLVAPRETARAQALETEQGQPLKWSRAPLATARPAQLPQAAMTTLRIDGGKTDKLRAGDILGALTGEAGLSGAAIGKIAIYPTRSYVAIARAQVAKALAHLHAGKIKGRRFRVSKL

SEQ ID NO: 38944 - protein, 186 aa, Xanthomonas axonopodis pv. citri str. 306
MTDCSRCAGTNTSGPNHWPERIRDIVDFPKPGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEVVGAAVLVELQGLQGRQKWANDVPLLATLSY

SEQ ID NO: 38945 - protein, 518 aa, Xanthomonas axonopodis pv. citri str. 306
MTHLRFDNRLRQQLPGDPEEGSRRREVSVAWSAVLPTPVAAPSLIAHSAEMAQVLGLDAAEIASAQFAQVFGGNALYPGMQPWAVNYGGHQFGHWAGQLGDGRAISLGEAIGTDGGRYELQLKGAGPTPYSRGADGRAVLRSSIREFLCSEAMHHLGVPTTRALSLVGTGDAVVRDMFYDGHPQREPGAIVCRVAPSFIRFGNFELPSARGDIALLRQWVDFTIARDFPALAGAGEALYAGWFAQVCERTAVMVAHWMRVGFVHGVMNTDNMSILGLTIDYGPYGWVDDYDPDWTPNTTDAQGRRYRFGTQPQVAYWNLGRLAQALAPLFPDQAPLQHGLDRFRDTYLACDRHDTAAKLGLAECRDEDLQLIDALRALMRESEMDMTLTFRGLIDLSPDHPDPAQLREAFYDEDKRVADAPQLQQWLQRYAARLQQDPLPPDARRARMRLANPRYVLRNYLAQQAIDRAEQGDPSGVQELLEVMRHPYDDQPGRDAFAARRPEWARDRAGCSMLSCSS

SEQ ID NO: 38946 - protein, 568 aa, Propionibacterium acnes KPA171202
MSVPFQYAHDDDGGLLRIAARGQEVLTNPLANRGTAFTIEQRKALGLTGLLPSGVMTITDQLKRVYAQYSAQPDDLAKYLYLNHMHDRNEVLYFRLLAEHIEEMLPIVYTPTIGKAIEEYSHWYDRPRGIYLSIDDPEDMEQALAQLGHGPDDVDLIVATDAEGILGIGDQGVGGVAITVGKLAVYTAAAGIHPHRVLPVILDVGTDNMERLNDDGYLGVRHPRVRGERYDEFVQQYVETAHRMFPHALLHWEDFAAGNATRILNKYRDDYCTFNDDIQGTAAVVVAAVLSAVKSSGIPLNDHRIVIHGAGSAGTGIANLLVQLMVSQGADEKTARSHFWGLGSHGLLREGLRLRDFQQPFARNKEELEGWTLDSPDQYTLGDVVRNVHPTILIGCSAQPGAFTEDIVKTMAAQCERPVIMPLSNPTRKAEALPSDVLTWTDGRALVATGSPFKPVMINGVTYQIAQANNALVFPGIGLGTIAVRASRVTSGMIAAAAEAVAMHIDNRVVGASLLPSIKSLRPLSASVAIAVAQQAMEEGVATEVTDNPVEKVFSAMWQPRYPRIAVV

SEQ ID NO: 38947 - protein, 171 aa, Cochliobolus lunatus
MSNPRVFFDISIAGQPAGRVVMELFADKVPKTAENFRALCTGEKGTGKSGKPLHYEGSTFHRVIPQFMLQGGDFTRGNGTGGESIYGEKFEDENFALKHTGPGVLSMANAGPNTNGSQFFICTVKTSWLDGKHVVFGQVVEGMDVVQAVEKVGSQSGQTSKPVKIEKSGQL

SEQ ID NO: 38948 - protein, 256 aa, Gibberella zeae PH-1
MSSSQPQTNGVPASSAGTSQTVPNTQTTATSSSQPAVTASQNAPPPSAQSTSAPRPRDSRLIELLLTSQGVTAYEPRVPLLLLDFAYRHTSSVLSDALHLSGDPYVTQAGSKPSANAGAISAPAGDAAVTANAVKLAIAARLSYQLRGGNAGGGISKEYMQELARERNKVALPKIVPSEWGVRLPSERFVLSGTSWGLKDVWDEDDEEDDEMDQGGDAMEGIEGPEPEDVGGDGVEGGTVEDMFGEDVDEEMAEEG

SEQ ID NO: 38949 - protein, 475 aa, Yarrowia lipolytica CLIB122
MSFTEEETKLGKSLFEACSFTERPIAKDSHLETVRQVMRKNIPATITTSDLGLFTDEEEATKKKEIIQGDITIDGTTPLHVICSSFPSDATAEELEVALEMMRELFQWGAGWMLLDEQGQTPGCVAWDRSKAEARDSVLASVYNEIVSAGTRSEVFLRRINKSENVEFLSDDDDEEMDVDDDEEDESRDGEETGDIQQAIADAIKQAKEAGLEVVVDGETVEEVPELVGDKEDEKNNESAAQNEVDLAGSQMDYLKDKLTYTDDNKTLITTQNDGVMMDWEDEIMQKSADLLVSRADKESDGPVVLNVGFGLGIIDTYLQSKKPSKHYICEAHPDVLEKMEKDGWMDKPGVTVLVGRWQDTLPGLLSQGVYFDGMYYDTFSENYSDLVDFFDHVVGLLAPTGVFSFFNGLGADRQVCYDVYKNVVEVDLQEYGLNVEYQVIKVNKDVTGADGHVWDGIKRRYWVVEDFYLPVCTF

SEQ ID NO: 38950 - protein, 136 aa, Zea mays
  misc_feature (114)..(114): Xaa can be any naturally occurring amino acid
SRNRRPQNEDFSPSQLSKMFGSHATMMANSPRTPIIVFTQTGSMAVLLSHYRPSSTLFAFTNEERVKQRLALYQGVIPIHMQFSDDAEETFSRAISSLLKAQYVKKGDYVTLVXSGVTSIWREESTHHIQVRRAQV

SEQ ID NO: 38951 - protein, 114 aa, Brassica napus
  misc_feature (11)..(11): Xaa can be any naturally occurring amino acid
PEQLQKENVSXENLIPHKTFSGNRPSLSLLLPELSAYNVGQLLAIYEHRVAVQGFVWGINSFDQWGVELGKVLATQVRKQLHSSRTQGAAPEGFNYSTTTLLKRYLETSPEPKM

SEQ ID NO: 38952 - protein, 767 aa, Yarrowia lipolytica CLIB122
MYSDDVASVTSSDNEQVENDSIRRALRRSALLRSASSRHGSSAVNRSGASSPTSSSSNSIQSAETDSDIDMDEVAEADGVEPDKDAPVHQLPSELLTVIFTMLPERRDVHSCLLVSKTWFMSCVDLVWFRPHLPKDLTRLQQLLRTLKQPVSSQTVPYSTYIRRLNLTNLTGEMTDELLSGVAVCTRLERLTLANCTALSDASLVPVLQQNSGLQSVDVTNVSHITDATIKALLPSKRRLQGLYATGCANITNAAIVALATECRLLKRIKVNSCPNVEDEAAMALVDNCPQLVELDLHENSALSGSVATEALRKLPNLRELRVGQVTGVNDACFLGFPARPQFDRLRIIDLTACNAITDAAVDRLVTCAPKLRHVVLAKCTRVTDRSIRSLLRLGKSLHYLHLGHCASITDAGIAQLVRACQRIQYIDVANCSQLTDAAVEDLASLTKLRRIGLVKCVNITDAAIYALASRSGFEASLERVHLSYCAGISIPAVLRLVNVCPRLSHLSLTGVTAFLRSDFRQFCREPPPEFTQHHQALFCVFSGDGVKRLRTHLNQLAEADMGYLLGGGGFAGGLGPGIGGGLGGGVGTATLEELIAAQRRVRHIVNEVFPDGRPHGGLDGLGMDGIDPLAQLEHVHHIERVMARLEMERQEGLEQRHQQEQRQLREGFRQADQRQLREGFGQPEIQQPGPPTALPVLPEGGVPVVAQPVAGIPPAAARGLERQTQQYNEALQQLQMLEGRPEVDQQLVAELRRQVEQHGREMGQGE

SEQ ID NO: 38953 - protein, 401 aa, Synechococcus sp. CC9605
MAKRSLASLNAGDLSGKRVLVRVDFNVPLNDTGAITDDTRIRAALPTINDLIGKGAKVILSAHFGRPKGQVNDAMRLTPVAARLSELLGKPVAKTDSCIGPDAEAKVGAMANGDVVLLENVRFFAEEEKNEAGFAEKLAGLAEVYVNDAFGAAHRAHASTEGVTKFLKPSVAGFLMEKELQYLQGAVDEPKRPLAAIVGGSKVSSKIGVLDTLIDKCDKVLIGGGMIFTFYKARGLSVGKSLVEEDKLELAKELEAKAKANGVQLLLPTDVVLADNFAPDANSQTADINAIPDGWMGLDIGPDSIKVFQEALADCQTVIWNGPMGVFEFDKFATGTNSIATTLADLSGKGCCTIIGGGDSVAAVEKAGLAEKMSHISTGGGASLELLEGKVLPGVAALDAA

SEQ ID NO: 38954 - protein, 97 aa, Triticum aestivum
  misc_feature (53)..(53): Xaa can be any naturally occurring amino acid
  misc_feature (65)..(65): Xaa can be any naturally occurring amino acid
  misc_feature (79)..(79): Xaa can be any naturally occurring amino acid
  misc_feature (90)..(90): Xaa can be any naturally occurring amino acid
VSGVQIAISASNTGGAWDNAKKYIEAGASEHAKSLGPKGSDCHKAAVIGDTIXGDPLKDTSGPSXLNILIKLMAVRSLXCFAPSFATYGXSSFNYLL

SEQ ID NO: 38955 - protein, 295 aa, Microcystis aeruginosa PCC 7806
MNNNIQENDAQRVKILSEALPYIQEFRGRTVVVKYGGAAMNNSDIKDTVMRDIVFLSCVGVRPVIVHGGGPEINSWLDKLGIEPQFKDGLRVTDAATMDVVEMVLVGRVNKEIVALINQAGGKAVGLCGKDGNLITARPVGKEGIGFVGEVSSVDTSVVESLVNSGYIPVISSVAADETGQAHNINADTVAGEIAAALGAAKLILMTDTAGILENYQDPSTLLAKLDIQQARELIQKGIVAGGMIPKVGCCVRSLAQGVQAAHIIDGRLPHALLLEIFTDRGIGSMIVASGYTNL

SEQ ID NO: 38956 - protein, 209 aa, Brassica napus
LVDKTSLQGLTAIPSFDPNSSLELDDSGNFAAAVDNPSEFSVLYRLQDVVAKLDMETRTCIRDSLFRLADSAGQRHHTSDTPHSNKSSQDDREVIPQEKSRYRYAGMLDTETVTNPTDRTVAHLLFHRPFDMYAAKHTEGLESPSSSKMGAEVKGSFPSTRESRMIKQKAKEEDVPAGSLALGYASNSGSSSTVAERVVEASQGNKRKL

SEQ ID NO: 38957 - protein, 230 aa, Polaromonas sp. JS666
MHELTIPKNYPVSKNQAAASPSALSSLAPEGASGADGRRIQTRRSGVHGKGVFALQDLAEGETLIEYVGEVVTWKEALRRHPHDPKDPNHTFYFHIDEKHVIDAKYGGNSSRWINHSCKPNCEADEDEGRVFIKALRNIKAGEELFYDYGLIIDAKYTKKLKAEYPCWCGAKNCRGTLLAPKDKDNGKNAAKDKPKAKDKASDRADGKAKAKTKLDSKKSQAKKNKKKKD

SEQ ID NO: 38958 - protein, 764 aa, Methanosarcina acetivorans C2A
MTEEDKSTIKLKVAEADQRDVGKGIVRIDERFREKLGLKPFDVVEIKGGKSTSALIGRPYPSDAGLDIIRMDGLIRTNAKTSIGEYVDIRKADWKEAKSVTFAPVAQGMQIYAPSETLKAVFMNRTVSKGDFISTTSLRRSRERETFGKGVMFEDFFQDFFGQGFGPSFGLGEIKLQVVSTAPAGIVKITDMTQVELLPEAMEIISEQNIPTVMYEDLGGLKDAISKVREMIELPLKHPELFDRLGIDAPKGVLLQGPPGTGKTMLAKAVANESDAYFISINGPEIMSKYYGESERAIREIFEDAEKNAPAIIFLDEIDSIAPKRAEVTGEVERRVVAQLLSLMDGLKARKNVIVIGATNRPEALDIALRRPGRFDREIELRVPDTEGRLEIFQIHTRGMPLADNVNLMDFAQITYGFVGADIAALCREAAMSALRRILPKINLNEPEISKEILDALQVTREDFENALKDVQPSAIREILIEVPNVSWEDVGGLERVKELLKEVVEWPLKNPESYRDIGVEAPKGVLLYGPPGTGKTLLAKAIAHESDANFITAKGSDLLSKWYGESEKRIAEVFTRARQVAPSIIFLDELDSLAPIRGTSVGEPQVTARILNQLLSEMDGLEELRAVVVIGATNRPDIIDPALLRPGRFDELILVPVPDEGARREIFRVHTKNMALAEDVDIEKLVSFTDQYTGADIAAVCKKAGRHALREDLHAKKVRQKHFLQAIEETGPSVTPDTMKYYEAIKGELRKRKSKEIENPYYV

SEQ ID NO: 38959 - protein, 322 aa, Prochlorococcus marinus str. NATL2A
MPIANDITYLVGQTPLVKLNRLPNEFDCRAEIIAKLESFNPTASVKDRIAGAMVMSAEKEGTIKPGHTVLVEPTSGNTGIALAMVAAAKGYRLILTMPDTMSTERRSMLRAFGAELQLTPGQEGIQGAIQLAKELVASIPNAYLLQQFDNLSNPEIHEKTTAEEIWEDCEGKLDALIAGVGTGGTITGCARFLKQKNPKIKVFAVEPSSSPVLSGGNPGSHAIQGIGAGFIPNVLDMNQIDEVIRINDNEAMDIGRRLAKEEGLLSGVSSGAAVAAALKVGNQPEFANKRLIVILPSFGERYLSTTMFTSIPAKPVKGNEYL

SEQ ID NO: 38960 - protein, 294 aa, Candidatus Protochlamydia amoebophila UWE25
MMDVANYLQTQSQLIEKRLDQLVSKRHGPHQNLIEAARYALLSGGKRLRPILALTTVQTLHGDIQEALSPACTLELIHTYSLIHDDLPCMDNDDYRRGKLTVHRQYSEGHAVLTGDFLLTYAFELLATDKYLTSEKKVKLITILSRQSGYDGMIGGQALDLASEGQKINLETLRLLHRNKTAALITASVEFGGILANATEEQLAHIREFGENIGLAFQITDDILDITSSEAKHGRKIGSDILKDKSTYVSLLGIEQAKAYALNFYQKAINALKLLPYDNSFLIHLADFIIHRHY

SEQ ID NO: 38961 - protein, 556 aa, Microcystis aeruginosa PCC 7806
MTVTSIAFDSIDTALAEIKAGRAIVVVDDENRENEGDLICAAQFATPDLINFMAVQARGLICLAMTGERLDALELPLMVTKNTDSNQTAFTVSIDAAPHLGVKTGISAEDRAKTVQVAINPVTRPDDLTRPGHVFPIRAKAGGVLKRAGHTEAAVDLARLAGLYPAGVICEIQNPDGSMARLPQLFEYARQHNLKLISIADLIGYRLKHDRFVHRETVCNFPSQFGTFQLYAYRNLLDQTEHIAIVKGDPALFDDQPVMVRMHSECLTGDALGSLRCDCRQQLQSALKMIENNGLGVVVYLRQEGRGIGLINKLKAYSLQDIGLDTVEANERLGFPADLRDYGMGAQMLNDLGVRNIRLITNNPRKIAGLKGYGLEIVERVPLLIEANDYNSNYLATKAEKLGHLFLQTYLVTIALSWEENPPSISQRYHQLEKLRQLSRANQLSLQEETRPVANALFDRAPLIVHLGLDIRQGVSSNWYKNPSHPYLLVIDKILNDVKDWSEIERLEFLISDGDDSMTGLQMKLDRQKMSDEDFSQLPQLATQIIYSFTRDSAKN

SEQ ID NO: 38962 - protein, 391 aa, Methanosarcina acetivorans C2A
MKKCGDNKMDLEDTLLMMPGPVPVTPRVLRAMSKPMINHRSAEFAGIYTDCRQILADVFQTKNDIFLLSGSGTAGMEAAVGSVAGSGDKVIAIENGKFGQRFKDLAALYADVVPLEFEWGLPVDLEMVKEKLEEGAKAITLVHNETSAGIMNPAVEIGKLAKKHDAIFIMDGVTSLGGDEVKVDEWGVDIAIVGSQKCLAAPPGMSAVSVSEKAFEAINSMKKRPYYNDLKAYKKSGDKPRPETPYTPALPLFYAMQEALHIVKEEGMEVRIKRHRALSEAVRAAAGAMNIEMFPQLNEYSKYSNTVTAMKAPAGVDGEDVKNDMKKRGVIIAGGQEHLKGKIFRIGNMGNVTARDVLSTIQQLEIVLSKQGYIDSVGAGAEAAMRVIDRV

SEQ ID NO: 38963 - protein, 327 aa, Synechocystis sp. PCC 6803
MQSFNRINSMKYFPLSNGEQIPALGLGTWKSSPQVVGQAVEQALDLGYRHLDCAAIYGNEAEIGATLANAFTKGVVKREELWITSKLWSNAHHPDAVLPALEKTLQDLGLDYLDLYLIHWPVVIQPDVGFPESGDQLLPFTPASLEGTWQALEKAVDLGLCHHIGVSNFSLKKLEMVLSMARIPPAVNQVELHPYLQQSDLLTFANSQNILLTAYSPLGSGDRPAAFQQAAEPKLLTDPVINGIAAEQGCSAAQVLLAWAIQRGTVTIPKSVNPERLEQNLRAADITLTDSEMAKIALLDRHYRYVSGDFWTMPGSPYTLQNLWDEI

SEQ ID NO: 38964 - protein, 249 aa, Bacillus clausii KSM-K16
MNLGLTGKRVFVTGGTKGIGKAIANAFAAEGAKVAVCARVTEGIEGLLAGIQTISGDVTKAAERERMFAEASAAIGPIDILVNNAGGSNGGAISETAMDVFYEAFELNYFSAVHFSKLALPAMKSAGRGTIINISSIFGRESGGKATYNSAKAALISFTKALADETAKQGIRVNSIAPGSILHPTGNWQKRLDADPEGITEFVNRDIPAGRFGTPEEVADVVVFLGSDKASWVTGATLVVDGGQSKSNI

SEQ ID NO: 38965 - protein, 306 aa, Escherichia coli CFT073
MDIAVIGSNMVDLITYTNQMPKEGETLEAPAFKIGCGGKGANQAVAAAKLNSKVLMLTKVGDDIFADNTIRNLESWGINTTYVEKVPCTSSGVAPIFVNANSSNSILIIKGANKFLSPEDIDRAAEDLKKCKLIVLQLEVQLETVYHAIEFGKKNGIEVLLNPAPALRELDMSYACKCDFFIPNETELEILTGMSVDTYDHIRLAARSLVDKGLNNIIVTMSEKGALWMTRDQEVHVPAFKVNAVDTSGAGDAFIGCFSHYYVQSGDVEAALKKAALFAAFSVTGKGTQSSYPSIEQFNEFLTLNE

SEQ ID NO: 38966 - protein, 266 aa, Synechococcus elongatus PCC 6301
MGKLDNQIALVTGSSQGIGQEIAIRLASEGASVVIDYRSHPEGAEETRKQVEAAGAQCHLAKDHAPEGYVVQADLGDVTQVRNLVAESIKHFGKLDILVNNAGMERRAPFWEVTEADYDMVLNVNLKGAFFAAQALVQHLLETKRPGKIINISSVHEELPFPNFASYCLSKGGIKMMTRDLAVELGEYGITINNVAPGAIETPINTNLLNNPTELNALLGNIPLKRLGKPKDIASLVLFLASPDADYITGTTIFADGGLLWNYHEQ

SEQ ID NO: 38967 - protein, 695 aa, Pseudomonas putida KT2440
MQTFFIAPTDFGVGLTSISLGLVRTLERAGLKVGFFKPIAQPHPGDTGPERSTELVARTHGIKPPVPLSLAHVERMLGDGQLDELLEEIIRLYQQACVGNDVVVVEGMVPTRHASYAARVNLHLAKSLDAEVILVSAPENEVLSELSGRVELQAQLFGGPRDPKVLGVILNKVRTDESMADFATRLREHSPLLRGNDFRLLGCIPYQPELNAPRTRDVAELLGAQVLNAGDYEQRRMSKIIICARTVANTVPLLTSGTLVVTPGDRDDIILAVSLAAINGVPLAGLLLTSDSKPDVRILGLCRGALQAGLPILSVSTGSYDTANQLNSLNREIPVDDRERAEFITDFVASHLDAAWLHQRCGTPRELRLSPAVFRYQLIQRAQQANKRIVLPEGAEPLLVQAAAICQARGIARCVLLAKPEDVDAVARAQGITLPPGLEILDPELIRGRYVEPMVELRKSKNLNAPMAEQQLEDPVVIGTMMLALDEVDGLVSGLVHSTANTIRPALQLIKTAPGSSLVSSVFFMLFPEQVLVYGDCVMNPHPSAAELAEIAQQSAASAQAFGIAPRVAMISYSSDSASDEEVEKVREATRLAQDAAQELLIDGPLQYDAAANPAIARELAPASPVAGRATVFVFPDLNTGNTTHKAVQRSADGVSLGPMLQGLRKPVNDLPRGAQVDDIVHTIALTAIQASVAR

SEQ ID NO: 38968 - protein, 220 aa, Leuconostoc mesenteroides subsp. mesenteroides ATCC 8293
MAAKLVLVRHGESTANRDNEFTGWTDVPLTLKGVRQANRVGEVLKRHGLQFDVSFTSFLKRAIITDNIILEEIEQLWLPLHKAWQLNERHYGALRGLNKDYARQQYGANKVALWRRSYTATPPLLEHVIPDRRYPEDLEPRGESLKMASDRLVPYWHSEILPQIQQDKNVLIVAHGSSLRALVKYIEHISDEDIDGLEIDNGEPILYEYEEGFSERIYLE

SEQ ID NO: 38969 - protein, 283 aa, Ashbya gossypii ATCC 10895
MGYTLTILGCGVMGQAVLSAIYNAPKADDESRAMYPSRIITCNNNAQSAKQVTELVRGFGTSPNGIEVESTSGDNAKAVAEARVVVLGTKPYLVEEVLQDVRTQVADKLLISLAAGWTLDQLVDYTARVARVMTNTPAKYGYGAAAVSHSPDVTADERALVSRLVGHLGLCVELPEKNMDAATALIGSGPAFALLMLESMMEAGVKLGIPLDVSRRCAAKVLEGTARMAEETGSHPAALKHQVCTPGGTTIAGLCVMEDSGVRSGIVKGIEEAANVAARLGRK

SEQ ID NO: 38970 - protein, 361 aa, Oryza sativa Japonica Group
MGPATPLRRRTRARPAATRAEGGSGGDGDDDDVRCEACGSGESAAELLLCDGCDRGLHIFCLRPILPRVPAGDWFCPSCASPSPHSKKSHAAKKPKQFPLVQTKIVDFFKIQRGPAAALAAAAESSEGKKRKRKVGGIRLVSKKKRKLLPFNPSDDPARRLRQMASLATALTATGAVFSNELTYVPGMAPRAANRAALESGGMQVLPKEDVETLNLCKRMMARGEWPPLLVVYDPVEGFTVEADRFIKDLTIITEYVGDVDYLTRREHDDGDSMMTLLSAATPSRSLVICPDKRSNIARFINGINNHTPDGRKKQNLKCVRFDVGGECRVLLVANRDISKGERLYYDYNGSEHEYPTHHFV

SEQ ID NO: 38971 - protein, 304 aa, Leuconostoc mesenteroides subsp. mesenteroides ATCC 8293
MIDLKSFQKEWLPKINQQLENDLSMASPDADLVAMMKYAVLNGGKRLRPLLTLAVVTSFGESITPSILKVATAIEWVHSYSLVHDDLPAMDNDMFRRGKPSVHALYGEANAILVGDALLTGAFGVIATANSSCSVEDCLPTEELLLITQNLAREAGGSGMVLGQLHDMDNHTEEQNASTNWLLNDVYSMKTAALIRYTTTLGAILTHQNVNVEDNHFDPKKAMYDFGEKFGLAFQIQDDLDDYQQDQLEDVNSLPHIVGVKEAQSVLDQYLFSTQEILANTVEQDQQFDRRLLDDFVSLIGDKK

SEQ ID NO: 38972 - protein, 407 aa, Wolinella succinogenes DSM 1740
MFDEIQFDKIKRLPKYVFAAINEIKLEMRRNNEDVIDFSMGNPDGITPAHIIDKLCEAAQKPKNHGYSASRGIYKLRLAICNWYKRKYNVDLDPELEACAVMGSKEGYVHLVQAIANFGDSAVVAEPVYPIHYYAFIIVGANVTKFGLKWNDRFELDEDDYFENLKRSLRETMPKPKFVVVNFPHNPTTVVVKKSFYERLVALAREERFYIISDIAYADLTFDGYSTPSILEVEGAKEVAVESYTLSKSYNMAGWRVGFVVGNPKLVGALQKIKSWIDYGMYAPIQVAATIALDGPQECVEEIKGKYEKRMDVLIKSFSEAGWEMDKPQASMFIWAKLPECAQGLGSLEFSKRLLREAKVAVSPGVGFGEHGEGYVRIALIENEKRIRQAARNIKQFLKTLQNTKEA

SEQ ID NO: 38973 - protein, 237 aa, Oryza sativa Japonica Group
EGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMEWSYKGKPFFGGDAVGFLDVALGGLLSWLHGTEELCGAKILDAAKTPLLSAWARRFGEMDAAKVALPDVCKLVEFAKMKRVQLEAAMAATTVSRN

SEQ ID NO: 38974 - protein, 106 aa, Wolinella succinogenes DSM 1740
MGKYIELNASNFDEVTKKGVSLVDFWAPWCGPCRMVAPVIEELAADFEGKANVCKVNTDEEQELAVKYGIRSIPTILFFKDGEIVDQMIGASSKQAFKEKLDSLIG

SEQ ID NO: 38975 - protein, 417 aa, Vibrio angustum S14
MDSKVVVPVEGQKITLDSDGKLVVPNNPVIPYIEGDGIGVDVSPAMIKVVDAAVKKAYAGDRKIEWMEIYTGEKSTQVYGEDAWLPQETLDFIREYKVAIKGPLTTPVGGGIRSLNVALRQELDLYICARPVRYFDGVPSPLKQPELTDMVIYRENSEDIYAGVEFQAGTAEADKVIKFLQEEMGATKIRFPQQCGVGIKPVSEEGTKRLVRAAIQYTIDNDRDSLTLVHKGNIMKFTEGAFKDWGYEVALQEFGAELLDGGPWMTLKNPNTGKEIVVKDCIADAFLQQILLRPAEYDVIATMNLNGDYVSDALAAQVGGIGIAPGANIGDGIALFEATHGTAPKYAGQDKVNPGSLILSAEMMLRHLGWVEAADLIISSMEAAISNKTVTYDFERLMDGATLRKCSEFADDMIEQM

SEQ ID NO: 38976 - protein, 178 aa, Triticum aestivum
VSPIEQFVQKSRLVPVRNSRDIVDPRVRRGLGAGKAADLTYWESAARMIADVSKSDKIVVEKSTVPVKTAEAIEKILTHNSKGINYQILSNPEFLAEVTAIEDLSKPDRVLISGPLYPRGPDCPITPLFAPLLPTCLTLNPVPPPLRPPALPRTTLYYPFLLPSPSPSSTPIASLPSP

SEQ ID NO: 38977 - protein, 358 aa, Thermoanaerobacter tengcongensis MB4
MITKEQILSALKKVYDPELRRNVVDLGMVKNIEIEGDKVTVDINLTVKGCPLRDQIKNNAIKEISKIEGVSEVVVNIGAMTEEERQDLARRLKEEKKNLFENTRVIVVGSGKGGVGKSTVAVNLAVALSRLGFEVGLLDADILGSSVPRLLGIVGEKPYALDEHTVLPIERFGLKIISMGNFVDEDTPLIWRGPLLTGVIDQFFNEVLWGDLDYLVLDLPPGTGDIPLTVMQRLPEAKFILVTTPQASASHVAGRIGHMAKKVNVEVIGIVENMSYFECPKCGERYNIFGEGETEKLAEALQTEILARIPIVVKIRELSDEGIPPALDDTEEGAIYVELAEKIVEKVRPLRHEKEPLK

SEQ ID NO: 38978 - protein, 264 aa, Zea mays
  misc_feature (34)..(34): Xaa can be any naturally occurring amino acid
  misc_feature (49)..(49): Xaa can be any naturally occurring amino acid
RGSEAPGSKCTRDMEATSFARRSVAAPRPPHAKXRRRHPLRLRRGTGPXHCSPLRAVVDAAPIQTTKKRVFHFGKGKSESAILGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNT

SEQ ID NO: 38979 - protein, 289 aa, Mycoplasma gallisepticum R
MYLTTKKIKVMKYNLLANNYKMPSIGFGTYKLEDGKQTVEAVKTALEVGYRHLDCAEIYENQLSVSQGIKLSGVNRKEIFITSKIWNDDKGYESTKKAFHKILKDLDLEYLDLLLIHWPIGKGFKDNWQEVNAQTWKAMEEFYLEGKIKAIGLSNFLVHHIEALKKSAKILPMVNQLEFHPGYLQPEIVEYCQKNNIVVQAWSPFSQSKVLENKTLVQLAKKYEVTVAQLILNWIIQKDIVPLPKSKTPERIRSNFDVFNFGINQADLKVIDQLNDCGGLGLHPDQVDF

SEQ ID NO: 38980 - protein, 380 aa, Methanosarcina acetivorans C2A
MTSARLKRVEESATIRISNIATRMIKEGTDVINFSLGEPDFDTPKNICDAAAKAMYEGKTHYAPSAGIPELRAAIAEKLKTENHLEVTEKDVLVTPGAKQAIFEIMMGALDDGDRALLFDPAWVTYDACIRFSGANTVWVPTVPERGFLPDNFAEYINDKTKLIVVNSPGNPTGGVFGKKTLQCIADLAIDHDLLVVSDEIYEKIIYDREHISIGSFDGMQDRTITVNGFSKAYAMTGWRLGYLTAPPEIFKLLQKIQSHSVSSATTFVQYGGLEALQGPQDGVKAMVDRFKMRRDILIDGLNKIGIECKKPDGAFYAFANVSEYGNGTEVAERLLKEAHVAVTPGIAFGASGEDFIRISYATSIDRIREALERLEKIFA

SEQ ID NO: 38981 - protein, 758 aa, Dehalococcoides ethenogenes 195
MQKGHEAIVWFNEVTKNDIPLVGGKGANLGEMTGAGIPVPPGYIVTANAYFDFINSSNLRPSISKALESLDINDSKQLAVVANSVKEMIMATPLPTELASQIKAAYEKMGQGLVAVRSSATAEDLPEASFAGQQSTYLNIEGGDEVVEAVQKCWASLFEARAIYYRVQQNFDHLQVGIAVPVQKMVQSQASGVCFTIEPITSDPTKIVIEAIYGLGEGLVSGEITPDLYIIDKEGPAVLSRTISHQERRLVRKNGNSASGPEDESGNNYWQPVPSTKQEQQKITEDDIITLAKLAMLIEKHYNGPQDIEWAKEENTIYIVQSRPVTALKDASELEPEIEAPIMLQGAAASPGLATGEVKVLQDPSEIDLVLQGDILVAEMTTPDFVPAMKRAAAIVTNRGGRTSHAAIVSRELGIPCVVGTGEATRLLKNEQIITVDGTHGKVYNGKVTRNVKTSNIASIVREAIRTKTRVYVNLAQPELADKVAARNVDGVGLLRAEFIFSQIGKHPRYMIEMGQQEEYIQQVYEGVLSFAKAFHPRPVVYRTNDFKTNEYRDLLGGDKYEGQEENPMLGYRGVSRYIKDIEVFKMEIEAIKRVRKDYPNVYVMLPFVRTVDELKKVKQILEDEGLKRGPDFKLWMMVEVPSNIFLIDKFIDAGIDGISIGSNDLTQLILGVDRDSEMLRETFDERNEAVLVALEKAVTTAARRGITASICGQAPSVYPELTEKLVSWGITSVSVSPDMIGTTREIIAKAEAKLKIK

SEQ ID NO: 38982 - protein, 163 aa, Triticum aestivum
  misc_feature (2)..(2): Xaa can be any naturally occurring amino acid
  misc_feature (8)..(8): Xaa can be any naturally occurring amino acid
  misc_feature (10)..(10): Xaa can be any naturally occurring amino acid
  misc_feature (23)..(23): Xaa can be any naturally occurring amino acid
  misc_feature (28)..(28): Xaa can be any naturally occurring amino acid
  misc_feature (37)..(37): Xaa can be any naturally occurring amino acid
  misc_feature (49)..(49): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (63)..(63): Xaa can be any naturally occurring amino acid
  misc_feature (71)..(71): Xaa can be any naturally occurring amino acid
  misc_feature (87)..(87): Xaa can be any naturally occurring amino acid
  misc_feature (92)..(92): Xaa can be any naturally occurring amino acid
  misc_feature (110)..(110): Xaa can be any naturally occurring amino acid
  misc_feature (114)..(114): Xaa can be any naturally occurring amino acid
  misc_feature (117)..(117): Xaa can be any naturally occurring amino acid
  misc_feature (132)..(132): Xaa can be any naturally occurring amino acid
  misc_feature (134)..(134): Xaa can be any naturally occurring amino acid
  misc_feature (139)..(139): Xaa can be any naturally occurring amino acid
  misc_feature (146)..(146): Xaa can be any naturally occurring amino acid
MXPTVMAXSXTSVAPFQGLKSTXGLPVXRRSNGASLXSVSNGGRIRCMXVWXIXGIKXFETLXYLPPLSTXALLKQVDYLIRSKWVXCLEFXKVGFIFREHNASPGYYDXRYWXMWXLPMFGCTDATQVINXVXEVTKXYPDSYVXIIGFDNIRQVQLRQASP

SEQ ID NO: 38983 - protein, 553 aa, Oryza sativa Japonica Group
MATPEDTGSWLLYLSLAAKCSGDGDGQPHRLLGFVVVCAVAGLVTCLLHWSFPGGPAWGRWWWTRRRRRGSPCGVAAVPGLRGLPVIGSMWLMTGLAHRKLAAAAEAAGAGRLMALSLGETRVVVAAHPGRGEGDPARRGVRRPPREGVRVRAAVPPRHRVRAPRRVLARAAAGGVTHLFSPWQVAASAPQRAVIARQMVRAIKLQQRSRSGDSAAGAAVEVRRVLRRASLHNVMWSVFGRRYELQLDPGKESDEVRELRALVDEGYDLLGQLNWSDHLPWLARFDLQSTRARCSRLVPRVNRFVTRIIDEHRSSAPVAAAIDFTDVLLSLQGSDKLADSDMVAVLWEMVFRGTDTVAVLIEWVLARLVLQQDVQARVHDELGRVVGLDRDVTESDTASLVYLHAVIKETLRLHPPGPLLSWARLATSDVHVDGYLIPAGTTAMVNMWAIAHDPDVWAEPMEFRPERFIGKAAEFSVMGSDLRLAPFGSGRRSCPGKSLAMATVAFWLATLLHEFALLPSPDPAHGVDLSEVLRLSCEMATPLAVTAWPRRVV

SEQ ID NO: 38984 - protein, 140 aa, Candidatus Protochlamydia amoebophila UWE25
MLKLRILSVGKTKEKWLEDAFNEYQKRLKANLQIECLWAKDSYQLLEWTQKESLIICLDPTGRLLTSEAFATFFSKCWEQGGSRLTIVIGGAEGLPLELKQHSILISLSLLTFTHQITRLILIEQIYRATEILKNSQYHK

SEQ ID NO: 38985 - protein, 343 aa, Lactobacillus sakei subsp. sakei 23K
MKRDFIDTKDYTQAEIQYLIDLGLQIKKDIKAGDYPQLLSNRTLGMLFEESSTRTRVSFETAMTQLGGHAQYLAPGQIHLGSAESESLGDTAIVLSRLVDILMARVATHDTIETIANAATVPVLNGMTDYNHPTQEIGDIITMAEHLPAGKKLSDCKVVFVGDATQVCVSLMFVATKMGMQFVQYGPKGYQIKPETLAIGQKNAEVSGGSVLITEDTDQAMRDADFVYTDVWYGLYESPLSYDERMAIFYPKYQVNDELMAKAAKHAKFMHCLPANRGEEVTDSVLDSDASVAWDEAENRLTAMRALLVYLMAPIIDYSDDTLNNLKDPALKDLLNNRIDSTK

SEQ ID NO: 38986 - protein, 580 aa, Ustilago maydis 521
MSPSVSSPQLRHTKSNRAISRIDRTDPLALALQPPANEAPADKYARLHQEKLAKQRSDEIDKFLKQHQEDRATHGLASSPSTSVDGANFKKGRVYKMVLLGQAGAGKTTVLKQMRLLYDPPAHERERRGWTKIVLLNLTSSVRVLLETLSLYHDQRLERKSSELSRLESSTSASTSTSASASSPKHVDTESQPNDATRLELAKQLGTTKKINTSSLPWLTHIPSVVQLERALRTELGAFGEEAVLSASSDEAAITNQKVRTRLDAQGSSSIRGEKSPLVLRPGWQERLFTYARRSLSLTQNGRAAAARRETDGGDSQSESEKDNSETLKLLRAIRPEVLALWNDDAGCRALRKRGLFLDGQSDAATSYFLDNYSRITDAAYRPTDEDILHSRVRTLGVTEDVFRVDRSLIYRIYDVGGSRSQRAAWAPFLDDIESIIFLAPLSAFDQPLVEDCSTNRLADTFTLFNQIVTNPLLEHATMILFLNKIDLLEKKLRQGVQLHKYWPEYVGDNDFEAVWRWFRAKFRDALRRAEDEVNLDQTSRRRLYVHTTVATSTVQIRAILMSVKDSILRENLKLTGLVG

SEQ ID NO: 38987 - protein, 245 aa, Oryza sativa Japonica Group
MVKICCIGAGYVGGPTMAVIALKCPAIEVVVVDISKPRIDAWNSEQLPIYEPGLDEVVKECRGRNLFFSTDVEKHVAEADIIFVSVNTPTKTRGLGAGKAADLTYWESAARMIADVSKSDKIAQISIYDPQVTEDQIQRDLAMGKFDWDHPMHLQPTSPTAFKQVSVVWDAYEATKNAHGLCILTEWDEFKTLDYQKIYDNMQKPAFVFDGRNVVDPEKLREIGFIVYSIGKPLDAWLKDMPAVA

SEQ ID NO: 38988 - protein, 375 aa, Lactobacillus sakei subsp. sakei 23K
MIRNRKEVSTMKTLQTSPKKDGYRMPGEFEAHKDVYLLWPERPDNWREGAKPAQATFAKVAETIAQFESVTVGVSDRQYTNARHMLADNIQVVEMSNNDSWIRDCGPTFVVNDKGDSRGVDWTFNAWGGLVDGLYFPWDKDDRVAQKVCEIEGRDRYRLDDLVLEGGSTHVDGEGTLLVTEECLLSDGRNPQLSKEQIESILKEYLNVEKIIWLKKGIYLDETNGHVDNIANFVKPGQVVLAWTDDQSDPQYAISKENYDMLINETDAKGRKLQVEKLYLPKPILITEAESQGVDTVDGTLPRLAGDRLAASYVNYYTANGGIVFPLFNDPMDEKAQEILQKLYPDRKIVGVPAREILLGGGNIHCITQQIPAGR

SEQ ID NO: 38989 - protein, 116 aa, Glycine max
MGIPSELRDMLLPNKKGVLVASPAEDRKTLRSKQCTREGVRAGFKAASIAGVASAVPTLAAVRMIPWAKANLNYTAQALIISAASIASYFITADKTILECARKNAKLEDALRHNQQ

SEQ ID NO: 38990 - protein, 538 aa, Hordeum vulgare
MAFEVVAAQLARLSDALATSDHASVVSINLFVALLCACIVLGHLLEENRWLNESITALIIGLCTGVVILMTTKGKSSHVLVFSEDLFFIYLLPPIIFNAGFQVRKKQFFRNFMTITSFGAVGTMISFFTISLAAIAIFSKMNIGTLDVSDFLAIGAIFSATDSVCTLQVLNQDETPFLYSLVFGEGVVNDATSVVLFNALQNFDPNQIDAIVILKFLGNFCYLSVSSTFLGVFSGLLSAYIIKKLYIGRHSTDREVVLMMLMAYLSYMLAELLDLSGILTVFFCGIVMSHYTWHNVTESSRVTTKHAFATLSFIVETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGDPSEPSSPKSLHSPLLTSMLGSDMEAPLPIVRPSSLRMLITKPTHTIHYYWRKFDDALMRPMFGGRGFVPYSPGSPTDPNVIVA

SEQ ID NO: 38991 - protein, 367 aa, Lactobacillus sakei subsp. sakei 23K
MKIVGTTPKEDQYYLPAETKRHRESIMMWPERSDNWRNGAKPAQKTFAEIAAIINRYEPVTMLVSKEQYQNARHALPAEIRVIEMSYNDAWIKDIGPTYLLNQKNQIRAVDWRFNAWGGLVDGLYFPWDMDDQVAQKLCELTGIDYYHLEKFILEGCAFHTDGEGTLIVTEESILSEGRNGMLTKTEVEAVLKAYLGIEKVIWLKLGYFMDETNGDVDNMLSFVRPGELLLTWTDDQSDPQYASSEEAYRILEAATDTKGRHFKIHKLQMPKPMFATQEESAGVDPINGLLPRYPGDRLTASYVNYYALNDAIILPIFDDPQDTVAIQTLTQLFPDRKIEPVYARELLLGGGDVHCVVAAVPAHTEA

SEQ ID NO: 38992 - protein, 234 aa, Oryza sativa Japonica Group
MAGGGDELKLLATWFSPFASRVKFVFHLKGLSYENIEEDLKNKSELLLKSNPVIKKVPVLLHNGKPLCESMVIVEYLDETFAAVGPSVVPADPYERAVARFWVSYIDNKLVAPWFQVFRGKTKEEKAEGLKQMFEATAVMEVAFRECSKGRPFFGGDAVGIVDVALGSQLGWLRASETLSGIKLFDPAKTPLLLAWAERFLALDAAKASMPESGRLLAYAKMRQAETDAANASK

SEQ ID NO: 38993 - protein, 950 aa, Pseudomonas putida KT2440
MLELANEQIAMGQKAADKAEALRLLADRLVADGLVAEGYLQGLQAREAQGSTFLGQGIAIPHGTPQTRDLVYATGVRLLQFPEGVDWGDGQMVYLAIGIAARSDEHLRLLQLLTRALGETDLAEALRRASSAEALLKLLQGAPQALALDAQLVGLNVPAEDFDELAWRGARLLQRADCVDSGFAAVLQQAEPLPLGEGLWWLHSERQVRQPGLAFITPQQPLRYRDQPLNGLFCLASLGAAHEALLERLCEVLIEGRGQVLYQATSSRAVLEVLGGEVPADWPSARVVLANPHGLHARPAKVLAQLAKGFEGEIRVRLVDSAQPAVSVKSLSKLLSLGARRGQALELVAEPSIAADALPVLLAAIEQGLGEEVEPLPQSVAPIADDVPEVLQAPAAGSRIQGVGAAPGIASGPAHVCVEREFDYPLRGESCALERQKLREALATVNGELQALVLRSDKAIGEIFVTHQEMLADPALTDDVEQRLAQGESAAAAWMAVIEAAARQQEALHDALLAERAADLRDIGRRVLAQLCGVQAQVEPEQPYVLVMTEVGPSDVARLDPNRVAGIVTAQGGATAHSAIVARALGIPAVVGAGASILLLESGTPLLLDGQRGVVSVAPPADELQRALAERDLREQRLQAAWANRFEPAITRDGHAVEVFANIGDSNGIAKVVEQGAEGVGLLRTELIFMAHPQAPDVATQEAEYRRVLDGLDGRPLVVRTLDVGGDKPLPYWPIAAEENPFLGVRGVRLTLQRPQVMEDQLRALLRAADQRPLRIMFPMVGQVHEWREARAMVERLRAEIPVADLQLGIMVEVPSAALLAAQLAREVDFFSIGTNDLTQYTLAIDRGHPSLSAQADGLHPAVLSLIDMTVRAAHAHGKWVGVCGELAADPQAVAVLLGLDVDELSVSARSIAEVKALVRQADHQTARALAREALQQDSAAAVRALVERY

SEQ ID NO: 38994 - protein, 112 aa, Cochliobolus lunatus
MSEETKQGVHNLANKAQFEAAINDKETLMVLDCFATWCGPCKVIAPQVVKLSEKYPNARFFKLDVDDVPDVAQELGIRAMPTFLLFKGGDKISEVVGANPKALEAAIQSNYE

SEQ ID NO: 38995 - protein, 241 aa, Oryza sativa Japonica Group
MAGKDDDVKVLGLVMSPFAIRVCIALKLKGVSYEYIEEDLANKSELLLSSNPVHKKIPVLIHGGKPVSESLVIVQYVDEAWAPSPTSPSILPADPYDRAVARFWAAYVDDKMVPGMVGVLRAATEEERAAKADETLAAMAQLEKAFAEVAAKNGKPFFGGDTVGYVDLALGCNLHFLEAIRRLHGVALVDAGKTPLLAAWAERFVEVEAAKGVVPDADDAVEFARKVQARVAAAAASTAAK

SEQ ID NO: 38996 - protein, 501 aa, Cryptococcus neoformans var. neoformans B-3501A
MLATMNPIRPLFRSTPLRLCHNSLSSRIPRRTLVTPTNLVHATVSNVTVDHVKEDPAEHQSGEQIAGEHPSGKEMFGFKLNPVATKTGGSAKSGGRPIYLDMQATTPMDPRVLDKMLPLFTEQYGNPHSRTHAYGWEAEKAVDEARQQVAQLVGAQPKDIVFTSGATESNNMLIKGIAKFHQSKKKHIITTQTEHKCVLDSCRWLSTQGFEVTYLPVLPNGLVSINELKAALRPDTSLVSIMAVNNEIGVIQPLAEISQAIKSWAKENGVTKPLFHTDAAQAVGKIPIDVEALGIDAMSISGHKLYGPKGVGAAYVRRRPRVRLEPLIHGGGQERGLRSGTVAAPLVVGLGEACRIAENEMAADHARIKALSDRLIEGITSKVEHIVRNGDVNGYPGCVNLSFSYVEGESLLMALKDIALSSGSACTSASLEPSYVLRALGAAEDMAHSSLRFGIGRFTTEEEIDLVVQRIVSVVNKLRDMSPLWEMVQEGIDISKIEWNQ

SEQ ID NO: 38997 - protein, 430 aa, Synechococcus sp. CC9605
MIDSLDLVIDTIVAREVLDSRGNPTVEAEVLLEGGAMGRAIVPSGASTGAHEAHELRDGGDRYMGKGVGQAVNHIEERIATALCGLSALDQAAVDAAMLELDGSDNKSNLGANAILAVSMATARAAANGLGIPLYRYLGGPMANLLPVPLMNVINGGAHAANSLDFQEFMLVPHGAPSFREALRMGTEVFHTLKKLLSDKGMSTAVGDEGGFAPDLGNVEAGEILVEAISKAGYKPGEQISLALDVASTEFFENGRYAFDGGSYTSAEMVGQLEQLVEKFPIVSIEDGLAEDDWDGWKLLTERLGGKVQLVGDDLFVTNTKRLQQGIDSATANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 38998 - protein, 388 aa, Salmonella typhimurium LT2
MKITISGTGYVGLSNGLLIAQHHDVVALDIVPSRVELLNDRISPIVDKEIQQFLKEDNIRFRATLDKFDAYQNADYVIIATPTDYDPKTNYFNTSSVESVMQDVISINPAAVMIIKSTVPVGFTAAMRQKFATENIIFSPEFLREGKALYDNLYPSRIVIGEQSERAREFAALLQEGAIKQEIPTLFTDSTEAEAIKLFANTYLAMRVAYFNELDSYAETLGLNTRQIIEGVCLDPRIGNHYNNPSFGYGGYCLPKDTKQLLANYQSVPNNIISAIVEANRTRKDFIADAILARKPKVVGIYRLIMKSGSDNFRASSIQGIMKRIKAKGVEVIIYEPVMEEDTFFNSRLERDLHCFKQQADVIISNRMAAELLDVAEKVYTRDLFGSD

SEQ ID NO: 38999 - protein, 468 aa, Salmonella typhimurium LT2
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 39000 - protein, 236 aa, Triticum aestivum
MRAVLIDWLVEVTEEYRLVPETLYLTVSYIDRYLSSKEINRDKLQLLGIACLLIAAKYEEICPPQVEELCYITDNTYIKDEVLRMEASILGCLMFEMTAPTEKCFLRRFLHAAQLCHEGPALHLEFLASYITELSLLEYSLLCHVPSLIAASSIFLANFILKPTKNPWNTTLSYHTQYKPSTLRDCVKVLHRLFRVGLGSNLPAIREKYSQHKYKFVAKKYCRPSIPADFFQDASS

SEQ ID NO: 39001 - protein, 492 aa, Synechococcus elongatus PCC 6301
MPSTNPFLTLPYEPAFASLGSEFSDPVEAATFPAHQLRFRNDRLLPILGLDPATVADEHFIEAFGRFQGRSPLLAMRYHGYQFGIYSPDLGDGRGFLYGQVRGRNGWLYDFGTKGSGRTPYSRGGDGKPTLKGGVREVLASEFLQRLGVRTGRCLSLIETGEELWRGDEPSPTRSSVMVRFNRTHIRFGTFERLHYFKRADLVRQLLDHVIATYYSHLLGDPEADAKFYAELTERTADLAAQWMAAGFCHAVLNTDNLSIVGESFDYGPWAFLDRFDPKFTAAYFDHSGRYRYENQPGICQLNLELLQVPLGMVMSAADLEAGIAGFGDRYQATYSRLMLRRLGFEADQLHSAIADDLIITTLQLLLRAPIGYNEFFARLRAQFQPSWRSDLSAILPDWITTDLEALPEAQWQGWRDRYHQLLTHLPESQLPLIQQQLAQANPEISPIRPVVESVWDPIAIDDNWEPLEALLNRWRHDGDGAADGAVVPNAN

SEQ ID NO: 39002 - protein, 214 aa, Mycoplasma gallisepticum R
MKNVQPMIIAIAGGSGSGKTTITQSIIAKIKSDTNLKVATVCLDNYYKPFSDLNLEARKKLNYDDPNSFDFDQVYYDLLALSNNQTIKMPIYDYKNYTRSDQFTEIDPSDVILYEGILSLYDSRILDLSKFKLFIDTPSDERLARRIERDCLERARDIKQVLNQWRSQVRVMHRKYVQKQKEGANLILPWYTLNHEGMSIIQNAIIKIAQGNEF

SEQ ID NO: 39003 - protein, 479 aa, Salmonella typhimurium LT2
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTAGDYFKSGKYYWNSGMFLFRASSYLNELKYLSPEIYKACEKAVGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFRPWGKYNVIDSGKNYLVRCITVKPGEKFVAQMHHHRAEHWIVLSGTARVTKGEQTYMVSENESTFIPPNTIHALENPGMTPLKLIEIQSGTYLGEDDIIRLEQRSGFSKEWTNERS

SEQ ID NO: 39004 - protein, 405 aa, Coxiella burnetii
MAIEIKVPTLPESVSDATVAKWYKKEGDSISRDENLVDLETDKVMLEVPAPKDGVVEQIVAKEGEVVKADQILALLKEGGAVAKEKAKKDEKETKKEKEKKEEKKDKEKKEKTEEKESDLSPAVRRMVSEKDVDVEEIEGSGKGGRITKKDVEDYLEKQKEKPSEGKEGPADERTEKRVPLSRIRQRVAERLVQVQQEAALLTTFNEINMQLVMELRKKYREEFEKKFKVRLGFMSFFTKAVVEALKRFPMVNASIDGSDIIYHNYYDIGIAIGTERGLIVPILRNAEKMNMADIEKQIREYASRAQEGRLNIEELTGGTFTITNGGTYGTLLSTPIINPPQTAILGMHKIMDRPTVENGEVVVRPIMQVALSYDHRVIDGREAVLFLVTIKELLEDPARMILEC

SEQ ID NO: 39005 - protein, 506 aa, Burkholderia pseudomallei K96243
MNHADMQHLNIEFPYRKQYGNFIGGEWVAPVGGEYFDNVSPVTGRPFTAIPRSREADIELALDAAHAAKAGWAAKGAAERANVLLRIADRMEANLTRLAVAETIDNGKPLRETTAADVPLAIDHFRYFAGCIRAQEGSIADIGGDMVAYHFHEPLGVVGQIIPWNFPLLMAAWKLAPALAAGNCVVLKPAEQTPASILVFAELIQDLLPPGVLNIVNGFGLEAGKPLASSKRIAKIAFTGETSTGRLIMQYASENLIPVTLELGGKSPNIFFADVMDRDDSYFDKALEGFAMFALNQGEVCTCPSRALVEESIYDRFIERALKRVEAIKQGHPLDSQTMIGAQASAEQLEKILSYIDIGRGEGAQCLTGGERNVLGGELAEGYYVKPTVFRGHNKMRIFQEEIFGPVLAVTTFKTEEEALEIANDTLYGLGAGVWTRDGNRAYRFGRGIQAGRVWTNCYHAYPAHAAFGGYKQSGIGRETHKMMLDHYQQTKNLLVSYSEKPLGFF

SEQ ID NO: 39006 - protein, 395 aa, Rickettsia conorii str. Malish 7
MRVKIIVPSLGESITEATIAKWYKKQGDSVKTDELLLEIETEKVTLEVNAPCNGTIGKISKTEGANVAVGEEIGEINEGASANTAGTNNESAKAQAVTQPTSEKPAVANNTLAPSVQKLVTENKLDPNNIKGTGRDGRITKGDVLATINTTTTSAPAISKSNEERVQRVRMSRLRKTIAQRLKDSQNTAAILTTFNEIDMSKVIALRNQYKEEFEKKHAVKLGFMSFFVKATIEALKLIPSVNAEIDGDDLVYKNYYDIGVAVGTEQGLVVPVVRDADKMGFAEVEKTIGILAKQAREGKLSMADLSGGTFSISNGGVYGSLLSTPIINPPQSGILGLHKTEERAVVIDGKIEIRPMMYIALSYDHRIIDGKEGVSFLVKIKQLIENPEKLLLNL

SEQ ID NO: 39007 - protein, 352 aa, Yarrowia lipolytica CLIB122
MQTLSEFADRHAFHSASDSVALYHSIPPHQRPAQATLKLRERALSADNEHEYADDMIAHMHMLEKAYSCDTDMMRQQPHVTFANRREALEDVVNSHRYFDLSSDTLFTAVALLDRYTSKCIIVDGYYPLVALAALWIAAKYVERKVAVPTLDQLHRLQPAYSKREYLQMEGYMLNVLEWSVSAPTADAFLDMFIGTTDPIFDDKFRTLRLFGLYLCECALFNEQLIDARKSSVAMAAQLLAMYYTHGIPDYPVSPRPDVNFIINQLETQAVPACIQSKYASTKFEFMRNAIGLRGGETPDPEDVMMTPPVTPERSKRYGFVGAQNQPQTQPQTQAIPKQPYDYGYNQGYYHS

SEQ ID NO: 39008 - protein, 570 aa, Kluyveromyces lactis NRRL Y-1140
MSLSDDEDFNDIYGDENTAQTTVNNNESTSSTATSTDNQNNTQSNNNQNNVSNSSTDDHKDQASTTNKEANSSSTNTTAATSQLDQLAALQALSSNLSQLQQQVASSNNQPDSNLASNNDKAENNNKENYSASVPEMLQMPQMPQMPGMPDMSQLQQLQQTMSQLQQTASQHEPKAIKADLSRDINKMFIGGLNWETTEEGLRDYFSKYGAVAEVKIMKDTATGRSRGFGFLTFENASSVDEVVKTQHILDGKVIDPKRAIPREEQDKTGKIFVGGIGPDVRPKEFEEFFSQWGSIIDAQLMLDKDTGRSRGFGFITYDTPDAVDRVCQNKFIEFKGKQIEIKRAEPRQLQKQKQPQMTQPMGQNMSNPMQQYQMFQNPMMAGGFNPMMATGFNPQSMNEYYTKMQEYYQQMQQQTGIDYTQMFQQQMQQMQQMMGMMGGLPAGQQPSQSGAGSPPSHSSTPQHNDDSNGVTTIGSSNNGNRSNSGVESGDDSRYDNSSSRDDSRRSGHRAYDRNSDRSSYGSSNRDRDSCRGPSSNYRGGGGRDRDSRRGGNGYGGGSRDRRGYHPYAR

SEQ ID NO: 39009 - protein, 482 aa, Saccharomyces cerevisiae
MLRNGVQRLYSNIARTDNFKLSSLANGLKVATSNTPGHFSALGLYIDAGSRFEGRNLKGCTHILDRLAFKSTEHVEGRAMAETLELLGGNYQCTSSRENLMYQASVFNQDVGKMLQLMSETVRFPKITEQELQEQKLSAEYEIDEVWMKPELVLPELLHTAAYSGETLGSPLICPRELIPSISKYYLLDYRNKFYTPENTVAAFVGVPHEKALELTEKYLGDWQSTHPPITKKVPQYTGGESCIPPAPVFGNLPELFHIQIGFEGLPIDHPDIYALATLQTLLGGGGSFSAGGPGKGMYSRLYTHVLNQYYFVENCVAFNHSYSDSGIFGISLSCIPQAAPQAVEVIAQQMYNTFANKDLRLTEDEVSRAKNQLKSSLLMNLESKLVELEDMGRQVLMHGRKIPVNEMISKIEDLKPDDISRVAEMIFTGNVNNAGNGKGRATVVMQGDRGSFGDVENVLKAYGLGNSSSSKNDSPKKKGWF

SEQ ID NO: 39010 - protein, 339 aa, Polaromonas sp. JS666
MTQGELQATMHALVQKGKGILAADESGPTIAKRFKTINVESTEENRRAWRSLLLTTPGLGEFVSGVILHEETLGQATDDGTPLPQCAARQGIVAGIKVDAGKIPLAGAPGDEITQGLDGLAGRLAAYQRQGARFAKWRAVYNVSDTLPSRLALEANAEALARYAAICQEQGIVPIVEPEVLIDGDHTMARCAEVTEAALHEVFHALHRHRVVLEHMLLKPSMVVPGKTHAHQAAPAEVAVQTVRILRRTVPAAVPSINFLSGGQTPEEATANLDAMNLLGPQPWQLSFSYGRALQEPALQAWKGQAAHARSSQDALLKRARLNGAACRGRYSAAMEAAD

SEQ ID NO: 39011 - protein, 490 aa, Coffea arabica
  misc_feature (1)..(1): Xaa can be any naturally occurring amino acid
XGSGVSTLEKKNMGRIVQIIGPVLDVAFPAGKMPNIYNALVVKGRDTVGQPINVTCEVQQLLGNNRVRAVAMSSTDGLTRGMEVIDTGAPLSVPVGGATLGRIFNVLGEPVDNLGAVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINKENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEMENNLK

SEQ ID NO: 39012 - protein, 262 aa, Zea mays
  misc_feature (80)..(80): Xaa can be any naturally occurring amino acid
MSSRSLPPKDRRMRTERTSYRDAPYRRDSRHGPSRFRNDLCNNCKRPGHFARECPSVAVCHTCGLPGHIAAECSSKGVCXWNCKEPGHMANSCPNEGICRNCGKSGHIARDCTAPPVPPGEVILCSNCYKPGHFREECTNEKACNNCRQSGHLARNCTNDPVCNLCNVAGHLARQCPKSDTLGERGGPPPFRGVGAPFHDVGAPFRGGFSDVVCRACNQIGHTSRDCMAGAFMICHNCGGRGHMAYECPSASLMDRFPPRRF

SEQ ID NO: 39013 - protein, 293 aa, Oryza sativa Indica Group
MSDPTAAVIPKPGGIGVGGGGSDDEEPVEIREVWADNLEEEFALIRDVVDEFPFVAMDTEFPGIVCRPVGAFRSPADYNYATLKANVDMLHLIQLGLTFSSPRGELPALGPGRRRCVWQFNFREFDDARDIFASDSIELLRRSGIDFRRNSERGVDARRFAELLMSSGVVLNDSVYWVTFHAGYDFGYLLKILTCSSLPDTQAGFFKLMKIYFPTVYDIKHLMKFCNSLHGGLNKLAELLDVERVGESHQAGSDSLVTSCAFWKLKDSFFAGSTEKYAGVLYGLNAENVVSAH

SEQ ID NO: 39014 - protein, 210 aa, Triticum aestivum
GINCCVLMGANIANEIAVEKFSEATIGYREDKEAANRWAKLFTTPYFLVAIVEDIEGVELCGTLKNVVAIAAGLVDGLDMGNNTKAAIMRIGLREMRAFSKLLFPSVRDNTFFESCGVADLITTCLGGRNRRVAEAFARNGGKRSFDELEAEMLHGQKLQGVSTAREVYEVLTYHGWQELFPLLSTVHEICIGQLPPTSIVEYRLAEGQS

SEQ ID NO: 39015 - protein, 159 aa, Lactobacillus sakei subsp. sakei 23K
MNIKIITVGKLKEKYLKAGIAEYAKRLSKFCKFEIIEVSDEKAPESLSEAEMTTVKDKEGERILAKVKDKEHVIVLAIHGKQRASEEFAKEIQDLATYGTSDITFIIGGSLGTSDAVNKRANDALSFGKLTLPHQLMRLVLTEQIYRAFMINQGSPYHK

SEQ ID NO: 39016 - protein, 403 aa, Oryza sativa Japonica Group
MVVGAGGGDELKLLGVWDSPYVNRVQIVLNLKGLSYEYVEEDLMNKSDLLLGSNPVHKKVPVLIHNGKPIAESRVIVEYLDEAFAAGAGGSTGASVLPSDPYERAVARFWAAYVDDKVGSPWYTILFARERGEKVEAAARAISALETVEAGAFRDRSSEGKTTNAAAAPFFGGDSIGFVDVVLGSYLGWFRVIEKMIGVRIMDAARTPRLAAWAERFEAADAVRGVLPDDVDKRGSGSERRRVAETGGASASAGERQLPARVEQRGGGRGGGGGGGAQRASSNGRDVDVKTALATPPCASAPLARVCHCEKERPLCSLSSRWPLASLLFSIGLVGRRAPRFPRPFASPVPGAALARRSRRSACSSHMPPRYRSPSAANTEMKRREKRKLKKIADPIVFLLTYI

SEQ ID NO: 39017 - protein, 235 aa, Prorocentrum minimum
MLEMYKIHMLGILIVVLFRTSAAGPSVVVALAGGSGAGKSYIGTYVKKVFGHANVSILSHDRYYKDQAHLHPEERARLNFDHPDMLESSLMLEHIQGLQRGETVDVPVYDFQTHSRLGYQQITPAPLVLVDGILVLAETVLSQAFDIRIYVDTPADIRLLRRIKRDLVERGRSVESVLQQYQDTVRPMHELFVESSKARADVIVSGTEGERFEPLVTLLAARTGLVRSSFVKDEL

SEQ ID NO: 39018 - protein, 277 aa, Zea mays
  misc_feature (38)..(38): Xaa can be any naturally occurring amino acid
RNSARGSAELSKLAANAFLAQRISSVNAISALCEATGXANVTEVAYAVGKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPTAVKQVSCVWDAYEATKGAHGLCILTEWDEFKTLDYQKIFDNMQKPAFVFDGRNIVDPEKLREIGFIVYSIGKPLDAWLKDMPAVA

SEQ ID NO: 39019 - protein, 198 aa, Glycine max
MGKAKKGPKFAVMKKIVTSKAIKSYKEEVLNPEKKNLMKEKLPRNVPTHSSALFFQYNTALGPPYRVLVDTNFINFSIQNKLDLEKGMMDCLYAKCTPCITDCVMAELEKLGQKYRGAPRIAKDPRFERILCTHKGTYADDCLVERVTQHKCYIVATCDRDLKRRIRKIPGVPIMYITKRKYSIERLPEATIGGAPRI

SEQ ID NO: 39020 - protein, 449 aa, Bacillus cereus ATCC 10987
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKEEIGEHPLVGDIRGKGLLVGIELVNDKETKEPIDNDKIASVVNACKEKGLIIGRNGMTTAGYNNVLTLAPPLVISSEEIAFVVGTLKTAMERI

SEQ ID NO: 39021 - protein, 386 aa, Coxiella burnetii
MNLHEYQSKHLLKKYNIPVPASEVVFNPDAAVDAAAKIGGDRWVVKAQVHAGGRGKAGGVRLVKNKEELKSAVKALLGTRLVTYQTDERGQPVNQILVEQTSDIARELYLGAVIDRASQRIVFMASTEGGVEIEKVAEKILKVTIDPAIGLQPFQCRQLFFGLGLQDLKQMRSFTDIVMGLYRLFTERDLSLLEINPLVITGSGELICLDAKINIDDSALYRQSELREMRDTTQEDEHETMAQQWELNYIKLDGNIGCMVNGAGLAMATMDLIKLSGGDPANFLDVGGTATKERVTEAFKIIVSDKNVKGILVNIFGGIVRCDLIADGIISAVKEVGIDVPVVVRLEGNNAQLGAKKLADSGMNIIAAKGFADAAEQIVKQVGVIA

SEQ ID NO: 39022 - protein, 461 aa, Photobacterium profundum SS9
MSTGKIVKVIGAVVDVEFDQDSVPRVYDALNIIDGNNSSLVLEVQQQIGSGIVRCIAMGSSDGMRRGLVAVNTGEPITVPVGEETLGRIMNVLGQPIDECGEIGQKTSYPIHREPPSYEDQANSTELLETGVKVIDLICPFAKGGKIGLFGGAGVGKTVNMMELINNIAKAHSGLSVFTGVGERTREGNDFYYEMKEAGVLDKVAMVYGQMNEPPGNRLRVALTGLTIAERFRDEGRDVLLFIDNIYRYTLAGTEVSALLGRMPSAVGYQPTLAEEMGVLQERITSTHKGSITSIQAVYVPADDLTDPSPATTFAHLDATVVLSRNIAALGLYPAIDPLDSTSRQLDPLVVGVEHYDVARGVQTVLQRYKELKDIIAILGMDELSEDDKLTVARARKVERFLTQPYHVAEVFTGQPGIFVSLKDTLNGFKGLLSGEYDDVPEQAFLYCGAIEDVIEKAKTM

SEQ ID NO: 39023 - protein, 387 aa, Bacillus cereus ATCC 10987
MEFEFFFQIALILLSTKLAGDLSVRLGQPSVLGKLIVGIVIGPAVLGWIENSELLTQLSNVGVILLMFMAGLETDLEELNANRNSSLAVALGGIILPFVGGYVSGLIMGMEQGNAVFLGLLLCATSVSISVQTLRDLGKMKTRESTTMLGAAVFDDILVVILLAFAMSFLGTDDVNLTMIILKKVVFFASIILIGWKGVPAIMRWLSPLRVSESIVSAALIICFSFAYFGELLGIAGIIGAFAAGIAISQTNYKHEVEKKVEPIAYAMFVPVFFVSIGMNITFDGIGDQIWFILALTVIAVLTKLIGCGLGARMTGFDAKSSAIIGSGMVSRGEVALIIAGTGLSSGLLAQDYFTAIVIVVILTTMITPPMLKYTFGAKDKAMKASK

SEQ ID NO: 39024 - protein, 371 aa, Arabidopsis thaliana
MSNFTYTSAFNLSDNSPFNPAIGSSSSSSSALVVASDDDNNTDDACSICLEPFTLQDPSTVTSCKHEYHLQCIIEWSQRSKECPICWQLFVLRDPASQELLAAVEKERLLKTRNISSSSPISIHHSHDDFHSEEEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQGGETC

SEQ ID NO: 39025 - protein, 327 aa, Triticum aestivum
MACRAATMVALLLAAVAATCARAQLHDKFYSESCPSVEDVVRKEMVRALSLAPSLAGPLLRMHFHDCFVRGCDGSVLLDSANKTAEKDAQPNQTLRGFGFVERVKAAVEKACPDTVSCADILALIARDAVWLSKGPFWTVPLGRRDGSVSISNETDALPPPTSNFTVLTQLFAAVNLDAKDLVVLSAGHTIGTSHCFSFSDRLYNFTGMENPSDIDPTLEPQYMMRLKSKCASLNDNTTLVEMDPGSFKTFDTDYFKLVSKRRGLFHSDGALLTDPFTRAYVQRHATGAFKDEFFADFAASMIKMGNANPLTGSQGEIRKKCNVVNR

SEQ ID NO: 39026 - protein, 112 aa, Glycine max
  misc_feature (18)..(18): Xaa can be any naturally occurring amino acid
  misc_feature (26)..(26): Xaa can be any naturally occurring amino acid
  misc_feature (86)..(86): Xaa can be any naturally occurring amino acid
TTVNRAGAGMADPLTALXSMAVCPTXNTIIDFTSFASNAGRAQYMQMWPPVGYKKFETLSYLPDLDDAHLGKDGEYLLRTGWSPRXEFELEHGFLCREHNRAPEYYDGRYWT

SEQ ID NO: 39027 - protein, 469 aa, Burkholderia pseudomallei K96243
MQTESNGRPGAGGGAARPALQQTLGTWQLWGIAVGLVISGEYFGWSYGWASAGTLGFVVTALFVAAMYTTFIFSFTELTTSIPHAGGPFAYARRAFGPAGGYLAGVATLVEFVFAPPAIALAIGAYLHVQFPGLEPKHAAMGAYLVFMALNIVGVQIAATFELVVTLLAIFELLVFMGVVSPGFAWSNFVKGGWAGADHFSAGAFHGMFAAIPFAIWFFLAIEGVAMAAEEAKHPKRSIPIAYVAGILTLVALAIGVMVFAGGAGDWTKLANINDPLPQAMKYIVGANSGWMHMLVWLGLFGLVASFHGIILGYSRQIFALAREGYLPEWLAKVHPRFKTPYRAILAGGVVGIAAIYSDELIQFGGQTLTANIVTMSVFGAIVMYIVSMAALFKLRRMQPRMERPFRAPLYPFFPAFALVAALVCLGTMVYFNALVASIFVAFVALGYGYFLATRAQREAAPADALLEE

SEQ ID NO: 39028 - protein, 512 aa, Fusobacterium nucleatum subsp. vincentii ATCC 49256
MKKGGIVILDFGSQYNQLIARRVREMGVYAEVVPFHEDVDKILAREPKGIILSGGPASVYAEGAPSLNIKLFQKNIPILGLCYGMQLITHLHGGKVARADKQEFGKAELELDDKNHILYKNIPNKTTVWMSHGDHVTEMASDFKIIAHTDSSIAAIENNDKNIYAFQYHPEVTHSQHGFDMLKNFVFGIAKAEKNWSMENYIESTVKQIKERVGNKQVILGLSGGVDSSVAAALINKAIGKQLTCIFVDTGLLRKDEAKQVMEVYAKNFDMNIKCINAEERFLSKLAGVTDPETKRKIIGKEFVEVFNEEAKKIEGAEFLAQGTIYPDVIESVSVKGPSVTIKSHHNVGGLPEDLKFELLEPLRELFKDEVRKVGRELSIPDYMVDRHPFPGPGLGIRILGEVTKEKADILREADAIFIEELRKADLYNKVSQAFVVLLPVKSVGVMGDERTYEYTAVLRSANTIDFMTATWSHLPYEFLEKVSNRILNEVKGINRLTYDISSKPPATIEWE

SEQ ID NO: 39029 - protein, 406 aa, Desulfitobacterium hafniense Y51
MTSGKGFLKSGHLGTLIASFFYFDISFMIWVLLGVTSTFVVGEFQMTDAQKGLMVGLPVLGGAFLRIPMGLLADRFGGKKIGIIGMLVTMVPLLWGYLFGNGIGEIYALGLLLGVSGASFAVALPLASRWYPPEHQGLAMGIAGAGNSGTVLATLFAPRLAEQVGWHGVFGLALIPLTVALAVFIFLAKDNPNAPKPQGVSAYLQIVKHKETWLYSFFYSLTFGGFVGMTSYLSLFFVDQYQLSKVTAGDFVTLIVFAGSFIRPIGGYLGDRLGGMKMLIGLYLVLSMLLLLAGTLPSSAYVALGVLFLTMLFFGIGNGALFQVIPTEFPKEVGIMTGFVGAAGGVGGFILPNILGNVKGLTGSYSYGFWWLAATFLAAALLVFVLRKSRSKLSSLPEPGLAKNSV

SEQ ID NO: 39030 - protein, 341 aa, Synechococcus elongatus PCC 6301
MFGLIGHLTSLEQARDVSRRMGYDEYADQGLEFWSSAPPQIVDEITVTSATGKVIHGRYIESCFLPEMLAARRFKTATRKVLNAMSHAQKHGIDISALGGFTSIIFENFDLASLRQVRDTTLEFERFTTGNTHTAYVICRQVEAAAKTLGIDITQATVAVVGATGDIGSAVCRWLDLKLGVGDLILTARNQERLDNLQAELGRGKILPLEAALPEADFIVWVASMPQGVVIDPATLKQPCVLIDGGYPKNLGSKVQGEGIYVLNGGVVEHCFDIDWQIMSAAEMARPERQMFACFAEAMLLEFEGWHTNFSWGRNQITIEKMEAIGEASVRHGFQPLALAI

SEQ ID NO: 39031 - protein, 326 aa, Methanosarcina acetivorans C2A
MQNRKVQNRKVQNRKVQNRNKAVKPVNDMKALTFGEALFDIIKGTVHLGGAPLNLAAHLAKLGAKPAVLTAVGKDELGKTLLSRAEEMGVDTSYILLDEKRPTGTVTVELQAEGIPIFTINEGVAWDAITPDEREFEALAAEEWDVFCFGTLAQRSEENRKTLKRLLSEIKAKHFFYDVNLRAGFYRKEWILSSLERCTILKMNEEEAAKISGMLFGTTYACRTLCRLLTDRYPKISVICITKGPEGAAVYQDGVYEEIKTTPVEVADTVGAGDAFSAGFLYTFLSGYGVSKAVSVAIMLGTYVASKPGSVPEYSEELRKELGILE

SEQ ID NO: 39032 - protein, 338 aa, Moraxella sp. TAE123
MKAAVLHEFGQSLQIEEVDIPTPGAGEIVVKMQASGVCHTDLHAVEGDWPVKPSPPFIPGHEGVGLITAVGEGVTHVKEGDRVGVAWLYSACGHCTHCLGGWETLCESQQNSGYSVNGSFAEYVLANANYVGIIPESVDSIEIAPVLCAGVTVYKGLKMTDTKPGDWVVISGIGGLGHMAVQYAIAMGLNVAAVDIDDDKLAFAKKLGAKVTVNAKNTDPAEYLQKEIGGAHGALVTAVSAKAFDQALSMLRRGGTLVCNGLPPGDFPVSIFDTVLNGITIRGSIVGTRLDLQESLDMAAAGKVKATVTAEPLENINDIFERMRQGKIEGRIVIDYTM

SEQ ID NO: 39033 - protein, 292 aa, Salmonella typhimurium LT2
MKTRKGIILAGGSGTRLYPVTMAVSKQLLPIYDKPMIYYPLSTLMLAGIRDILIISTPQDTPRFQQLLGDGSQWGLNLQYKVQPSPDGLAQAFIIGEEFIGHDDCALVLGDNIFYGHDLPKLMEAAVNKESGATVFAYHVNDPERYGVVEFDQKGTAVSLEEKPLQPKSNYAVTGLYFYDNSVVEMAKNLKPSARGELEITDINRIYMEQGRLSVAMMGRGYAWLDTGTHQSLIEASNFIATIEERQGLKVSCPEEIAFRKNFINAQQVIELAGPLSKNDYGKYLLKMVKGL

SEQ ID NO: 39034 - protein, 392 aa, Prochlorococcus marinus str. NATL2A
MKAMILAAGKGTRVQPITHVIPKPMIPILQKPVMEFLLELLKEHGFTEVMVNVSHLAEEIENYFRDGQRFGVEIAYSFEGRIEDGELIGDALGSAGGLKKIQDFQKFFDDTFVVLCGDALIDLDLSEAVKRHKEKGALASLITKRVSKDQVSSYGVVVTDEEDRVKAFQEKPSIDNALGDTINTGIYLFEPEIFNYIPSGKPFDIGSDLFPKLVEEGAPFYALPMDFEWVDIGKVPDYWRAIRNVLKGDVRQVEIPGKQVRPGIYTGLNVAANWDKINVKGPIYVGGMTRIEDGVTIVGPSMIGPSCCICEGATIDNSIIFDYSLIGPGVQLVEKLVFGRYCVGKEGDHFDLQEAALDWLITDARRQDLGEPSPQQKAMAELLGTDLIGSSN

SEQ ID NO: 39035 - protein, 665 aa, Colletotrichum trifolii
MDNNNNRLYLNIGNNNDRLGPGSDRQYPTTPSTFPQPVFPHQGQQQQQQQQQQLHHQQQPGMQHPQQYQAQQQQQQQQQQQQQQPYQTGYAPSGYFNPNQQAAQYPPQGHGDYNAAYQPRSNTPGTNDPNVGLAHQFSHQNLGGAARASPYGSRGPSPGQRPRTAGASGQPPSGYGHYATPPLPNQQPASVDPFAPAPERNYEKYGPNANGNQKKCTQLASDFFKDSVKRARERNQRQSEMEAKLSEPNQSQSRREQIWSTAGRKEGQYLRFLRTKDKPENYNTVKIIGKGAFGEVKLVQKKGDGKVYAMKSLIKTEMFKKDQLAHVRSERDILAESDSPWVVKLYTTFQDSYFLYMLMEFLPGGDLMTMLIKYEIFSEDITRFYIAEIVLAIEAVHKLGFIHRDIKPDNILLDRGGHVKLTDFGLSTGFNRLHDNNYYQQLLQGRSNKPRDRNSVAIDQINLTVSNRSQINDWRRSRRLMAYSTVGTPDYIAPEIFTGHGYTFDCDWWSLGTIMFECLVGWPPFCAEDSHDTYRKIVNWRQTLYFPDDIQLGVEAENLIRSLICNTENRLGRSGAHEIKAHSFFRGVEFDSLRRIRAPFEPRLTSAIDTTYFPTDEIDQTDNATVLKAQAIQQARSGIPQVEESPEMSLPFIGYTFKRFDNNFR

SEQ ID NO: 39036 - protein, 264 aa, Synechococcus elongatus PCC 6301
MAIPLLQIDAFTQQPYRGNPAAVCLLTEPLPDTQLQAIAAEMNLSETAFLLTDQTAWQLRWFTPACEVDLCGHATLAAAQALQEWGRAQRGQTLRFHTRSGLLQAKLSDRGIELDFPLQPPQGLETSLDLAAGIGAPVVASRTSELGYWLLELASVEQVRTLQPDQAAIAQWPCQAVVVTAAAQAGDDCDFVSRFFAPRFGIPEDPVTGSAHCLLAPYWQAKLGRDRLQARQLSARGGELEVEVVGDRVFLRGYAVTVLRGELQ

SEQ ID NO: 39037 - protein, 496 aa, Pseudomonas syringae pv. syringae B728a
MVAELLARLGVANSAHTQGDYPVYTPIDGSRIASVTLEGKAQVVARIDSAHSAFLKWRTVPAPRRGELVRIFGEVLREHKADLGELVSVEAGKITQEGLGEVQEMIDICDFAVGLSRQLYGLTIASERPGHHMRETWHPLGVVGVISAFNFPVAVWAWNTTLALVCGNPVIWKPSEKTPLTALACQALFDKALKIFGDAPAALAQLVIGDRDAGEALVDDPRVPLISATGSTRMGREVGPRVAARFGRSILELGGNNAMILAPSADLDLAVRGILFSAVGTAGQRCTTLRRLIVHRSIKDEVVARVKAAYAKVRVGDPREGNLIGPLIDQQAFSAMQNALTKARDEGGQVFGGERQLQDKYPNGYYVTPAIAEMPGQSEVVRHETFAPILYVLAYDDFEEALRLNNEVPQGLSSCIFTTDLREAEAFQSAAGSDCGIANVNIGTSGAEIGGAFGGEKETGGGRESGSDSWRAYMRRQTNTVNYSRELPLAQGIVFD

SEQ ID NO: 39038 - protein, 415 aa, Pseudomonas syringae pv. syringae B728a
MSEHISESISFVHNITLSHGRNAEVWDTAGKRYIDFVGGIGVLNLGHCNPQVVTAIQDQAAKLTHYCFNATPHDPYIRFMQQLTQFVPVSYPLSGMLTNSGAEAAENALKIVRGATGRTAVIAFDGGFHGRTLATLNLNGKVAPYKQKVGVLPGPVFHVPFPSKDNGVSTEQALKAMDRLFSVEIDVNDVGCIIFEPVQGEGGFLAMQPDFAQALRAFCDKHGIVLIADEIQSGFGRTGQRFAFSRLGIEPDLILLGKSIAGGIPLGAVVGRKPLLDNLPKGGLGGTYSGNPIGCAAGLASLAQMTDANLSSWGEQQERAIVSRYEAWRASGLSPYLGRLTGVGCMRGIELITPEGEPGTRPLAELLSSARDAGLLLMPSGKARHIIRLLIPLTIEPDVLHEGLDIFERCLAALA

SEQ ID NO: 39039 - protein, 186 aa, Zea mays
TIDNRCRHSPRSCCHRFSFFLDSHCNSSQILPPGLAGSAATAATLVKSKAIRVHELGGPEVLRWEEVEVGEPGEGEIRIRTTAVGVNFIDIYFRKGVYAAPTMPFTPGMEAVGVVTAVGPGLTGRKVGDVVAYAGNPMGSYAQEQILPAAVAVPVPPSVDHKQAASVMLKGMNSCKLLETVTGKKV

SEQ ID NO: 39040 - protein, 464 aa, Dehalococcoides ethenogenes 195
MANGKVIQVIGSVVDVEFSADSMPALFNALEIPRDNGKMVLEVQSHVGNNRVKCLSFTPTDGLERGAEVIDTKRPLSVPVGRNTLGRIFNVLGEPLDNRGDVKAEKTMPIHRSAPAMDELESSAQVLETGLKVIDLIAPFARGGKIGALGGAGVGKTVLIQELIRNIATEHEGFSVFAGVGERSREGNDLWHEMEDSGVLPKTTMVFGQMNELPAVRLRIALTGLTMAEYFRDEERQDVLLFIDNIYRYTLAGMEVSALLGRMPSAVGYQPTLATEMGALQERIASTKQGSITSFQAVYVPADDYTDPGVVATFGHLDAMIALERSLAEQALYPAVDPLASNSRILDPQVVGEEHYQVARDVQKVLQRYKDLQDVIAILGMEELSEEDKLTVARARRIQRFLTQPMFVSEVFTGRPGQYVSLAETIRGFKEILEGKHDSLPEQAFYMVGTIDDAVAEAKKLSAA

SEQ ID NO: 39041 - protein, 665 aa, Oryza sativa Japonica Group
MGGGVEERKVVDLEDGDGEEGEDAAAVAAGSSRETRMLPRMPVRVLLAEGDDSTRHIICALLRKCGYRVAAASDGVKAWDILKEKSFNIDLVLTEVELPLMSGFLLLSTIMEHDACKNIPVIMMSSNDSVSMVFKCMLKGAADFLVKPIRKNELRNLWQHVWRKQLSSGVLDVQHTQQEDNLTERHEQKTGVTKAEHVTENVVHKNMECSEQESDAQMYLALQICINVGELIYQFFKSAKCHSSVLLGIAKWSTYDNSKSSCTRSELEADSRQTNNLLEYKQPMGRHFSKPDHKNTEKNGGTKIHASNDGNLIPRREEDASLRRMTCSNDINCEKASRDMELVHIIDNQQKNNTHMEMDVARANSRGNDDKCFSIPAHQLELSLRRSDYSRLESQEKNERRTLNHSTSSPFSLYNCRTASSTINAGDAQACSTSATHIDLENKNGDSKTPSQDKRETNQPPIRVVPFPVPVGGLTFDGQPFWNGAPVASLFYPQSAPPIWNSKTSTWQDATTQAISLQQNGPKDTDTKQVENVEEQTARSHLSANRKHLRIEIPTDEPRHVSPTTGESGSSTVLDSARKTLSGSVCDSSSNHMIAPTESSNVVPENPDGLRHLSQREAALNKFRLKRKDRCFEKKVRYQSRKLLAEQRPRVKGQFVRQDHGVQGS

SEQ ID NO: 39042 - protein, 433 aa, Candidatus Protochlamydia amoebophila UWE25
MPFTLTMPKLSPTMEEGTLIKWHKKIGDSIQTGDLLIEVATDKATVEYNAIDDGWLRQILIQEGKDAAVNQAIAILTVDQNESLEGYQADGVKEKALQLSSDSIEMPELNYKEKKEPKSKTTAFQQPVFVPEFPLENYTFEFPIERGDKKLLASPLAKKLAKEKGLDLTTVKGTGPQQRIISRDLDKAQAAGVVNFGHRETPQLPPGSYEELSLTPMRKVIGQRLQESKSFIPHFYVTLTIDASPLTQIREQLKNNQVKVSINDFIVRACALALRQNPGLNCGFNSANQSIIQFKTIDIAVAVSLEEGLITPIIRHADFKNLGELSVEMRVLAQKAREGKLEPQEYKGGSFTISNLGMFGVSEFQAILNPPQAAILAVSGILDVPVIQNNMVIPGKTMNLTLSVDHRVIDGVAAAKFLQSLKQLLENPAGLLL

SEQ ID NO: 39043 - protein, 439 aa, Vibrio parahaemolyticus RIMD 2210633
MQALADRLKNYKVEGLTTRPVASGKLVRVVGLTLEATGCRAPIGSLCLVETMSGHMEAEVVGFSGDNLYLMPSEQITGILPGAKVTPLTSEAGLPVGMELLGRVIDGVGNPLDGLGPIYTEHRASFNAEPINPLARKPISEPLDVGLKAINGLLTVGKGQRIGLFAGSGVGKSVTLGMMTRGTTAQVVVVGLIGERGREVKEFIEEILGEDGRRRSVVVAAPADASPLMRLKGCQTALTIAEYFRDQGLDVLLLMDSLTRFAQAQREIALSVGEPPATKGYPPSVFAKLPALVERAGNGSPEQGSITAFFTVLTEGDDLQDPIADASRAILDGHIVLSREMADAGHYPAIDVEKSVSRVMPQITTEEHVLMSKAVRQVLSICRKNQDLVSIGAYKPGTDPAIDGAFTLKPKLDEYLQQRMKESVPYDMCVNMLRNILGG

SEQ ID NO: 39044 - protein, 470 aa, Oryza sativa Indica Group
MASAPFAVSSSPAASAVAARSKARDTRLTHLLCLVLRGGRSEARTGCRLGITRKNFGRVMMALAVDVSRFEGVPMAPPDPILGVSEAFKADQNDLKLNLGVGAYRTEELQPYVLNVVKKAETLMLEKGENKEYLPIEGLAAFNKATAELLFGADNPVLKQGRVATLQSLSGTGSLRLAAAFIQRYFPEAKVLISSPTWGNHKNIFNDAKVPWSEYRYYDPKTVGLDFEGMIADIQAAPDGSFVLLHGCAHNPTGIDPTPEQWEKIADVIQEKKHMPFFDVAYQGFASGSLDEDASSVRLFVQRGLEVFVAQSYSKNLGLYAERIGAINVVCSTPEVANRVKSQLKRLARPMYSNPPIHGARIVANVVGDPTMFGEWKQEMEEMAGRIKNVRQKLYDSLSAKDDSGKDWSFILRQIGMFSYTGLNKTQSDNMTDKWHIYMTKDGRISLAGLSLAKCEYLADAIIDSFHNVS

SEQ ID NO: 39045 - protein, 259 aa, Neisseria meningitidis MC58
MNGIIIKTPEEIEKMRELGKLVAEALDYIGQFVKPGVTTDEIDKLVYDYHVNVQGGYPAPLHYGNPPYPKSCCTSVNHVICHGIPDDKPLKEGDIINIDLTIKKDGFHGDSSRMFTVGKVSPIAQRLIDVTHASMMAGIEAVKPGATLGDVGYACQQVAENAGYSVVQEFCGHGIGRGFHEAPQVLHYGKKGQGPVLKPGMIFTVEPMINQGKRHLRILNDGWTVVTKDRSLSAQWEHEVLVTETGYEILTVSPASGKP

SEQ ID NO: 39046 - protein, 431 aa, Schizosaccharomyces pombe 972h-
MAVSAVPHPSKQAQASEEGINQEKCINEEYKIWKKNSPFLYDLIITRALEWPCMSLQWYPEQQIFAEHGYTEQKMFLGVRADVGKYLLAVASIQLPYLNQTVPPTTMEGASAGDESSLRVNISNLYSHPESVCSAKLMPQDDSCVATVGNYHNDVLVFDKESFESYSSASESPLKPKYRLTKHTQPCTSVCWNFLSKGTLVSGSQDATLSCWDLNAYNESDSASVLKVHISSHEKQVSDVRFHYKHQDLLASVSYDQYLHVHDIRRPDASTKPARSVHAHSGPIHSVAFNPHNDFILATCSTDKTIALWDLRNLNQRLHTLEGHEDIVTKISFSPHEEPILASTSADRRTLVWDLSRIGEDQPAEEAQDGPPELLFMHGGHTSCTIDMDWCPNYNWTMATAAEDNILQIWTPSRSIWGNEQLEEDATAYLS

SEQ ID NO: 39047 - protein, 210 aa, Candidatus Protochlamydia amoebophila UWE25
MVSSGRDPQDVNLIVVSKNQPITVMQDVYQSGCRQFGENRVMEALAKIPEMPRDIQWHLIGTLQSNKVAKILNSSISLIHSVHSFSLAKKISEGSLQKQKITSILLQVNVSKEESKQGLTHDEWEKLLAPLQELSNLRIEGLMTIAPHTADLGYVRFCFRQLFELREKWKKQMNNPTYFKHLSMGMTNDYLIAIEEGATLLRIGSGIFGH

SEQ ID NO: 39048 - protein, 440 aa, Bordetella parapertussis
MGLLEGICRYRGAILKREVYRARAARRRAGRDRAKGAKIAAFQPGRARFMSAQISSLNAGAAPESFGIASVPEIIAELRAGRIVILVDEEDRENEGDLVMAAEFVTPEAINFMVTHGRGLVCLTLTEERCRQLDLPLMASRNGTRYGTNFTQSIEAAEGVETGISAADRARTIQVAVARDAQPSDLVQPGHIFPVRAVPGGVLVRAGHTEAGCDLTAMGGLTPAAVICEILKPDGTMARLPDLVEFAREHKLKIGTIADLIQYRSEHESIIARMGERMMQTPWGDFRCIAYRDDATRSPHLALVHGNIDPERETLVRVHEPASLLDVLDTGASPHSWSVGQALHAIAASPAGVLVLMNCQSSTEHLFGQIANWAGPAERAAAQEGDRFGLRTYGIGAQILRDLNVGRMKLLARPRKMPSMAGFALTITGYDCAPPNLRND

SEQ ID NO: 39049 - protein, 278 aa, Arabidopsis thaliana
MSKEVSEEGRHGKDYVDPPPAPLLDMAELKLWSFYRAIIAEFIATLLFLYVTVATVIGHKNQTGPCGGVGLLGIAWAFGGMIFVLVYCTAGISGGHINPAVTFGLFLARKVSLPRAVAYMVAQCLGAICGVGLVKAFMMTPYKRLGGGANTVADGYSTGTALGAEIIGTFVLVYTVFSATDPKRSARDSHVPVLAPLPIGFAVFMVHLATIPITGTGINPARSFGAAVIYNNEKAWDDHWIFWVGPFVGALAAAAYHQYILRAAAIKALASFRSNPTN

SEQ ID NO: 39050 - protein, 356 aa, Capsella rubella
MEKGEDSSTFKMGNSAQERGLPYVPDCYVVPPSWQPCDSNSEIVPTIDVSRLNGGDDERRGVIREISLACQHLGFFQIVNHGINQNILDDALEVAKGFFELPAKEKKKFMSNDVYAPVRYSTSLKDGLDKIQFWRIFLKHYAHPLHRWIHLWPENPPGYREKMGKFCEEVRKLSIEIMGAITESLGLGRDYLSSRMDENGMQVMAVNCYPPCPGPDAALGLPPHSDYSCITILLQNLAGLKIFDPMAHGGSGRWVVVPQVTGVLKVHIGDHVEVLSNGLYKSVVHKVTLNEENTRISLASLHSLDMNDKMSVPCELVNNENPVRYKESSFNDFLDFLVKNDISQGDRFIDTLRIKD

SEQ ID NO: 39051 - protein, 238 aa, Vitis vinifera
MASSAVLFSSVRACEFSKPQTLIPRSNSPLIVSIPLHRRRHKNGRVFASISVTSPEVRTGPDDLVASILSKVAQTDRGVLLTKDKHKEVAEVAQELQKYCVTEPVKCPLIFGEWDVVYCSNPTSPGGGYRNAFGRLFFKAKEMIQVVEAPDIVRNKVHFSALGFLDVEVSLKGKLKALDDKWIQVVFEPPELRLGALEFQYGGESEVKLEITYIDDRVRLGKGSRGSLFVFERLRKTV

SEQ ID NO: 39052 - protein, 396 aa, Staphylococcus epidermidis RP62A
MTQSEKIINLTNHYGAHNYVPLPIVISEAEGVWVKDPEGNTYMDMLSAYSAVNQGHRHPRIIQALKDQADKVTLVSRAFHSDNLGQWYEKICKLAGKDKALPMNTGAEAVETALKAARRWAYDVKGIEPNKAEIIAFNGNFHGRTMAPVSLSSEAEYQRGYGPLLDGFRKVEFGDVNQLKAAINKNTAAILVEPIQGEAGINVPPEGYLKTIRELCDEHQILFIADEIQAGLGRSGKLFATDWDHVKPDVYILGKALGGGVFPISVVLADNEVLDVFTPGSHGSTFGGNPLASAVSIAAIDVIIDEDLPGRSLELGEYFKSELKKIEHPSIKEVRGRGLFIGIELHESARPYCEALKEQGLLCKETHDTVIRFAPPLVITKEELDMALEKIKSVFA

SEQ ID NO: 39053 - protein, 858 aa, Vibrio angustum S14
MLSIIEQIKQGKLWDFHGGIHPAENKKISNQAPIVSAGIPQELVLPLKQHIGSKGDIIVAVGDKVQKGQALTQGDIAMCVPVHAPTSGTVIAIEQRTTAHPSGLSDLCIVLHPDHTDTWGEKKTYADYQDRDPAELIETIRLSGIAGLGGAGFPTARKLQGGLGNVDILIINAAECEPYITADDRLMRDYAEEVIEGVRILRHIISPKLTIIGIEDNKPEAIKALEQHVTEADNILIRVVPTKYPSGSSKQLVKILTGREVPSQSRSTSVGVIMQNIGTAFAIKRAIIDGEPLIERVVTLTGEAFKKRGNVFAMLGTPIAYLLDKFGYKADKKHPRVIIGGSLMGFTLPHSNVPITKITNCILAPKRKELPLHTYEMACIRCSACADVCPSSLLPQQLQWYAKDQNYDKCEEYNLKDCIECGACAYVCPSEIPLVQYYRQAKAEIWARSQDEMNAERARQRFEAKQARMERDKAERENRFKKAADSRRDEMAKTGGDDAVAAAIARVKAKQAAAAKADTAEVKPAVAAAIAKAKAKQAASAQGATSESLPDNSEMAKLREERKRQARERKAEKEATANNQPAAENDSKKDAVAAAVARAKARKAAQQTEAQAESASEPIVETENVDPKKAAVAAAVARAKARKAAQQAEAQTESAPEPVVEAENVDPKKAAVAAAVARAKARKAAQQAEAQAESAPEPVVEAENVDPKKAAVAAAVARAKARKAAQQAEAQAESAPEPVVEAENVDPKKAAVAAAVARAKARKAAQQAEAKAESAPEPVVEAENVDPKKAAVAAAVARAKARKAAQQAETQAESAPEPVVEAENVDPKKAAVAAAVARAKAKKAAQQAAKEQQNIEED

SEQ ID NO: 39054 - protein, 576 aa, Populus trichocarpa
MLEKKMEGINTNKVIEEFEALTKDAGGVQRETLKKILEENGSAEYLQNLGLNGKSDPESFKSCVPLVTHEDLEAYIHRIAEGDSSSVLTGKPISDMSLSSGTTQGKRKFVPFNDELMENTLQIYRTSFAFRNREFPLEKGKSLQFVYSSKPGKTKGGLGAGTATTNLFRNSKYKSGMKAIQFQCCSPDEVIFGPDFHQSLYCHLLCGLLFREEIQFVFSTFAHSIVLAFRTFEQVWEELCNDIRDGELSSRVTALSVRMAMRKLLRPNPELADLIYKKCSGLSNWYGLIPELFPNAKYIYGIMTGSMEPYLKKLRHYAGELPLMSADYGSSEGWIAANVNPKLPPELATFAVLPNIGYFEFIPLQDNAECMYKESKPVGLTEVKIGEDYEIVVTNFAGLYRYRLGDVVRVMGFHNSTPELKFVCRRNLILSINIDKNTEKDLQLSVEEAGKLLAEEKLEVVDFSSLVEVSTDPGRYVIFLEISGEASEEVLQECCNCLDRSFVDAGYVSSRKVKTIGPLELRVVWRGTFLKILEHYLGLGTVVSQFKTPRCVGPMNNKVQQILCNNVAKTYFSTAF

SEQ ID NO: 39055 - protein, 396 aa, Burkholderia pseudomallei K96243
MAARPFTSPGGSMQSAAAPRSKLPDVGTTIFTVIGQLAAEHEALNLSQGAPNFAPDPALVERVARAMRDGHNQYAPMAGIAALREALGVKTERLYGERYDPDSEVTIVASASEGLYAAISALVHPGDEVIYFEPSFDSYAPIVRLQGATPVAIRLSPERFRVNWDEVAAKITPRTRMLIVNTPHNPSATILGEADVARLAQLVAGTDIVVLSDEVYEHVVFDGARHHSMARDRALAERSVIVSSFGKSYHVTGWRVGYCLAPAELTRELRKVHQFMTFAADTPMQHAFAAALAEPASYLELGAFYERKRDLLVRELAGSRFELLPSEGSFFMLARFGHFSDESDADFVLRAIRDARVATIPLSAFYADGANTGCIRLSFSKDDATLVEGARRLCSL

SEQ ID NO: 39056 - protein, 185 aa, Vitis vinifera
MRIPILGFGQAGIAIELKDRGSFVQTAAVRHLMGSLTRAEGLRFAVVVARFNEIVTKLLLEGALETFKRYSVKEEDIDVVWVPGSFEIGVVAERLGKSKKYQAILCIGAVIRGDTSHYDAVANSAASGVLSAGLNSGVPCIFGVLTCDDMDQALNRSGGKSGNKGAEAALTAIEMASLFEHHLIQ

SEQ ID NO: 39057 - protein, 518 aa, Methylobacillus flagellatus KT
MLTFDNRFLRELPGDPETSNQLRQVYGACWSRVMPTSVSSPKLLAYSHEMLEALELSEEEIRSPAWVDALAGNGLMPGMEPYAACYGGHQFGHWAGQLGDGRAISLGEVVNRQGQRWELQLKGAGVTPYSRMADGRAVLRSSVREFLCSEAMHHLGIPTTRALSLVQTGDVVIRDMFYDGHPQAEKGAIVCRVSPSFIRFGNFEIFAMRDDKQTLQKLVDFTIDRDFPELRNYPEEERLAEWFAIICVRTARLIAQWMRVGFVHGVMNTDNMSILGLTIDYGPYGWVDNFDPGWTPNTTDAAGRRYCFGRQPDIARWNLERLAQALYTLKPEREIYDEGLMLYDQAYNNEWGAVLAAKFGFSAWRDEYEPLLNEVFGLMTQAEIDMTEFFRKLALVDAAQPDLGILQSAAYSPALWETFKPRFSDWLGQYAQATLADGRDPAERREAMNRVNPRYVLRNYLAQQAIDLADTGDTSMIEALMDVLRKPYDEQPGKERFAALRPDWARHKAGCSMLSCSS

SEQ ID NO: 39058 - protein, 477 aa, Vitis vinifera
MVILQLALPTTSSANLRPKLPSLGGKQATVPPSLCVSNSQQSEHPASLSRPANRQSVAAIVFGDGSESQLYPLTKRRSEGAVHIAGSYRLIDAVVSNCINSNITKIYALTQFNSTSLNSHLCRAYSGVGLEVVAAYQSPEARGWFQGTADAVRRCLWLVEEHPVAEFLVLPGYHLYRMDYQKLIQAHRQSKADITIVALSAEISRETGLGILEVNSENQVVEFSKRSEKEPATIISVKSPRKSNDNGYKKLASMGIYVVKKEIMIKLLSEHFPKANGFGSEVIPGAISIGMKVEAFAFDGYWEDMRNIEAFYQANMEITKKTDVGYNFYDRDSPLYTLPRNLPPTLITDAVITDSIIGDGCILDRCEIRGTIVGLRTKIGDRAVIEDSVIMGSDIYQPEDELRRDMKGTGNDIPIGIGEDTHIRKAIVDKNARIGKQVLIMNRDNVQEGNREAHGYTISEGIVVVLKGAVIPDGSIL

SEQ ID NO: 39059 - protein, 322 aa, Yarrowia lipolytica CLIB122
MGLLDKFKTLSLANTASEKFSAEAEISKIVPIADCSPTDCDSCVLDTRYPPMDIDQSPLYNTAKPFGLHLVVATGLSDWKKKYLDDKSSVAGALDDPDVAEAVATTMKKFYPTKPLSDLGTKISNSSLPPPDEYYMYDDKRPSSSESVSAMERGKGVIEDSYGKPKDSSNDLMTRPTKVLLLPLFLEITLTPENARSELVEALGNLHEQPKKLTKNTKRAYVLLCSHKTVDKRCAITSKILKKEFDAQLRDKQIHDVEVAFVSHVGGHKFAANALIYLSTGESIWLARVGPEHVCAIIDEVIEKGKVFPELVRSVAKCQLDW

SEQ ID NO: 39060 - protein, 281 aa, Methylobacillus flagellatus KT
MSHRYHDCRPIVNELHVSRENFIIPGPEGTIPVRLYRRAQAGGDVPLVLYFHGGGFNAGCLDDADFPAGFIAYHCPAVVLSVGYALAPQHPFPAAPEDAYAATRWAARNTCRLNVTAKLLVVAGDDAGGSIAAGLSMMARDRGEFSIAAQVLIAPMLDPSMTLLGDAAGLKSELTAAQCAQRYRQYLPKCTQRMHPYAAPLESLRLAGLPAAMIATAECDVLHIEAEKYANVLIQAGVPTQVSRFSGVQHAELLAHQPMLREVVEFLRRQAMHAGLPIDSG

SEQ ID NO: 39061 - protein, 207 aa, Arabidopsis thaliana
MAGAEQSQRWSLKAKTVLVTGGTKGIGHAIVEEFAGFGAVIHTCARNEYELNECLSKWQKKGFQVTGSVCDASLRPEREKLMQTVSSMFGGKLDILINNLGAIRSKPTLDYTAEDFSFHISTNLESAYHLSQLAHPLLKASGCGNIIFMSSIAGVVSASVGSIYSATKGALNQLARNLACEWASDGIRANAVAPAVIATPLAEAVRY

SEQ ID NO: 39062 - protein, 282 aa, Azoarcus sp. BH72
MKTESMSMTNPVRGPGLFALLREDVRCVFGRDPAARTVWEVLTTYPGVHAVMSHRIAHALWRRGWRYPGRLVSFLARVFTNVDIHPGAQIGRRFFIDHGAGVVVGETAEIGDDVTLYHGVTLGGTTWNPGKRHPTLGDHVVVGAGAKILGAITIGSRVRVGANSVVVKNVPADRTVVGIPAKVVKRESPILSATDELNLDHHVMPDPVGHTLNCLLDRIKMLESELATLQAEGKAALAAASAPPKPVQTVFPLINANPLDCQANTDAACPECACQPEAQEAR

SEQ ID NO: 39063 - protein, 148 aa, Hordeum vulgare
  misc_feature (5)..(5): Xaa can be any naturally occurring amino acid
  misc_feature (139)..(139): Xaa can be any naturally occurring amino acid
MASKXILKEFKDLQKDPPTSCSAGPSGEDMFHWQATIMGPHDSPYAGGVFLVNIHFPPDYPFKPPKVSFKTKVFHPNINSNGSICLDILKEQWSPALTISKVLLSICSLLTDPNPDDPLVPEIAHMYKTDRSKYETTAXSWTQKYAMG

SEQ ID NO: 39064 - protein, 258 aa, Pseudomonas syringae pv. phaseolicola 1448A
MFKRLREDIQSVFHRDPAARNAFEVLTCYPGMHAIWLHRFAHILWRNGWKWLARLVSNFGRWMTGIEIHPGARIGRRFFIDHGMGIVIGETAEIGNDVTLYQGVTLGGTSWNAGKRHPTLEDGVVVGAGAKVLGPFTVGAGAKIGSNAVVTKAVPAGATAVGIPGRIIVKSDDETEARRKVMAEKLGFDAYGVSADMPDPIARAIGQLLDHLQAVDGRLEGMCDALGRLGSDYCAKDLPELRDEVFDCVKDRHEDKVG

SEQ ID NO: 39065 - protein, 186 aa, Triticum aestivum
  misc_feature (9)..(9): Xaa can be any naturally occurring amino acid
  misc_feature (17)..(17): Xaa can be any naturally occurring amino acid
  misc_feature (38)..(38): Xaa can be any naturally occurring amino acid
MIGEECFSXHNVEYRGXGTVHVSFVVIKADTPWHYSEXDGGDLVVKDPNGAQVRDSRDKTSDKLEFIVQKRGVHRFCFTNKSPYHETIDFDVHVGHYSYFDQHAKDEHFSPLFEQIAKLDEALYNIQFEQHWLEAQTDRQAILNENMSRRAIHKALFESAALIAASVIQVYLLRRLFERKLGTSRV

SEQ ID NO: 39066 - protein, 195 aa, Triticum aestivum
  misc_feature (78)..(78): Xaa can be any naturally occurring amino acid
  misc_feature (85)..(85): Xaa can be any naturally occurring amino acid
  misc_feature (110)..(110): Xaa can be any naturally occurring amino acid
  misc_feature (120)..(120): Xaa can be any naturally occurring amino acid
  misc_feature (130)..(130): Xaa can be any naturally occurring amino acid
  misc_feature (139)..(139): Xaa can be any naturally occurring amino acid
  misc_feature (143)..(143): Xaa can be any naturally occurring amino acid
MAPTVMASSATSVAPFQGLKSTAGLPVSRRSNGASLGSVSNGGRIRCMQVWPIEGIKKFETLSYLPPLSTEASSKQVXDYLIRSXKWVPCLRVQARLGSSSVSKNASPGXYDGRYWTMWXLPISGCTDAXQVINEVEEXKKGXLTVLRRVRQHRKCMRSCLKQRAARSGRLKVIQRAIMHAVPELLVPPLLLVSK

SEQ ID NO: 39067 - protein, 228 aa, Synechococcus sp. WH 8008
HEVAGAGQHELGMKFAELIQAADNTMTYKYVVRNVAKKYGKTATFMPKPVFNDNGSGMHVHQSLWKGGQPLFFGEGTEANLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGAPTNVDLFELSAERLSEIDTVPASLNGALEALNADHHYLMEGGVFTK

SEQ ID NO: 39068 - protein, 474 aa, Synechococcus elongatus PCC 6301
MESPLMLVPVILSGGSGSRLWPLSRESYPKQFHALLSDYSLLQETLLRLEGLPGLASPLLICNEQHRFLVAEHLRAIGQTAAAIVLEPEGRNTAPAVAIAALQAQSQGEDPLLLVLPSDHSIADPAAFRATVQTAIALATAGHLVTFGIVPEAPETGYGYIKAGSDLDLGGFAIDRFIEKPNLATAENYVASGCYYWNSGMFLIRASVYLSELARYAPEMFTACEAAWQKRQADLDFVRLDPATFAQCPSDSIDYAVMEHTQQGAVLPLQAGWTDVGSWSSLWQALEQDGAGNVTVGDSLALDCRNVYLRSEGRLVVGVGLEDVVAVETDDALLIAHRDRTQTVKQVVEALQREARRESRAHRKIYRPWGRYDSLDLGDRFQVKRITVNPGASLSLQMHHHRAEHWIVVKGTALVTRDNEEVLLTENQSTYIPVGCKHRLSNPGRVPLEMIEVQSGSYLEEDDIVRFEDHYGRS

SEQ ID NO: 39069 - protein, 791 aa, Oryza sativa Japonica Group
MAANNNSDPILDEGGGGGVKHEAVGEAGEGKGGGGGSLIKLVYFSRHAEHSSEDKRKLSTKRRLGMLNGGRRSYPVLGGRLHFVKFETGKLNECLDFISSKQLHRGGVDSPSWRSGAQPDNIVIKATGGGAFKYADLFKERLGVSLEKEDEMDCLVAGANFLLKSIRHEAFTHMDGQKEYVQIDQNDLFPFLLVNVGSGVSIIKVDGHGKFQRVSGTNVGGGTYWGLGRLMTKCKSFDELLELSQRGDNSTIDMLVGDIYGGLDYSKIGLSASTIASSFGKTISDDKELSDYRPEDISLSLLRMISYNIGQISYLNALRYGLKRIFFGGFFIRGHAYTMDTISFAVNFWSKGEAKAMFLRHEGFLGALGAFMSYEKHGLDDLRIHHLVERFPMGAPYVGGKIHGPPLGDLNEKASTSTLDHGNLNGFISWMEKFVQKGTQITAPVPVGFPVTTGMGGFERPTAKGDILRSDASAALNVGVLHLVPTLDVFPLLEDPKMYEPNTIDLDLNEYKYWFKILSDHLPDLVDKAVASEGGTDDAKRRGDAFAHAFSAHLARLMEEPAAYGKFGLANLLELREECLREFQFVDAYVSIKQRENEASLAVLPDLLMELDSMNEIDDFDMFKKRMLADKKGQPYKRALLFVDNSGADVVLGMIPLARELLRNGTEVVLVANSLPALNDVTANELPGIVAEAAKHCGILRKAAEAGGLIFDAMAGIQDDLKDEPVSVPLMVVENGCGSPCIDFRQVSSELAAAAKDADLLILEGMGRSLHTNLNARFKCDTLKVLVSANS

SEQ ID NO: 39070 - protein, 296 aa, Azoarcus sp. BH72
MWDYSDTVKEHFYNPRNAGALADANAIGEVGSISCGDALRLMLKVDPANETILDASFQTFGCGSAIASSSALTEIIKGKTLEQALEVSNQDIADFLGGLPPEKMHCSVMGREALQAAVANYRGEEWKDDHEEGALICKCFAVDAVMIEETIRANNLCSVEQVTNYTKAGGGCSSCHEGIEEILAKVLAERGETFKAAPPPEKKAPGKMTTLERIRKIEQVIEKARPNLQRDHGDIELVDVDGKNIYVSMKGACAGCQMEAATLGGVQAQMIEALGELVKVIPVKATAKLAPNTLPA

SEQ ID NO: 39071 - protein, 384 aa, Chlamydomonas reinhardtii
MLSRLGLGLLARAAVAGGEGLAARAFGTGSAYLPLPGDARSQIVTLIPGDGIGPEVTKAVVDVVAAMQAPITWERFDYLSGSEETAAGSVPRTSVPKEVLDSIRRNGVCLKGTLFTPLNKENTNTQSLNVQLRKDLDLHVNVVHGFSIPGLPTRYNNLDIVVIRENTEGEYSGLEHEVVEGVVESLKVITYEKSLRTAQYAFEFAYLNHRKKVSAIHKANIMKLGDGMFLKACREVARNFPNIKYEEVIVDNTCMQLVNKPHQFDVMVTPNLYGNLVSNVVAGLCGGFGVVPGGNIGDGVAVFEQGARHVAKDLAGAGVANPTATLLSTAMLLRHLKLAGFADRLEAAVLKVYTDGDEAALTPDVGGSGTLLRFTEAVVRNLQE

SEQ ID NO: 39072 - protein, 505 aa, Pseudomonas syringae pv. syringae B728a
MSTARILELMRPYWGDRSVIASYVGGQFIEGHGAPVEVRNAHDDSLLLSFPDADESLVEVADKAARAAQQQWWALTAQARGRAMYQVGNLIRDELENLAQIESLTANKPIRDARVEVLKVAEMFEYYAGWADKLHGEIIPVPTTHLNYVTYEPLGTVLQITPWNAPIFTCGWQIAPAIAAGNAVILKPSELTPLSSLMVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQESIFEKFTNALAVAATQFKVGDPSDPETQIGPINNAKQYNHVKNMVEQALKDGAKLVGEHADPIPEKPGYYINPTVLAGTNALYCAQEEIFGPVVVAIPFKDEEDAIRIANDSRFGLAGGVWTRDVGRAHRVARQVRAGTFWVNGYKTIHVSSPFGGYGESGYGRSSGLDALREYSEVKSVWVETAAKPAASFGYGASLE

SEQ ID NO: 39073 - protein, 502 aa, Zea mays
MSTHAASRRSSSSSAVAKRPAIAEGATKAAGPGPTAAQAKKRTALVNITNVAAPGARVAAVGKVAPPVTGAKLNPATSGAPLKKPSLANARTIRGSAAKSASIKPAPPVSRHDSSSEQKHNVPVPTTVHVPSRAPALVPYSSFVSPGRSGDSVSTDETMSTCDSMKSPDFEYIDNGGCSMLASLQRRADEHLRTSEDRDVEENKWKKNGPAPMEIDSICEVDSNFEDPQLCAALASDIYMHLREAEMKKRPSTDFMETIQKDVNPSMRAILIDWLVEVAEEYRLAPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLANYIAELSLLEYSLLSYPPSLIAASAIFLARFVLQPTKYPWNSTLAHYTQYKPSELSECVKALHRLSSVGPGSNLPAIREKYSQHKYKFVAKKQSPPQIPAEFFRDAAC

SEQ ID NO: 39074 - protein, 228 aa, Synechococcus sp. WH 8104
HEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMLMAGLDGIKNQIDPGDGEDRDLFELAAEELSKIATVPASLNGALEALNADRGFLTAGGVFSD

SEQ ID NO: 39075 - protein, 411 aa, Pseudomonas syringae pv. syringae B728a
MRALTYHGANSVKVDTVPDPVIEQADDIILRVTATAICGSDLHLYRGKIPTVEHGDIFGHEFMGVVEETGSAVTAVAKGDRVVIPFVIACGSCFFCNLDQFAACETTNTGRGAILNKKSIPPGAALFGFSHLYGGVPGGQAEYVRVPKANVGPFKVPGTLADEKVLFLSDILPTAWQAVLNAGIGQGSTVAIYGAGPVGLMSAACAKMLGAEKIFMVDHHPYRLAYAQKTYGVIPINFDEDDDPADTIIRQTAGMRGVDGVIDAVGFEAKGSTTETILATLKLEGSSGKALRQCIAAVRRGGVVSVPGVYAGFIHGFMFGDAFDKGLTFKMGQTHVHRFMPELLEHIEAGRLEPEAIITHRMSLEDAAKGYKLFDKKEEDCRKVILTPGNNTIVVPDDTTEALVGGGVPAM

SEQ ID NO: 39076 - protein, 227 aa, Symploca atlantica PCC 8002
HEVATGGQNELGFRFGRLIEAADWLMTYKYVIKNVAKKYGKTVTFMPKPVFNDNGSGMHCHQSIWKDGQPLFWGDGYANLSKMALNYIGGILRHAPALLALTNPTTNSYKRLVPGFEAPVNLAYSQGNRSASIRIPLSGTNPKAKRLEFRCPDATCNPYLAFAAMLCAGIDGIKNEIEPGESLDVDIYDLSPAELSKIPSTPGSLEAALESLEKDHSFLTDSGVFTE

SEQ ID NO: 39077 - protein, 215 aa, Oryza sativa Japonica Group
MAVLLITRLLTLVLGYAYPAYDCYKTLELNKPQIDQLRFWCQYWILLAFLTTLETITYFTVSWLPMYGEAKLALVLYLWYPKTRGAKHVYESYLQPVLARHEADIDRGLLQLRASAKDATASHLQAAVSLGPGLLRRSRRPRLVAAAGGEKQRRRRPRRPENRFAFSVTVDHQLVTIDAMIDTPGLHADQLQKRQKINPEEEEEDEDATVSKTRR

SEQ ID NO: 39078 - protein, 279 aa, Magnaporthe grisea 70-15
MSRPEDTLAADVHYNDTEARKYTTSSRIQNIQAAMTRRALELLELTSPSLILDVGCGSGLSGEILTAEDPADGGPHTWIGMDVSPSMLDVALQRDVAGDLMLADIGQGVPFRAGSFDAAISISAIQWLCNAESSDTSPLGRLSRFFNGLYASLRRGGRAVCQFYPKNDTQRDMIAGAAKKAGFAAGLLEDDPDTKNKKVYLVLTVGGSAHDGSGGDITDVVKGLDNVDVLDVSRKPKAGRDMRKGGKAWIVKKKEQMERKGKVVKASSKYTGRKRKPAF

SEQ ID NO: 39079 - protein, 455 aa, Bacillus pumilus SAFR-032
MHILVVGLDYKTAPVEIREQLSFEPSELGTAMSKLKEEKSILENIVISTCNRTEIYAVVDQLHTGRFYIKRFLADWFGLEKEDVSPYLKFYENDGAVEHLFRVACGLDSMVIGETQILGQVRSSFKVAQEEKTIGTVFNYLFKQAVTVAKRSHAETDIASNAVSVSYAAVELAKKIFGRLSDKHVLILGAGKMGELAAQNLQGQGIGQVTVINRTYEKAKELAGRFSGEPKSLNQLEKTLSEADILISSTGAKQFVITKEMVESANKKRKGRPLFMVDIAVPRDLDPAISEVEGAFLYDIDDLEGIVAANLKERRAVAEQVELLIEAEIVEFKQWLNTLGVVPVISALREKALTIQADTMQSIERKLPNLTHREMKLLNKHTKSIINQMLKDPILKAKEIAAEPNAEEKLLLFKEIFDLQVEDEEQKVEPVQVEQGSFQLFKPNMAQGFATVASE

SEQ ID NO: 39080 - protein, 402 aa, Pseudomonas putida KT2440
MANPGSPRRFARIDRLPPYVFNITAELKMAARRRGEDIIDLSMGNPDGATPPHIVEKLVQVAQREDTHGYSTSRGIPRLRRAISNWYKDRYEVDIDPESEAIVTIGSKEGLAHLMLATLDQGDTVLVPNPSYPIHIYGAVIAGAQVRSVPLVPGVDFFNELERAIRESIPKPKMMILGFPSNPTAQCVELDFFERVVALAKQYNVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNLLVKGLHELGWMVENPKASMYVWAKIPPEYAHLGSLEFSKKLLAETKVCVSPGIGFGDYGDDHVRFALIENQDRIRQAIRGIRQMFRADGLARK

SEQ ID NO: 39081 - protein, 180 aa, Vitis vinifera
MAISLSLCSNIIRQRQRHTPESVRPVPIRILTVGKKRSRGVQLIVDEYIEKLKYYCSPDDIQIRSNPKNARDVKAQVENEDTAVMGLIRPDDWVVMLDEHGLDLGSIQMAELLRDVGNTGAARLSFCIGGPYGHGEQLRKRANISIKLSSMVLNHQIALLVLMEQLYRAWTILKGQKYHH

SEQ ID NO: 39082 - protein, 315 aa, Bartonella bacilliformis
MAVEAHAPPALARARVGNGLRTGVKVIDIFTPLCFGQRIGIFSGSGVGKSTLLSMMMQADHFDKVVLALTGERGREVRDMLDDTLQDKLDKVVAVIATSDESPMMRRLAPIMATTIAEYFSSLGDNVLLVVDSITRYALAVREIAISAHEPPVSRGFPPRVFSELPRLLERAGPGRKGKGSITGVYAVLVDGDDHNDPIADAIRGILDGHIVLDRAIAAQGRFPAVDISSSISRLASHSWTGEQRILVQSLKEMIFRYEETRDLRAMGAYRPGTDHILDQAVHLVPSIYAAMNQNIDTPLVRNPYDELAKLLKSQ

SEQ ID NO: 39083 - protein, 90 aa, Mycoplasma genitalium
LVIAYEPLWAIGTGKTATPEVANQTIKTIREYINDLYDENVANNISILYGGSVDHNNIQKLAIMEQIDGFLVGKASLEIKNFLEMARVYA

SEQ ID NO: 39084 - protein, 194 aa, Karenia brevis
  misc_feature (29)..(29): Xaa can be any naturally occurring amino acid
  misc_feature (70)..(70): Xaa can be any naturally occurring amino acid
SLVQTLQPGKSLVAAGYCMYSSSTVMVMXPANGVNGFTLDPKFGEFVLTHPDIKIPKRGKIYSINEANYXDWDPALQTYISNLKAGKGESGQKYSARYIGSMVGDVHRTLLYGGLFGYPGDAKNPNGKLRLLYEGGPMSFLLEQAGGKSTTGSQRVMDITPASVHQRVPVFLGSPDDVDEVTKVYKEAGIEKNY

SEQ ID NO: 39085 - protein, 356 aa, Olimarabidopsis pumila
MEKGEDSSTFKMGNSAQERSLPYVPDCYVVPPSCEPCDSNSDVVPTIDVSRLKGVDDDRREVIRELSLACQRLGFFQIVNHGINQNILDDALEVAKGFFELPAKEKKKFMSNDVYAPIRYSTSLKDGLDKIQYWRIFLKHYAHPLHRWIHLWPENPPEYREKMGKFCEEVRKLSIEIMGAITESLGLGRNYMSSRMDENGMQVMAVNCYPPCPDPETALGLPPHSDYSCITILLQNLAGLKIFNPMAHGGSGGWVVVPQVTGALKVHIGDHVEVLSNGLYKSVVHKVTLNEENMRISLASLHSLGMDDKMSVPCELVNHENPVRYRESSFNDFLDFLVKNDISQGDRFIDTLRIKD

SEQ ID NO: 39086 - protein, 590 aa, Xylella fastidiosa Ann-1
MPHSAHRPTPTLHTQMNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGELLLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDAHYVPMLLALGLTEFSLHPATLLEVRRVIRNSDLGTLKTSVTTLLRARDRKSIEEWMAAHANTTPT

SEQ ID NO: 39087 - protein, 357 aa, Photobacterium profundum SS9
MLLTIDVNYSRIVSGYSHFLFFDMNRLQTATTDSNLMANPPTVKQNKIAIIGECMIELSGKPFASQAQNFGGDTLNTAVYLSRLLPSLRPSYVTAVGADTYSKIMLSAWESEGVDTSLTLVNPDKLPGMYAIEIDDDGERSFHYWRDDSAARYLCEHEGFNDVVSSLKSVDLVYLSGISLAILSDHGKVKLLNTLAQLKSSGVKIAVDSNYRPRLWRNATDACEWLGKLYQLSDIALVTADDEELLLGRKLSEPQVIARRLHSLGIKQVVVKLGSDGAMWSQAGNQGVVSGNKVTQVIDTTAAGDSFNAAYLAAWCSGMEMAECCYWGNKLAAQVIQHKGAIIPVEQTRYITELMSD

SEQ ID NO: 39088 - protein, 164 aa, Mycoplasma gallisepticum R
MFHNQTYNKDKMKKYKKKPIEVLKKELTPLQFDVTQNSATERPYTNEYDQNFKKGIYVDITTGEPLFLSTDKYDSGCGWPAFSHPIAKSLINEVKDLSHNMVRVEVRAKNSDSHLGHVFTDGPTDKGGLRYCINSASLKFIPYEDLKKAGYEEFIAILDQEAKH

SEQ ID NO: 39089 - protein, 590 aa, Oryza sativa Japonica Group
MEQYEVLEQIGKGAFGSALLVRHKVEKKKYVLKKIRLARQTDRTRRSAHQEMQLIATVRNPFIVEYKDSWVEKGCYVCIIIGYCEGGDMAEAIKRATGDHFSEEKLCKWLVQLLMALDYLHANHILHRDVKCSNIFLTRDQSIRLGDFGLAKILTSDDLASSVVGTPSYMCPELLADIPYGTKSDIWSLGCCIYEMTALRPAFKAFDMQALISKITKSIVSPLPTRYSGAFFASFFSLQAAELLKHPHLQPYVLQVHLKSSPARNIIPSHQSPIDKVKKMTFPTESMCRSKGRRNSLGNERIVTFSKPSPERKFTSSIQSIKDYSTTRSVKDLSIDVSLVEEVSSKTTFTTRTSSIVKTPKRTPSKTITTPQLEPPKVSYNRVNRSELLSRTPVNRSARVIRRASLPLPLPSSETPKRGVSSISILEQLESPDVSVNSPRIDRIAEFPLASSEDPPFLKLHGRRSPTPTPQHCVIDQSITKDKCMVEAFHIIDVDDDDGRSDSSSGRNNAAAAASSRAGSSESTRQRRFDTSSYQQRAEALEGLLEFSAQLLQQERYDELGVLLKPFGPEKVSPRETAIWLTKSFKETGL

SEQ ID NO: 39090 - protein, 429 aa, Pseudomonas syringae pv. phaseolicola 1448A
MRAELNNGLIDFLKASPTPFHATATLVQHFEAAGFQRLDERDTWAIETGGRYFVTRNDSSIVAFRMGRQSPLTGGIRMVGAHTDSPCLRVKPQPELQRQGFWQLGVEVYGGALLAPWFDRDLSLAGRVTFRRDGKVESQLIDFKLPIAVIPNLAIHLNRTANEGWAINAQNELPPILAQVAGDERADFRALLTDQLAREHGLNADVVLDYELSFYDTQSAAVVGLNGDFLAGARLDNLLSCYAGMQALLNSESDETALLVCTDHEEVGSSSTCGADGAMLEQIVQRLLPSSEDYVRTIQKSLLISADNAHGIHPNYAEKHDANHGPKLNAGPVIKVNSNQRYATNSETAGFFRHLCMAEEVPVQSFVVRSDMACGSTIGPITASHLGIRTVDIGLPTFAMHSIRELAGSHDLAHLVKVLSAFYASHELP

SEQ ID NO: 39091 - protein, 227 aa, Tolypothrix sp. PCC 7101
HEVATGGQCELGFRFGKLIEAADWLMTYKYVIKNVAKKYGRTVTFMPKPIFGDNGSGMHCHQSIWKDGKPLFGGDKYAGLSDMALYYIGGILKHAPALLGITNPTTNSYKRLVPGYEAPVNLAYSQGNRSASVRIPLSGSNPKAKRLEFRCPDATSNPYLAFAAMLCVGIDGIKNKIHPGEPLDRNIYELSPEELAKVPSTPGSLELALEALENDHAFLTESGVFTE

SEQ ID NO: 39092 - protein, 162 aa, Salmonella typhimurium LT2
MLEDLRANSWSLRPCCMVLAYRIAHFCSVWRKKNVLNNLWAAPVLVLYRVITECLFGYEIQAAATIGRRFTIHHGYAVVINKHVVAGDDFTIRHGVTIGNRGADSLACPVIGNGVELGANVILLGDITIGNHVTIGAGSVVLDSIPDHALVVGEKARVKVST

SEQ ID NO: 39093 - protein, 508 aa, Mycoplasma gallisepticum R
MNKKHKDFDLNFLKKTKIVATCGPSITYKLFSLADLEDPSKQEIVQKAKENLRQLFLNGVSTVRLNFSHGNQEEQAVRMILARSVANELNLPISIMLDTNGPEIRLNQISETDNTVKKDQIVKIYTNREIVGNATEFSVSDSSKKYNMAKDVSLGSIVLVDDGKLTLQVIEVAEDFSYIRAIAKNEHKIITKKRINLPNAKYSIPFLSQKDYNDITFGLKNKVDYIAASFVNSADDIYEIKAILKQYGMEHVQVIAKVETRHAIKNLDEIIDVSDGVMVARGDLGLEIPYYEVPYWEKYIIKACRFKNKRVIVATQMLDSLEKNVQPTRAEVTDVFFAVERGCDATMLSGETANGMYPIIAVETMKKINKQSELLFDYKRAITHYFPMTDVCKTAFGERVLDIAKKICPNREIENEDFSTHFLVHFTNNREEIFALSNAKLAASVIIVTDDQNVYTGHGVDYGVFTYKVDDLTKALSNYQLVAKKAILHYSELFEIKPDNKTNFVLLK

SEQ ID NO: 39094 - protein, 188 aa, Methylobacillus flagellatus KT
MVWNVPNSLTVMRILSIPVFIGIFYLPETTLPMHDKNVLATFIFAFAAITDWFDGYLARALNQTSAFGAFLDPVADKLMVAAALILLIELDRVGAVVALIIIGREIAISALREWMAGLGERGSVAVAFIGKVKTAVQMAAILLLLYYDPLGPLHVSFYGEVLIYIAAFLTLVSMAYYLKAAWPRMKAG

SEQ ID NO: 39095 - protein, 256 aa, Oryza sativa
  misc_feature (182)..(182): Xaa can be any naturally occurring amino acid
  misc_feature (216)..(216): Xaa can be any naturally occurring amino acid
  misc_feature (227)..(227): Xaa can be any naturally occurring amino acid
MTTTNSDLAKELIEKGKKTSAYMAIDENLNKDIKVMGIGSGSTIVYAVERLAERIKNENLDICCIPSSYQSKQLLVKYNIPVSDLETFTSIDLTIDGADEIDKDLTCIKGGGGCHLQEKLVAHCAKNFILIADSRKRSTKLGQNWQNGIPIEVLPLAHRLVRETIENLYGGKAILRESAVLXGKAGPVVTDNGNFILDWKFETKDDNDNVNYDWEXINTSIKNDPGXVLRPGLFIGMAKMAYIGNWDGSVTKLIHK

SEQ ID NO: 39096 - protein, 1448 aa, Aspergillus oryzae
MSSKFEVAPDVDPGTQIDTYPDHEDDTLSDTSSSVSSDEKQERQSLSRIASSRLGQVLSATHAKNEPQLDPNSPEFDHRRWAQFVLRRMHECGIEPPQQGVVFKDLQVSGSGSALQYQETVLSTFAIPFRTAARAIAGQKRMPRRQILRGFDGLLEGGELLLVLGRPGSGCSTLLKTICGRMGGLTLEPESTIHYNGVGYEDMIKHHRGEIAYNKEVDEHFPHLTVGQTLSFAAHARAPRRRIEGVTRTEFADTMTKVVMSVYGLSHTVNTKVGDNFIRGVSGGERKRVSIAEMFLSNCRIGAWDNSTRGLDAASALKFVRALRLSADMSNSCHAVAAYQASQSMYDLFEKVVVLYEGYEIYFGRCDAAVEYFQRMGWERPEKQVSPDFLTAITNPLERRARPGMEDKVPRSAKEFSEYWKRSVEYQNLRTEIGRYVQEHAPNSEAAQILRQVHEEKQARHTRTNSPYLLSIPMQIRLCVRRANQRLRNDLPTAMSTVVVQTILSLIIGSVFYNSPNSSNAFFQKGAVLYFSVLMNALITIGEIMQLYAQRPIVEKQAAYAFVHPFTEALASALVDLPIKILRCSVFSIILYFLANLRREPSQFFIFYLLLICTILTMSGMFRSLASLTQTVGQAMALAGILVLCIVVYTGFTLPQPYMHPWLSWIRWINPVYYAFEALVSNEFHGRNFECTSYIPSYGTETSFICSVVGAVAGERFVSGDAFIQQNYQYSYSHLWRNFGILIAFLIFFHVLYLTATEFISADKSTAEALVFRPGHAPSHLQDGDGIEAEKTNPTTEVRADADSIRLPEQKDILSWKSVCYDIPVKDGTRRLLDNVNGWVKPGTLTALMGVSGAGKTTLLDVLAQRVSIGVVTGDIFVNGKGLAANFPRRTGYVQQQDLHLETTTVREALRFSAMLRQPRSVSQQEKYDYVEQVIQVLGMEDYAEAVVGRLGEGLNVEQRKLLSIGVELAAKPTLLVFLDEPTSGLDSQSSWTICAFLKKLTNQGQAVLATIHQPSAMLFQTFDRLLFLAKGGKTVYFGDIGKDSRTLLDYFERNGGRICKEHENPAEYILETVSGDVDNNTPDWVKVWDESPEHKDVLAELDRLHSSRENDSASSNENAESKDEFAMPLHSQLYHVLRRVFQQYLRQPEYIFSKFILGIVSGLFIGFSFWKTDNTQQGFQNSLFSIFLLCTIFNTLVNQIMPKFVAQRALYEVRERPSRVYSWKVFILSQMIVEIPFQFGLGVCSWASFYWSVFGANQDSERRALIMLFIVQFFIYSASMAQFVVCAVGEPALASMIATLMFGLSFVFSGVMQPPPALPGFWIFMYRVSPFTYYIGGIGSTALHGRPVQCSSTELSVFDPPDGQTCGEYMAKYLNSAGGQLYNMNATFGCEYCAMDSADQYLAQRWIYWEDRWRNYGIFWAYFVFNIVGAITLYYLFRVRKISLKKS

SEQ ID NO: 39097 - protein, 227 aa, Nostoc sp. PCC 7906
HEVATGGQCELGFRFGKLIEAADWLMIYKYVIKNVAKKHGKTVTFMPKPIFGDNGSGMHCHQSIWKDGKPLFAGDQYAGLSQMALYYIGGLLKHAPALLAITNPSTNSYKRLVPGYEAPVNLAYSQGNRSASIRIPLSGTNPKAKRLEFRCPDATSNPYLAFAAMLCAGIDGIKNKIDPGSPLDKNIYELSPEELAKVPSTPGSLELALEALENDHAFLTESGVFTE

SEQ ID NO: 39098 - protein, 195 aa, Bacillus pumilus SAFR-032
MKVTKSDIVISAVKPEQYPSGGLPEIALAGRSNVGKSSFINSLINRKNLARTSSKPGKTQTLNFYIINDMLHFVDVPGYGFAKVSKTEREAWGRMIETYITMREELKAVVQIVDLRHKPSVDDVNMYEFLKYYGVPVIVIATKADKIPKGKWEKHAKVVKQTLDIAPSDELVLFSSETKKGKDEAWNAILAKINK

SEQ ID NO: 39099 - protein, 467 aa, Mycoplasma gallisepticum R
MVLNMYNYDLIVIGAGPGGYVAGEHAAKNGLKTLVIERGTYGGVCLNVGCIPTKTLLQSSKVKHYIEKAAEYGLDLVNNQLSVNWANILKRKEAVVNKLVNGVKTILKVAKADTIVGEARIVDGHTVTVNNQTFYITTKDIIVATGSSPRKLPLPGFDQGRAEGVIIESTKALELPQIPQSLVVIGGGVIGIEFAMLYASLGTKVTILQAVDRLCELLDQDASDFIAKRMKSLGVNVVYNAKILGYQNNAIIYEDNGTAYQLPSQYILESVGRVVNDQVFGSFNVARDDRNRIKLNDKLQTSTDSIYVIGDAAGQIMLAHYAYHQALYAVDTILNRKTKKLSSLTTPGCIYTYPEIATIGYTEQQLKEKNIEYVVSKMPMAVNGKAIADGSTEGFIKFMFGKKYGEILGCVLIASTASDMISEIALAMENELTVFELEQAIHPHPTIAEIISECAKQAIYNHFNKKH

SEQ ID NO: 39100 - protein, 141 aa, Oryza sativa Indica Group
MITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVPYGISINLVEVTWKSKLKAQGP

SEQ ID NO: 39101 - protein, 89 aa, Synechococcus elongatus PCC 6301
MARSLLRAFPIQQLLQQPQQTRSWELAEPVEGFESLTPVQGELTVRHGHSFLEVTATAETIVNLTCDRCLWLLQPPPPSQYAGANLATG

SEQ ID NO: 39102 - protein, 227 aa, Lyngbya aestuarii PCC 7419
HEVATGGQNELGFRFGTLIEAADNLMIYKYVIKNVAKKYGKTVTFMPKPLFNDNGSGMHCHQSIWKDGQPLFGGDKYAGFSEMDLHYIGGILRHAPALLALTNPTTNSYKRLVPGFEAPVNLAYSQGNRSASVRIPLSGDNPKAKRLEFRCPDATANPYLAFAAMLCAGIDGIKNKIDPGEPLDVDIYDLSPEELGKIPSTPGSLELALEALENDHAFLTESGVFSE

SEQ ID NO: 39103 - protein, 440 aa, Mycoplasma gallisepticum R
MFEYKFTDVGEGLHEGVVAQIYVKVGDTIKEGDPMFSVETDKVTTDLPAPEGGKVTAILASVGQTVHVGEVMLVLNGDGSSAPAAAPATPAFVAPTPAVTPAPTPAEAAPSGGGGGGGASVVGEVKVSNTLFGLFGDQRAASTPTPAPTPAFAPTPVPVATPLAQAVASDLNVNLHNVTPANGAKIFSSDVFASAQQSSPAASVAANDNETYKEITSIRKAIAKAMTTAHEEIPATVLTFNFDVTKLVSYRKQVKDAVLASYNVKLSFLPFLLKAITKAVVAHPIFNSHYDKASNRLVLKKKINLGIAVDTADGLMVPNIKSAQDKSVIELAREVNNLAEKARSKKIGLADLADGTISVTNFGSIGALFGTPIIKFPEVAIIATGTVEEKLARTPENQIVIKQIMPITIAADHRWIDGADIGRFAKTLKEIVENLNGLLI

SEQ ID NO: 39104 - protein, 75 aa, Synechococcus elongatus PCC 6301
MMEWEPEDELKESLPPDGSFDPQQWLYEQLCLALPLRNVCAEDCPGPAQPESESPPSVVDDRWLALAKLRDRLGE

SEQ ID NO: 39105 - protein, 227 aa, Anabaena cylindrica PCC 7122
HEVATGGQCELGFKFGKLIQAADWLMTYKYVIKNVAKKYGRTVTFMPKPVFGDNGSGMHCHQSIWKDGQPLFAGDKYAGLSETALHYIGGLLKHAPAVLAITNPTTNSYKRLVPGYEAPVNLAYSQGNRSASIRIPLSGTNPKAKRLEFRCPDATSNPYLAFAAMLCAGLDGIKNKIDPGEPLDKNIYELSPEELAKVPSTPGSLDAALEALEKDHAFLTEGGVFSE

SEQ ID NO: 39106 - protein, 245 aa, Oryza sativa Japonica Group
MAAPSSLASSHLSRLADLRRAGVAAAAPAHPQQLRLGCSRRRAQRVVAMAGSGKFFVGGNWKCNGTKDSVSKLVTELNAATLEPDVERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 39107 - protein, 365 aa, Bacillus pumilus SAFR-032
MKKKIALLPGDGIGPEVVTSAVAVLKETAAQFRHEFEFETALIGGIAIDEKNNPLPKETVDVCKSADAILLGAVGGPKWDQNPPELRPEKGLLAIRKQLDLFANIRPVKVFDSLSEASPLKQDHINGVDFVIVRELTGGLYFGEPSERYTDEEGKEAAVDTLLYTKEEIVRVLKEAFDMALTRRKKVTSVDKANVLASSKLWRDAVEEVASQYPDVEFEHMLVDNAAMQLIYKPAQFDVIVTENMFGDILSDEASMITGSLGMLPSASLSSTGLHLYEPIHGSAPDIAGQNVANPLATILSAASLLRTSFALEEEAAAIEEAVETVLASGKRTKDLSAKEGTYQTTEDITHAVVDALKQNVKTIV

SEQ ID NO: 39108 - protein, 143 aa, Oryza sativa Japonica Group
MARGGSGGGRWRRLNVRPDLASDQEGTRTLNLTVLRRLDPAVADILIIAAHVVLYSFDDNIHQWSRRPVEGSLFVVKRNTQPRFQFIVMNRKNTENLTEDLLGGFEYQVQVPYIMYHNAADEITGIWFYDPQECEQVGYLFSR

SEQ ID NO: 39109 - protein, 7178 aa, Streptomyces violaceusniger
MENEEKLRHYLKEVTKDLRQTRQRLEDIEAKSREPIAIIGMSCRFPGGIATPEALWDLVREGGDAVSDFPTDRGWDTEDLYDPAGGSGKSVTRYGGFLHGIADFDAALFGISPREAIAMDPQQRLMLETSWEAFERAGVHRDAVRGSRTGVFIGTNGQDYATLLSAARDEVQGHLGTGSAASVLSGRVAYTFGLEGPTVTVDTACSSSLIALHLAVQALRNGECELALAGGVTVMTTTNTFVELSKQGGLAPDGRSKAFAAAADGTGWGEGAGVLLVERLSDAERHGHPVLAVVCGTAANQDGASNGLTAPNGPAQRRVIRAALSNAQLSTGDVDVVEAHGTGTRLGDPIEAQALLDTYGQDREQPLWLGSVKSNLGHAQAAAGVAGASDGLAMRHGVLPRTLHVDEPTPHVDWSAGAIRLLTERTPWPETDRPRRAGVSAFGVSGTNAHVIVEQAPETEPIEPSRIEPVAVPCVLSGQGEAGLRAFAARLADVATEAHPGDLGWTLATTRSALSHRAVVIGSTPADLRSGLAAVAAGEPAPNVVEGVAGPDTGVVLVFPGQGSQWAGMAVELLDTSPAFARRFAECARALEAHLDWSIEDVVRSVPGAPSLDLIEVVQPVLFTMMVSLAELWSSYGITPSAVVGHSQGEIAAACVAGALSLEDAAKVVVLRSRLFAETLVGNGAIASVALPAEQLATRIEPWGERLAVAGVNGPAAATVAGDPQSLEEFVAACVADGVRARVVPATVASHGPQVEPLRERLLALLADVAPRQSTVPFYSTVTGGLLDTTELDADYWFWNARKPIDFLGALHALFADGHRFFVESSTHPALTMGIQDTADASGESVVVTGSLRRGEGGLAQFCSAVARLHVHGVRVDWPAAFGAARRVELPTYPFQRERYWLTPRPGHGDASALGLGALDHPLLGATAVLPESGGCLLTGRLSLATHPWLADHALSGVVLFPGAGFVELVLQAGLWLGCGVVEELTLEGPLVFSERGGVEVQVVVGGVGEGGVGGGGCRSVSVFSCRGGEWVRHAVGVLGVGAGVVSGVEVWPPVGAVRVGVEGVYEGLAERGYVYGPVFQGLRDAWRRGDEVFVEVAVPAEARGDAARCAIHPALLDAALHGVRFGDFVSDDDQAYVPFSWTGVTLNAVGATALRVTLSPAGRDAIALRATDTTGAPVLSARSLALRPLSAQQLDDTRGSRTDALHRVEWVDASGAVAAGGEVASRTEVVRVVSEGADVVGEAYGHVLGVLERVRAWVGDEDLAGERLVVVTRGAVDVGGGVEDVAGAAVWGLVRSAQSENPGRLVLVDTDDVEGVGGVLPGVLALGEEQVVVRSGVVRVPRLGRVRVSGEVSGVFGSGAVLVTGGTGVLGGVVSRHLVVRHGVSRLVLLSRRGAEAEGAAELRAELEGAGAEVVIAACDAADGEALAGVLAGLPEGFALSGVVHAAGVLDDGLLTSLTRERVEPVLRAKVDAAWNLHELTAGMNLSALVFFSSAAGVLGNAGQSSYAAANGFLDALAAHRRARGLPAVSIAWGFWEERSELTKHLSADDLARAHAVPMPTSQALDLFDAALAADEAMVLAAPLDPRAWSDADNPPAVLRDLVRPRIRRAAEVVDASGSASALEHRLAAVDRSEWDQVVRELVRNHIAAVLRHASAESVDTSRTFQEIGFDSLTAVELRNRISAATGVRLPATAVFDYPTPRALADHLLAEALGKDIGAAAATPAGAALVADDPIVIVGMSCRYPGGITSPEALWDLVRSGGDAISALPTDRGWDLDGLYDPDPDRPGRSYARSGGFVYDAAEFDAAFFGISPREAAAMDPQQRLLLEASWEAFERAGIPATSVKGERIGVFTGVMHHDYLTRLSITPDGVEGYLGTGAAAGVASGRVAYTFGLEGPAVTVDTACSSSLVALHLAIQALRLGECSLALAGGVTVMSTPTVFVEFSRQRGLASDGKCKAFAGAADGTGFAEGIGMLLVERLSDARRNGHPVLAVVRGSAVNQDGASNGLTAPNGPSQQRVIRQALASAGLSAVDVDAVEAHGTGTTLGDPIEAQALLATYGQGRDADRPLLLGSIKSNIGHTQAAAGVAGVIKMVMAMGHGVLPQTLHIDEPTPHVDWSTGAVRLLGEHTEWPEAGRPRRAGVSSFGISGTNAHLILEQAPLPTTAERPDDAEPGDAKSGDVRPGDVRPDDVRPRAAGPGAVVPWILSGRDRRALRAQAERLRAHVASHPDLSVADIGFSLLTSRAVLEHRAVVLGGDHAELSAGLTALAQDEPAPGVVEALDAAEPGRKVVFVFPGQGSQWAGMALELLESAPVFARRMGECAEALAPLVEWSLPDVLADERALGRVDVVQPVLWAVMVSLAELWRSYGVAPSAVVGHSQGEIAAACVAGGLSLADGARVVVLRGKALLALSGRGGMVSVPVPADRLRDRPGVSIAAVNGPSSTVVSGGDEALDAVLVEFPAAKRIPVDYASHSPQIDGIRDELLKALAPIEPRTAAIPFHSTVTGRPIDTAELDADYWYRNLRETVELERVTRAAVEDGHHTFIEISPHPVLTTGLRETLDDADAHGGLVLASLRRDDGGLTRFRTALAEAYAYGVEVDWLSVFPGARRVELPTYAFQRERYWLDAPTAEAPTSAIDAEFWAAVEREDLESLAATLRVDGQPLREVLPALSQWRRERRDVSTIDSWRYKIRWKPLTPPATCPTGTWLVVVSHAEAEHEWVAGVTGALTRHGAEPLVVVLGEPELDRAALAARLGAALADTPRVSGVVSLTALDESPHPAYPSVPQGYAMTLLLSQALGDAGVEAPLWCLTQRGVSLGDGGGNRGGAGGRGDEGNGSGNGNSTGSGSGNGPGEGDGDRDVAVSRKQALTWGLGKVIALEQPLRWGGLIDLPEGVAPYAQDYLVGVLAGTSDEDQVAIRPTGLFGRRLAHAPAPERGGAWQPRGTVLVTGGTGALGGHVARWLAAQGAEHVVLTSRRGMAAPGAERLAGELEALGARVTVAACDVGDRDALAALLTEVGPLTAVVHTAAVLDDATLNSLTTEQLQRVLRVKTDGAVHLHELTRDMELSAFVLFSSLSGTLGAPGQGNYAPGHVFVDTLAEQRRAEGLVATSIAWGLWAGDGMGEGGVGEVARRHGVPEMAPEMAVAAMARAVEQDDTVVTVAEIDWDRHYVAFTATRPSPLLSDLPEVRALIDAGVGQESAEPGHERSEFAERLAGMADADRNRALLDLVRRHVAVVLGHTGPDAIDPGRAFHEIGFDSVTAVELRNRLNRATGLRLPATVTFDQPTPLAMARYLRGELLHDGQDRSAPARPVRTTGAVDDEPIAIVGMSCRFPGDVASPEDLWRLLADGSDAIGEFPENRGWDTAHLFHPDPDHRGTSSTRAAAFVSGAGEFDAGFFGISPREAVAMDPQQRLLLEVSWEALERAGIDPSTLRGSETGVFTGTNGQDYASLLKADETGDFEGRVGTGNSASVMSGRISYVLGLEGPALTVDTACSSSLVALHLAVRALRSGECSLALAGGASVMTTTGIFVEFSRQRALAADGRCKAFAAGADGTGWGEGVGMLVVERLSDAERNGHRVLAVVRGSAVNQDGASNGLTAPNGPSQQRVIRQALASAGLSAVDVDVVEAHGTGTTLGDPIEAQALLATYGQGRDVDRPLLLGSIKSNIGHTQAAAGVAGVIKMVMAMGHGVLPQTLHIDEPTPHVDWSTGAVRLLDEQTDWPETARPRRAGVSAFGVSGTNAHVILEQAPAPTAEPELSPERDETRAVPWVVTGASEAGVRAQAARLMAFVDDRPELRPVDIGWSLVSTRAALPHRAVVVGGDRDELVRELEAVAGGSAAIGEARTHSGVVFVFPGQGSQWVGMALELVESSSVFAGRLGECADVLAPLVEWSLWDVLGDEVALSRVDVVQPVLWAVMVSLAELWRSFGVVPSVVVGHSQGEIAAACVAGGLSLEDGARVVALRSRALLALSGRGGMVSVPVPADRLRDRPGLSVAAVNGPVSTVVSGSVEALDAVLEEFPEAKRIPVEYASHSVQVEEIREGLAEALASVRPRTGEVPFYSTVTGRLMDTVELDAEYWYRNLRETVEFRSAVEGLLELGHTVFVEASPHPVLTVGIQDTADATDTTHTDILVTGSLRRDDGGLVRFLSTVGRLFTAGVPVEWQPLFAAAGARRVDLPTYAFQHEWFWLDPVRGASDVGGAGLAGLAHPLVSAVLPLPESDGCVLTGSLSSATHPWLRDHAVLDKVLLPGTGFVELALQAGLHLGCRTLDELTLQAPLVLPAHGDVQIQVAVGGPDDSGRRPVTVYSRPGQDRTWVRHATGSVSPGGETATVDRTVWPPVDATPVDLTGVYAEMNTRGYAYGPVFQGLRAAWRRGDEVFAEVVLSETAESDAGRCAVHPALLDAALHGAGLGTFVTEPGRPHLPFAWTGVSLHAVGATTLRVVLSPAGPDAISLLAMDGTGAPVLTADSLALRPVSGGTRGGAHNDSLFRVDWTELALAASDTSDEVAFPVVESLAQLTGPGAPQPVHGAVVFRPFATEASATEAPATEASVAGATDATGAADTTEENPEDVYALTSRVLEVAQAWLADDRFGDARLVVVTRGAVATRPGEDPESLAAAAVWGLIRTAQTENPGRFVLVDTVDEDPSVSSVSSVSSTSSVVSALPAVLATDEPQVAIRAGKALVPRLVRAASSALPVPAETDTWRLEADGQGTLENLVLAPHAEASRPLATHEIRVAVRAAGVNFRDVLLALGMYPDKAGLLGSEAAGTVLEIGSGVAGVAPGDRVMGLFSGAFGPVAITDHRLVAPIPAGWSFPQAAATPIAFLTAMYALIDLADVRSGESVLVHAAAGGVGMAAVQVARWLGAEVFATASPAKWDAVRACGVAQQRIASSRSTEFADRLRSDAPGGVDVVLNSLTGELLNASLGLLRPGGRLIEMGRTDLRDAEEVMARHGVSYRAFELLDAGPDRIGRLLTELLSLFRQGVFTPLPLRVQDVRQASDAFRHLSQARHIGKLALTIPRPLSGGTALITGGTGTLGGLVARHLVREHGVTELVLVGRRGDTAPGAAELLTELEAAGARVRVVACDVSDREATAALVASLPNLRSVVHTAGVLDDAVIGSLTPERLRTVLRPKADAAWHLHELTRDRDLAEFVLFSSAAGVLGGPGQGNYAAANAFLDALAARRRAQGLPATSLAWGFWEQRSGLTEHLTTDRLARSGVLPLSTDEGLALFDAARATGDTLLVPMRYEPSAPGPEPVPALLRGLVRAPLARALPGPADGVGNGVTEGLTGLAVDERLGVLLDLVRREAAAVLGHGGPQSVTPRRPFKELGFDSLSAVELRNRLRTATGRRLEATLIFDHPTPAALARHLDAELFGATDVAAPVPAPTVAHPADERIAIVGMSCRLPAGVDSPEALWTLLMSGTDAISELPTDRGWSLDALYDQDPSRPGTTYAKTGGFLKNAADFDAGFFTISPREALAADPQQRLWLEACWEAFERAGIDPLALKGTRTGVFAGAASTTYGAGQAAAPDGSEGYLLTGNSTSVISGRVAYTLGLEGPAVTVDTACSSSLVSVHWACESLRRGESTLALAGGVAVMTTPDLLVEFSRQRGLAPDGRCKSFAAAADGTGFAEGAGVLVLERLSDAERNGHQVLAVIRGSAVNQDGASNGLTAPNGPSQQRVIRQALANAGLASQEVDAVEAHGTGTTLGDPIEAQALLATYGQDRDPDRPLLLGSVKSNIGHTQAAAGAAGLIKMVLALRNGVLPRTLHVDEPSPHVDWSAGAMELLTEQTTWPDRDRPRRAGVSAFGVSGTNAHVILEQAPKPDENGEPDTGRSGLPAVPWVLSGAGAAGLRAQAQRLASFVRENPELDPVDVGWSLVATRAALSHRAVVVGADRTELLRELDAVQSVGAAEAGRDVVFVFPGQGSQWVGMALELVESSSVFAGRLGECADVLAPLVEWSLWDVLGDEVALSRVDVVQPVLWAVMVSLAELWRSFGVVPSVVVGHSQGEIAAACVAGGLSLEDGARVVALRSKALLALSGRGGMVSVPVSADQLRDRPGLSVAAVNGPVSSVVSGPVEVLDAVLEEFPEAKRIPVDYASHSSQVEEIRGELAEALVSVRPRTGEVPFYSTVTGRLMDTVELDGEYWYRNLRETVEFQSTVEHLMREGHTVFVEASPHPVLTVGIQDTADATVTDIVITGSLRRDEGGVRRFLTSLAEVSVRGVEVNWWTAFDGAGARRVDLPTYAFQRERFWLAPSTGTGDAYGLGLGAVDHPLLGAAVPLPDADGCVLTGALSLAGQPWLADHSVLGMVLLPGTAFVELALQAGARFGCDTLEELTLHEPLVLPEQETVQLQVSVGGPDDLGSRPFTVFSRREGDWTRHAGGTLCVGEHGDPPANPSVWPPADARPVDVAELHMTMAERGYQYGPAFQGLRKAWIRDSEVFLDVALPELVRGDAARCGVHPALLDAALQGIGLGAFVSEPGRAHLPFSWSGVTLHAVGATTVRVTLSPAGPDAVAIRMTDTIGAPVLSIDVLAMRPLAEQRLLEAGGPRGDALFRLDWTELPVPTGATGPRALSWGLLGGHDEPRLTAALTAVGVSPQRHRDLASIDQVPDVLVLPCLPEADDGPAPEATSSTLGRVLEVVREWLGDARYTDTRLVVLTRRAVATSTGDDVEDLAAAAVRGLLRTAQQENPDRLVVIDHDDSDLGVLPAVLATGEPEAAIRAGTVLVPRLVKAAVPDGKTPAWDTGTVLITGGTGTLGGLVARHLVTTHGARDLVLASRGGDTAPGAVELATELEALGASIRVAACDVADRAQLTALLDTIPALRAVVHTAGVVDDGVIGSMTADRVEAVLRPKANAAWHLHELTRRLDLDAFVLFSSATGVLGSAGQGNYAAANAFLDALAVHRRAQGLPAVSVAWGLWEQRSGLTAHLSEQDMARMTRTGAIPLSDERGLELFDAVCRSGEATLVATPLHLRAVAATGTVPPVLSALAPAPPRRATEAGDGGVALRQSLAELSGAEQSQAVRELVRGQVAAVLRHPDGSAIDPVRTFQEIGFDSLTAVELRNRLGASTGIRLAATAIFDYPTPATLAEHLLAEIVPETADPVAARLGELDKVAAMISAMGEDDTLREQLSSRMETIVAMWADLHRPERSSRVGRDLESASLDDMFGIIDQELDGS

SEQ ID NO: 39110 - protein, 608 aa, Ustilago maydis 521
MSTTPIHSTRNLLRAFPSRILPLLTTTAETKAKTKTKAVTVVPPSLSLNLQRPRRFQPISPLAVPRRTATTSSKIDPAAIASQLSSMPSTSKTPASEPTLFIDGKWTHAKAGHTRPIINPFDGSTVAVIDEAGSEDALAAVDSAARFFRTSSWPHQTCTSRTALLSKVADLLQRDKEILAEIETKDTGKTLQESKVDVDDVTNVFRFYAQEAKKLDTPKKIVSDVIPDSVESTTSHVPVGVCVLIAPWNYPLLQICWKVAPALVTGNAVIIKPSEVTPLSTVHFVKLLVEAGAPMGSVQLLTAGGASVGPALTEHADVDLVSFTGGLDTGRRIIASCATTVKRCTVELGGKNPNIVFADCDLEWAIDTVTTAVFLHSGQVCSSGARLIVEESIADKLVAGVAERAKRIKMGNGLDAASETGPLVSAAHLSKVEAYVQLGLEEGAKLVCGGARPDAKSHPELANGFFFCPTIFDRCHREMRIVQEETFGPILTVERFKDGDEEHAIWLANDTKYGLAGGVQSGNQERARRVAKRLRHGTVWVNTYGSYTPAAEWGGFGMSGNGRELGSKGLDEYIETKHEWVETKPAPPGWFKGQAEVLQPANVVKAKL

SEQ ID NO: 39111 - protein, 450 aa, Arabidopsis thaliana
MATLEDSFLADLDELSENEAELDENHGDVGKEEEDVDMDMADLETLNYDDLDSVSKLQKTQRYDDIMHKVEEALGKDSDDHEYKLIVDCNKLSVDIEDEIVIVHNFIKEKYKLRFQELESLVHHPIDYACVVKKIGNETDLTLVDFAGLDLTPAIIMAISVTASTTKGSALPEDVLEFVESKMGSIAPNLSAIVGSAVAAKLMGTAGGLSALAKMPACNVQVLGHKRKNLVGFSSATSQSRVGYLEQTEIFQSTPPGLEARAGRLVAAKSTLAARVDATREDPLGISGKAFREEIRKKIDKWQEPPPARQPKPLPIPHSEPKKRRGGRRLRKLKARYQVTDMRKLANRTAFGTPEESSLGDGLGEGYGMLGQAGSKRLRVSSVQSKLKINAKVAKKLKERQYAGGATTSGLTSSLAFTSMQGIELCNPQQALGLGSGAQSTSQSQEPSRS

SEQ ID NO: 39112 - protein, 475 aa, Erwinia carotovora subsp. atroseptica SCRI1043
MMSTEIKAQVVVLGAGPAGYSAAFRAADLGLETVLVERYSTLGGVCLNVGCIPSKALLHVAKVIEEAKALAEHGIVFGEPKTDIDKIRLWKEKVINQLTGGLAGMAKGRKVKVVNGLGKFTGANTLEVDGENGKTTINFDNAIIAAGSRPIQLPFIPHDDPRVWDSTDALELKSVPERLLVMGGGIIGLEMGTVYHALGSQIDVVEMFDQVIPAADKDVVKVFTKRISKQFNLMLETKVTAVEAKEDGIYVTMEGKKAPAEPQRYDAVLVAIGRVPNGKNLDAGKAGVEVDDRGFIHVDKQMRTNVPHIYAIGDIVGQPMLAHKGVHEGHVAAEVISGKKHYFDPKVIPSIAYTEPEVAWVGLTEKEAKEKGISYETAIFPWAASGRAIASDCAEGMTKLIFDKETHRVIGGAIVGTNGGELLGEIGLAIEMGCDAEDIALTIHAHPTLHESVGLAAEIFEGSITDLPNPKAKKK

SEQ ID NO: 39113 - protein, 411 aa, Oryza sativa Japonica Group
MAQQLSAPFRAAAAAGSRASAAAADPAKVLRLRSAGSAQFTSIAASSSFARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 39114 - protein, 629 aa, Pichia pastoris
MFVFEPVLLAVLVASTCVTAKTHTWNFTTGFVNANPDGVYERDDVIGLNGQWPLPVLEADKGDRIELYLTNGFEDYNTSLHFHGLFQNGTNSMDGPELITQCPIPPGETMLYNFTVDQVGAYWYHSHTAGQYGDGMRAAFIVHDGSDDDDFPYEYDEEFTFTISEWYHESSVDLIPNFMSRFNPTGAEPIPQNFLFNDTRNFTWNVEPSKTYKVNLINVGGFVSQYLWMEDHTFKVVQVDGVYTQPNETDMIYITVAQRYTVLIETKDDTSRNYALMQRVDDTMLDVIPKDLELNGTNYIVYNESAGLPEEYKVESLDIFLDDFWLEPLEAQEAYPDPDYQIVVDVAMDNLDDGVNYAFFNNLTYVAPKVPVLGTVFSAGEDAINPLVYGSNTNSFVLEKDEVIEIVLNNLDTGKHPFHLHGHVFQTVVRGPDYGEESTPVPYNASEAHDIPENPMRRDTVYVNPQSYFVIRFKADNPGVWFFHCHIEWHLDQGLALVLIEDPLSIQSQQNLDDNWKRMCEVNNMPYVGNAAANTENFLDLTDENVQVKNLPAGFTARGIVALVFSCIAGILGCVAIGLYGLAATDDNPVKLSQDLGIDEEFIQDETSSQLSHNGSKDTTEKTATELLN

SEQ ID NO: 39115 - protein, 183 aa, Photobacterium profundum SS9
MNTKQQQIAIVTGANGGIGKNYTRMMLDDGFRVVMAVRNEVAGSLVRDELLQSHPDAAIDILKVDMSSLSSIKAFSKQVKEKYSRIDVLAHNAGVYFFDNERRESTDGIELNLAVHVVGPYALTIQLLPLLKETQGSRVITMSSSEHHGAKIDLRDIQIKERFEEQGNMIAYSRSKWAGLGWH

SEQ ID NO: 39116 - protein, 2345 aa, Gibberella zeae
MSVDNKQVPGPVAIVGLACRFPGDATSPSKFWDLLKSGKDAYSETTDRYNAQAFYHPNSKRQNVLPVTGGHFLKQDPHVFDAAFFNITAAEAISLDPKQRIALEVAYEAFENAGKPLKQVAGTTTACFVGSSMSDYRDAVVRDFAHNPKYHVLGTCEEMIANRISHFFDIHGPSATVHTACSSSLVAIHLACQSLLSGDAEMALAGGVGMILTPDGTMQLNNLGFLNPEGHSRSFDKDAGGYGRGEGCGILVLKKLDKAIQDGDNIRAVIRASGVNSDGWTQGVTMPSSEAQAALIKHVYETRGLDYGATQYVEAHGTGTKAGDPVETGAIHRTIGQGASKNRKLWIGHLEAAAGVASVIKGVLAMENSLIPPNIHFASPNPEIPLDEWNMAVPTKLTPWPAARTKRMSVSGFGMGGTNGHVVLEAFNSTPQSILYGDAQYQPAHNGKRLFTFSSHDQAGLDRVSKSLVDHLDSLGPAGARPEYLADLGYSLSVGKSGLSWKTAHLAESLTELREKLSSPQSEHAVREPRSQPKIGFVFTGQGAQWARMGVEMLHRPVFKESVQRSTDYLQQLGCDWTPIVELSRAQKESRLTLPEISQPICSVLQIALVDELRSWGVAPVSVVGHSSGEIAAAYCIEALSHKDAIAVAYFRGKVSAGLNHLNGGMMAVGCSRAEAETLIDESDLQGGHVTVACVNSPSNVTLSGDVAPLDQLKGILEKRGIFARRLRVEVAYHSTHMNSVFADYTASIADIEPQSCPSHQPIMVSSVTNNQVDPALLGSYYWGRNLISPVLFSDTIKEMVSPADGNGQKAVDLLVEIGPHGALGGPIEQILSHFDIENVGYQSMLTRGQNAVETSLELATSLFLQGVAIDIQKVNGDSGCRLLTNLPPYPWNHSKKFRAESRLQRELIAQSTPTRSIIGAPVPKMNESQRVWRGFIRLDDEPWIRGHTVGTTVLFPGAGMVSIVLEAAQQMVDPGKVARAFRLRDVSFSAAMALPEDQATEVIIQMKPQLVATSGSTPATWWEFTVSSCAGTDQLRDNCRGLITIDYEGNTSQQMAHEDSQVVSGRISDYHQILEECPATYAKDRFYKHMMKAAWRYGETFQGVENCHPGDGKTVFDVKLIDIGETFSKGQLDRPFLIHGATLDAVFQGWLGSTYKNGTFEFDKPFVPTKIGEMEISFNVPSEAGYMMPGLCRSHRSGFNELSADTIMFDKDLSRVILSVIDFRTSELEMDGAATEETTVEVDPADITSKVLWDYSLSLMEPCDLKQVMGSIVAQNSLTDFVRMLLHDNPAANIVEFISRSDGLPNTYASKLPPGTILPTQIRYAVVDETEDVGDENAASSMLTIDALVDSVSASGATADIVVIPQGFQFQDNYAKILEPLAKVSKPNTTIVVAVDTPDTTVPLKAKGFQLLHSIQGTPSLEVFAGLTGEQEKPTNGIHKEEVVLLLPSMLSTVTKEFAEEVQLDLEGQGFSVSTESLAESIDDSTFDGKTCVSLLEVERPLLDSLSESDFQLIRKVVLTSQRILWVTHGESPSLALVDGFSRCIMSEIEGVKFQVLHLSEPTGLQHGPRLAAKVIASKASDNEFRDKDGLLQVARIFKGLTENENIRHHLHDDVRVTRLSNQEHPLRLTIGKPGLLDTLYFVDDERVLAPLADHEVEIQVKATGLNFRDVMASMALVPVKGLGQEASGIVLRTGRDATHLKPGDRVSTLDMGTHATVMRADHRVTVKIPDAMSFEEAAAVPVVHTTAYYALVRLAKLQRGQSVLIHAAAGGVGQAALQLANHLGLVVYATVGSDDKRKLLTDTYQVSEDHIFNSRDASFAKGIMRVTGGRGVDCVLNSLSGELLRVSWSCLATFGTFVEIGLRDITNNMLLDMRPFSKSTTFSFINMYTLFEEDPSALGDILEEVFKLLGGGILQTPSPMTVYPINQVEDAFRIMQQGKHRGKIVLSFPDDAQAPVLHVAKNSMKLDSQATYLFVGGLGGLGRSLAKEFVSCGAKNIAFISRSGDSTSEAKATIKEITSRGANVKAYAADISNETAFLNAMKECSREFPPIKGVVQMAMVLRDVVFEKMTYEEWKLPLKPKVQGSWNLHKYFDHERPLDFMVICSSSSGIYGYPSQAQYAAGNTYQDALAHYRRAQGLRAVSVNLGIMRDVGVLAEQGTSGNIKLWEEVLGIREPAFHALMKSLIKGQTDNNSEFPAQICTGLGTADIMATHGLAKPTYFQDPRFGPLAVTSLSSDASGDKQSTAMSISSQLSEASSKAKATEIITNALIGKVADILQMPQSEVDPGQPLYRYGVDSLVALEVRNWITREMKVNVALLEILAAVPMESFAGKLASTSKLVTVS

SEQ ID NO: 39117 - protein, 394 aa, Arabidopsis thaliana
  misc_feature (317)..(317): Xaa can be any naturally occurring amino acid
MAIMSDLPRDLLAEILSRVPLASLRSVRFTCKKWNDLSKDRSFLKKQIVEAKKKQLKSKEFEVIMMRNFRVYLTSVDLHNDVNPSFTPKGTLTSFSDDANQHQVDNVSSVFHCDGLLLCITKDLNFRLVVWNPYFGQTRWIQPRNSYHIKDIYAIGYDENKNHKILRLKDQYYDYDSHPRARICEFELYSFESNSWKVVLDVSPDWYIHSYHRGLSVKGNTYWYATEKHGYVNFLICFDFTTEKFGPRLPLPFNATESFTYDDVVTLSSVGEEQLALLFQSDATLMMEIWVTSKVDPTEVLWNKLFLAVDHDMIEFXYELKFVADAGSFFIDQKKNVVVVFDKDMNEHTHRGMAYIVGKNGYFKRVDIGEEAYTSCFPLVCSYVPSSVQIRQLT

SEQ ID NO: 39118 - protein, 255 aa, Zea mays
  misc_feature (122)..(122): Xaa can be any naturally occurring amino acid
  misc_feature (208)..(208): Xaa can be any naturally occurring amino acid
ASTAGLVSSARPCGRASEERDGVAIPREWVGLQQFPPATQTELHELLGKLKEEDVSTLTILVMGKGGVGKSSTVNSIVGERIATVSAFQSEGLRPMMWSRTRAGFTLNIIDTPGLIEGGYIXIEQAVDIIKRFLLGKTIDVLLYVDRLDAYRMDTLDGQVIRAITNSFGKDIWRKSLVVLTHAQLSPPDGIEYNDFFTRRSEALLRYXPDGTPWVPKLMKEITVVISNGSKPIHVDQKLIDGPNPNNRWKMFIPI

SEQ ID NO: 39119 - protein, 146 aa, Lactobacillus delbrueckii subsp. lactis
MEEFKLNDRNQIPKIGFGTYKIKGYQGARAISQAIENGYRLLDSAARYENEGALGKAIRSSSVARSQLFVTSKLPGAHHEYKAAINELEEGLLRSGLDYFDLYLIHWPNPLEDHYVEAWQALIDAQRFGLVRSIGVSNFEPGHIDR

SEQ ID NO: 39120 - protein, 526 aa, Bordetella parapertussis 12822
MSDTATAPTTAEPRTAPPARADLLAHYARKTLSAPVYDVALETPLQAAPRLSRQLDCRVLLKREDLQPVFSFKIRGAYNRVAQLSAEERRRGVIAASAGNHAQGLALAAARLGIPALIVMPRTAPELKIDGVLAHGAQVALHGDAFPAALAHAQALAEREGRVFIPPYDDPDVIAGQGTVGMEILRQHPGRLDAIFVPVGGGSLIAGVAAYVKHVRPEIRIIGVEPVDSNCLQAALAAGRRVVLDRVGTFADGVAVAQIGHHNFEICRDHVDEVICVTNDEICAAIKDIYDDTRSITEPAGALAVAGLRKYAERGEAAGRTLVAIDSGANINFDRLRHVAERAALGEQREALIAVTIPERPGSFKAFCAALGPRQITEFNYRYHPGDEAQIFVGVRTHPEHDRRDALLAGLRGQGFAVQDLSDDELAKLHVRHMVGGRANQIDDEQVFRFEFPERPGALFDFLSKLGGRWNITMFHYRNHGSADGRVVAGLQVPADERHLVPQALTRIGYPFRDETANPSYRLFIR

SEQ ID NO: 39121 - protein, 476 aa, Pyrococcus horikoshii OT3
MPKLIKERVPTPERPVEERIKDFDEVNLGYTWELALKEAERCLQCPVEYAPCIKGCPVNINIPGFIKALRENKDNPRKAVKEALRVIWACNSLPAITGRVCPQEDQCEGACVVGKVGDPVNIGKLERFVADYARQHGIDDELLMEEIKNIKKNGKKVAVIGAGPAGLTCAAELAKMGYDVTIYEALHEPGGVLAYGIPEFRLPKEILRKELKKLSILGVKIKTDHIVGRTVTIPELLKEYDAIFIGTGAGTPKLLKIPGINLNGIYSANEFLTRINLMKAYKFPEYDTPIIVGKRVIVIGAGNTAMDAARSALRLGAEVIIAYRRGEEDMTARIEEVQHAKEEGVKFMFFVNPVEFIGDENGRVKAVKFEKMKPLEERDSRGKRKIIGTGEYVTVETDTVVIAIGQTPNRIIWKTTPGLKVRENGTIVVDENLMTSIPGVFAGGDAIRGEATVILAMGDGRKAAKAIHEYLSKKSA

SEQ ID NO: 39122 - protein, 172 aa, Bacillus pumilus SAFR-032
MKRIIVLTVLNRSGVLNRITGLFTKRHYNIESITVGHSEIQDVSRITFVVHVDQEKDIEQLTKQLNKQIDVLKVTDITNQSIVQRELALIKVVSAPASRMEITGVIEPFRASIVDVSRESVVIQVTGESSKIEALIELLKPYGIKEVARTGTTAFARDNQQKPQQNKTISIV

SEQ ID NO: 39123 - protein, 400 aa, Dehalococcoides ethenogenes 195
MKAVILAAGEGSRMRPLTFTRPKVMLPIAGKPILEHLLLEVSAAGITEFILVVGYRDEQVRSYFADGARWGLKISYCQQTRQLGTAHALKQLEKQLQADFLVMNGDILAKSADIAALAASSETTLGVFEASDPRRLGVLETDGSRVKRIHEKSANPPTNLANAGLYFFTPRIFAAINNTPLSLRGEYEITASIQMLIDSGLAVGYRPLTYWQDVSYPWDLLDLNASMLKSLSQRICGQVEENAVIRGAVEIGEGSRVRSGAYLEGPVIIGKNCDIGPNCYIRPATSIGDNCRVGASVEIKNSIIMDNTKIPHLNYVGDSVIGQNCNLGAGTKLANLRFDGADITAGGVNTRRRKLGAVLGDGVETGINVSLNPGVLIGAGSRIGPGAVVSGVIEPNSYIG

SEQ ID NO: 39124 - protein, 198 aa, Prochlorococcus marinus str. NATL2A
MFLVIDNYDSFTYNLVQYLGELSSQHPIASEVRVERNDALTIKEIKDLNPDAILLSPGPGDPNQSGVCLDILSELSIEIPTLGVCLGHQAITQAFGGKIIRAKELMHGKTSNVLHRGTGIFKDLPNPLVATRYHSLIAERESFPECLEVIAWLEDETIMGISHKDYPHIYGVQFHPESVLTEAGHKLLSNFLDIATAT

SEQ ID NO: 39125 - protein, 126 aa, Kluyveromyces lactis NRRL Y-1140
MVKKQGSGSNATVSKFVQFSESLGTAYSSYLKEVNGNKQLLLIDSFLAFLVVLGVVQFLFVLLIRDNFPFNAFLSGFIICVGQFVLLVSLRLQLISPFEGISKQRAFGEFIVASLVLHFISVHFVN

SEQ ID NO: 39126 - protein, 197 aa, Pseudomonas lundensis
LGNTGTTPEDAESDRVWSAGLVIRDLPLVASNWRNTMSLSDYLKANNVVAIAGIDTRRLTRILREKGSQNGCIMAGDNISDEAAIAAARGFPGLKGMDLAKVVSTEKTYEWRSSVWNLATDSHPTIDASELPYHVVAYDYGVKWNILRMLVERGCRVTVVPAQTPASDVLALNPDGVFLSNGPGDPEPCDYAIKAIQ

SEQ ID NO: 39127 - protein, 211 aa, Pseudomonas fragi
QQIVTLTYPHVGNTGTTPEDAESDRVWSAGLVIRDLPLVASNWRNTMSLADYLKTNNVVAIAGIDTRRLTRILREKGAQNGCIMAGDNISEEAAIAAARGFPGLKGMDLAKVVSTEKAYEWRSSVWNLATDSHPTIEASELPYHVVAYDYGVKWNILRMLVERGCRVTVVPAQTPASDVLALNPDGVFLSNGPGDPEPCDYAITAIKQVLT

SEQ ID NO: 39128 - protein, 281 aa, Archaeoglobus fulgidus DSM 4304
MVKEVFESIEDYEKSLEERIQSGSMGYRKMFDLTGKVAIVTGATGGLGGPIALGLADFGCDVVVVGRRLEVLEKLKESIEKLGQRALAVKCDITSEEDVANLVNRTVEEFGRIDILVNCAGINIPKPAEEYPLEDWNKVMDANVTGVFLVCREVGKVMVKQNGGKIINVSSVRSSYGMPKNYIAYCSSKAAVNMITKQLACEWAKYNILVNAIAPTVIATPLTAHIMKDPELSKTMKSRILLGRWGYPDDLIGAVVFFASDASNFVTGQILYIDGGVTSWA

SEQ ID NO: 39129 - protein, 173 aa, Desulfococcus oleovorans Hxd3
MIYSKTVMDHFRNPRNVGVIENAAGVGEVGNPICGDMMTIYLDIQDDRIADIKFQTFGCGSAIAVSSMLTELAKGKTLEEAKKITNKDVAEALEGLPKNKLHCSNLGADALQMAIKDYEDRKAGKVRPELKRKESHDELHRVGDKCYCPYCDSEVSDGEKMCSACLSDLTEEH

SEQ ID NO: 39130 - protein, 387 aa, Desulfococcus oleovorans Hxd3
MSNIHLDHISVSPLLPEVQEAMIEVIRDFKGNPSSQNVAGELAAEKLEKARQSVADLINCDPREVVFVSGGTESINMAVKGVARANVEKGKHIVTSNIEHNAVNRSVKRLMHLGWKATSVAVNEKGRVAPDEVAKAIREDTILVSIMHSNNEIGTLQPIDEIAKITKEKKVLLHTDAVDSVGVIPFDVQQVGADLVSFASNPYYGPTGVGALYIRKGSRIWPIIDGGVQEHNRRAGTENLIGIVGMGVAAELAKRDMDRRVAHLKKLKALLVKELPNYIDEYYVNGDIDTSLPNLVSVSVKYVEGESLMLMLEDAGYTVSTRSACATGSLRASHVLMSIGLDHADAQGTLVITPGIDNTEEDILGFLKALRDITKALRDISPLYKNR

SEQ ID NO: 39131 - protein, 625 aa, Erwinia carotovora subsp. atroseptica SCRI1043
MAIEINVPDIGADEVEVTEVLVKVGDKVEAEQSLITVEGDKASMEVPSPQAGVVKEIKVSVGDKVETGKLIMIFDSADGAADAAPAKAEEKKEAAPAAAPAASAAKEVNVPDIGGDEVEVTEVLVKVGDTVAAEQSLITVEGDKASMEVPAPFAGTVKEIKISNGDKVSTGSLIMVFEVAGSAPAASAEKTEAAPAAAPAASAAKEVNVPDIGGDEVEVTEVMVKVGDKIAAEQSLITVEGDKASMEVPAPFAGTVKEIKISTGDKVKTGSLIMVFEVEGAAPAPAAKQEAAAPAPTAKSAAAPAAKAEGKGEFAENDAYVHATPVIRRLAREFGVNLAKVKGSGRKGRILREDVQAYVKDAVKRAEAAPTAAAGGGLPGMLPWPKVDFSKFGEVEEVELGRIQKISGANLSRNWVMIPHVTHFDKTDITDLEAFRKQQNVEAEKRRLDVKITPVVFIMKAVAAALEQMPRFNSSLSEDAQRLTLKKYINIGVAVDTPNGLVVPVFKDVNKKGIVELSRELMAISKKARDGKLTAGEMQGGCFTISSLGGIGTTHFAPIVNAPEVAILGVSKSAMEPVWNGKEFTPRLMMPMSLSFDHRVIDGADGARFITIINNTLSDIRRLVM

SEQ ID NO: 39132 - protein, 261 aa, Pseudomonas putida KT2440
MFERLREDIQSVFHRDPAARNAFEVLTCYPGMHAIWLHRLGNALWRRDFKWLARLVSNFGRWLTGIEIHPGATIGRRFFIDHGMGIVIGETAEIGDDVTLYQGVTLGGTSWNKGKRHPTLENGVVVGAGAKVLGPFTVGAGAKIGSNAVVTKAVPAGATAVGIPGRIIVKSEDTEVEAKRKAMAEKIGFDAYGVSGDMPDPVARAIGQMLDHLQAVDERLEGMCGALTKMGSDYCAKELPALPEDDFSEAAQVAQRDTQPH

SEQ ID NO: 39133 - protein, 352 aa, Cochliobolus heterostrophus
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAIFPKTNDLALDLLERLLAFNPVKRISVEDALKHPYLEPYHDPDDEPGADPIPEEFFDFDKNKDNLTKEQLKLLIYQEIMR

SEQ ID NO: 39134 - protein, 452 aa, Erwinia carotovora subsp. atroseptica SCRI1043
MDNQQTDGTLKRGLKNRHIQLIALGGAVGTGLFLGIAQTIKMAGPSVLLGYAIGGLIAFLIMRQLGEMVVEEPVAGSFSHFAYKYWGDFAGFASGWNYWVLYVLVAMAELSAVGIYVQYWWPDIPTWVSAAVFFLLINAINLANVKVYGEMEFWFAIIKVAAIIGMIAFGGWLLISGTGGPEATVTNLWAQGGFFPNGGLGLVMAMAVIMFSFGGLELVGITAAEADDPEKSIPRATNQVIYRILIFYIGSLAILLSLYPWGKVVEGGSPFVMIFHELNSNVVATILNVVVLTAALSVYNSCVYCNSRMLFGLAKQGNGPKVLETIDSRGVPVVAIGISALATALCVLINYLIPGKAFELLMALVVSALVINWAMISLAHLKFRAQKDKEGTVTKFKALLYPLGNYICLLFLAGILVIMFLTPGIQISVMLIPVWLIILGVGYFIKKKNQAK

SEQ ID NO: 39135 - protein, 178 aa, Triticum aestivum
  misc_feature (124)..(124): Xaa can be any naturally occurring amino acid
  misc_feature (126)..(126): Xaa can be any naturally occurring amino acid
MLRGPQSRLVAPGLRRLLGPGAWESRAAPGLAAAGAGARAYQEPVVGHYNNPRNVGSFDKDDPNVGTGLVGAPACGDVMKLQIRVDEGTGKIVDACFKTFGCGSAIASSSVATEWVKGKQMEEXVXIKNTEIAKPLSLPPVKLHCSMLAEDPIKAAVKDYESKKAKLGDSPAEKAAEA

SEQ ID NO: 39136 - protein, 323 aa, Xanthomonas campestris pv. vesicatoria str. 85-10
MAMWCVATTAGAQQSAAAVQSTLASVQAEKVVVSTDVGDDIDDAFALGLLLRRPQLQVLGIASAWGDTALRAQLLQRLLQQAGRSEIPLAAGARTTSTIAFSQARWAAKGQLPAALPDAAAMILQQARQHPGEVTLMVLGPMTDAALAQQRDPAGFAKLKRVVAMGGSVRVGYGKSAYRPASAPAPEYNILADVPAAQRVFSSGVPIVLLPLDATQITLEEPERIALFAHGDGLTDALTQLYYQWRNTDQPWASATPTLFDVVPVAWLLRPALCPTTPLHLDVDAQGYTREGAGAPNVQACLHVDKPALIEMYMRALLELHGE

SEQ ID NO: 39137 - protein, 128 aa, Pseudomonas putida KT2440
MAYSEKVIDHYENPRNVGKMNAEDPDVGTGMVGAPACGDVMRLQIKVNEQGVIEDAKFKTYGCGSAIASSSLATEWMKGKTLDEAETIKNTQLAEELALPPVKIHCSVLAEDAIKAAVRDYKQKKGLI

SEQ ID NO: 39138 - protein, 158 aa, Zea mays
  misc_feature (29)..(29): Xaa can be any naturally occurring amino acid
  misc_feature (140)..(140): Xaa can be any naturally occurring amino acid
MQYLLQVKFRQGRARFMRKFEGCWTIEPXFVDKELCLPLNPHSLEEYESCTSGKGRVGSAITLDQLIEPALLPPPPISWYLRGITTRTTEMLVNDLIAETARLRTISNNASAKQGTEETCDANIGDPARECGDIKERWRXRRKSGRHGSSLRLTSLFL

SEQ ID NO: 39139 - protein, 366 aa, Arabidopsis arenosa
MEKGEDSSTFKMGNSAPGPAQKIIGPCAMSLPYVPDCYVVPPSCEPCDSNSEIVPTIDVSRLKGGDDERRGVIRELSLACQHLGFFQIVNHGINQNILDDALEVARRFFELPAKEKKKFMSNDVYAPVRYSTSLKDGLDKIQFWRIFLKHYAHPLHRWIHLWPENPPGYREKMGKFCEEVKELSIEIMGAITESLGLGRDYLSSRMDENGMQVMTVNCYPPCPDPETALGLPPHSDYSCITILLQNLAGLKIFDPMAHGGSGRWVAVPEVTGVLKVHIGDHVEVLSNGLYKSIVHKVTLNEENTRISLASLHSLGMDDKMSVPCELVTDENPVRYKESSFKDFLDFLVKNDISQGDRFIDTLRIKD

SEQ ID NO: 39140 - protein, 379 aa, Oryza sativa
  misc_feature (336)..(336): Xaa can be any naturally occurring amino acid
LLFFFSVLIPVAVSLLFPCAYVLIWHRKGQILCYLLCNKTRSRNESNIQKLIVSYGSLAPKRYKYSEVAKITSFLSNKLGEGGYGVVFKGKLQDGRLVAVKFLHDSKGNGEEFVNEVMSIGRTSHVNIVSLFGFCLEGSKRALIYDYMPNSSLDNYIYSEKPKETLGWEKLYDIAIGIARGLEYLHHGCNTRIVHFDIKPQNILLDQDFCPKIADFGLAKLCCTKESKLSMTGARGTIGFIAPEVLYRSFGVVSIKSDVYSYGMMLLEMIGGRKNVKSMVQNSSEKYFPDWIYDHFYQGDGLQACEVTSEVEGIAKKMTLIGLWCVQVLPMHRPTXQVLDMFEKALDELDMPPKQSFCETVRHLIIFPLFCAVWYKHSP

SEQ ID NO: 39141 - protein, 326 aa, Triticum aestivum
MELGAAGMRRSASHNSLSGSDDFDLTHLLNKPRINVERQRSFDDRSLSDVSYSGGHARGGGGFDGMYSPGGGLRSLVGTPASSALHSFRQPSYFWLDFQQLNDIYRYKTEEYFHTAVNKFNVIPDSIPDWLFDFMPCEGGFFVGNVSPARMDFRWFALGNMIAIVSSLATPEQSMAIMDLIEERWEELIGEMPLKICYPAIENHEWRIVTGCDPKNTRWSYHNGGSWPVLLWLLTAASIKTGRPQIARRAIDLAERRLLKDGWPEYYDGKLGKYVGKQARKFQTWSIAGYLVAKMLLEDPSHLGMIALEEDKAMKPVLRRSASWTN

SEQ ID NO: 39142 - protein, 367 aa, Glycine max
MEEEAGIYRLAEDSLRQIFCRLPLREIMICRSVSKFFLQLLSTPSFLQVLSSSHPPLQLLALRNRHHTPSHTSLPLFDPATKSWLHFPLDFLPFHSPLPVASSLGLLYLWAHNNSNSNSKSLICCNPLTRTFRVLPHLGSAWSRHGSVLVDSEDRVMVLTELAALYCHRNTTTWLKFSSNLPSKPRSSLLINDSAFALCDVGSPWRNRWKLFSCTIKSTTTSVVPVWSPLDRHEWGDVFDVLNRPRLVRGGHGNFILMVGGLKSSFALNAPCSTILVLRLDLDNLRWDEAARMPPEMFRAFRESTKFKVFGGAGDMVCFSAKRIGKLALWDRRASEGHEWRWIDNLPENGKGLYRGFVFEGRLNAVP

SEQ ID NO: 39143 - protein, 2141 aa, Oryza sativa Japonica Group
MSAAQGMAYKLRTDAAPTGAGRRARRSHSSVAAPYRAARLLTEERVAARPPRAAARDAEPVRPLSTLPESSIGLYDPSRERDSCGVGFVAELSGDYKRATVNDALEMLERMAHRGACGCEKNTGDGAGILVTKDAGFELPQPGEYAVGMVFLPIDEKRRERSKAEFQKVAESLGHVILGWRRVPTDNSDLGESALQTEPVIEQVFLTKSSSSEADFEQQLYILRRLSILSIRAALNLRRGGKRDFYMCSLSSRTIVYKGQLKPCQLKGYYYADLGHENFTSYMALVHSRFSTNTFPSWDRAQPMRVLGHNGEINTLKGNKNWMKAREGLLECEKLGLTKDQFSKILPIVDATSSDSGAFDGVLELLIRGGRSLPEAVMMMIPEAWQNDVNMEPEKKALYEFLSALMEPWDGPALISFTDGRYLGATLDRNGLRPGRFYVTHSGRVVMGSEVGVVDVPSKDVLRKGRLNPGMMLLVDFENHTVVDDEALKAQYSKAHPYGEWLKRQKIYLKDIVESVPETERVAPGISGSLTQKNEKKEHAGVNGIVTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALEGPLVSIDEMEAIKKMNYRGWRSKVLDITYPKKSGRKGLEETLDRICTEARGAIKKGYTVLVLSDRGFSSDRVAVSSLLAVGAVHQHLVANLERTRVGLLVESAEPREVHHFCTLVGFGADAVCPYLAIEAIWCLQNDGKIPPNGDGKPYSKEELVKKYFYASNYGMMKVLAKMGISTLASYKGAQIFEALGLSSEVIRKCFDGTPSRIEGATFEMLARDALRLHELAFPSRAPPPGSADAKALPNPGDYHWRKNGEVHLNDPLAMAKLQEAARVNSRAAYKEYSRRIQELNKTCNLRGMLKFKDTADMISVDEVEPASEIVKRFVTGAMSYGSISLEAHTALAMAMNKLGGKSNTGEGGEQPSRMEPLANGSMNPKRSAIKQVASGRFGVSSYYLTNADELQIKMAQGAKPGEGGELPGHKVIGDIAVTRHSTAGVGLISPPPHHDIYSIEDLAQLIHDLKNSNPRARISVKLVSEAGVGVVASGVVKGHADHVLISGHDGGTGASRWTGIKNAGLPWELGLAETHQTLVANGLRGRAILQTDGQLKTGKDVAVACLLGAEEFGFSTAPLITLGCIMMRKCHTNTCPVGIATQDPVLREKFAGEPEHVINFFFMLAEELREIMSQLGFRTITEMVGRSDMLEVDPEVVKSNEKLENIDLSLILKPAAEIRPGAAQYCVEKQDHGLDMALDNKLIALSKAALEKEVRVFIETPIQNTNRAVGTMLSHEVTKRYHMKGLPAGTIHVKLTGSAGQSLGAFLCPGITLELEGDSNDYVGKGLSGGKIVVYPPRDSTFIPEDNIVIGNVALYGATIGEAYFNGMAAERFCVRNSGAQAVVEGIGDHGCEYMTGGTVVILGKTGRNFAAGMSGGIAYVYDIDGKFSVRCNHELVDLYHVEEEEDITTLKMMIEQHRLNTGSVVARDILSNFDTLLPKFVKVFPRDYKRVLDNMKAEKAAAKLAKEPKISNGVSVTTKKVQPEQSTNRPTRVSNAKKYRGFISYERESISYRDPNERVKDWKEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGKKVAIIGSGPAGLAAADQLNKMGHFVTVFERADRIGGLMMYGVPNMKTDKIEIVQRRVNLMAEEGITFVVNANVGSDPLYSIERLRSENDAVILACGATKPRDLGIPGRELSGVHFAMEFLHANTKSLLDSNLEDGRYISAKGKKVVVIGGGDTGTDCIGTSIRHGCTSIVNLELLTKPPSKRAADNPWPQWPRIFRVDYGHQEASSKFGNDPRTYEVLTKRFIGDENGNVKALEVVRVKWEKVDGRFQFKEIEGSNETIEADLVLLAMGFLGPEATIAEKLGLEKDNRSNFKAQFGNFATSVDGIFAAGDCRRGQSLVVWAITEGRQAAAAVDKYLSRNEQDAAEDITPSGAGFVQPVAA

SEQ ID NO: 39144 - protein, 434 aa, Bacillus cereus ATCC 10987
MNRLLMNENQKWNTFIETPFYTKVGKVHSVQEQFFVAKGPKAKIGDVCLVGEHSVLCEVIAIEKENNMLLPFEQTEKVCYGDSVTLIAEDVVIPRGNHLLGKVLSANGEVLNENAENIPLQKIKLDAPPIHAFEREEITDVFETGIKSIDSMLTIGIGQKIGIFAGSGVGKSTLLGMIAKNAKADINVISLVGERGREVKDFIRKELGEEGMRKSVVVVATSDESHLMQLRAAKLATSIAEYFRDEGNNVLLMMDSVTRFADARRSVDIAVKELPIGGKTLLMESYMKKLLERSGKTQKGSITGIYTVLVDGDDLNGPVPDLARGILDGHIVLKRELATLSHYPAISVLDSVSRIMEEIVSPNHWQLANEMRKILSIYKENELYFKLGTIQENAENAYIFECKNKVEGINTFLKQGRSDRFQFADIVEAMHHIV

SEQ ID NO: 39145 - protein, 360 aa, Vitis vinifera
MKPLGSEETDLEDGKLEKDREKSVRSNRVVRIHNQALLSGFAYCISSCSMILVNKFVLSSYDFNAGISLMIYQNLVSVIVVTVLSFFGLITTEPLTWKLIKVWLPVNVIFVGMLVTSMFSLKYINVAMVTVLKNVTNVITAVGEMYLFNKHHDNRVWAALFLMIISAISGGITDLSFNGIGYTWQIINCFLTASYSLTLRRVMDTAKQVTKSGNLNEFSMVLLNNTLSLPLGVILMFVFNEVDYLSTTPLLRLPTFWLVMTLSGFLGLAISFSSMWFLHQTGATTYRQDASYCGDFILGLCYCCSIGLSLVGSLNKIPLSVAGIVLFHVPTSLENSASIFFGLVAGVFFAKAKMRERSQS

SEQ ID NO: 39146 - protein, 288 aa, Kineococcus radiotolerans SRS30216
MTPAPPPTPSPAPPLRGRTVVVTGASSGIGAAAARRFARAGARVVPVGRDPERTRALAAELGVEPLLVDAARLDDVRRLAGDLLERCDRIDVLANNAGGSSARRTETPDGHETTFQVNHLAPFLLTALLRERIEATPGARVVTTSSAANLLGRVDLDDLDSRRGRYRGFRVYATTKLENVLFTRALSRRLGGTATASCFHPGVVATRFARDSVVAGVLYRTPLRRVLAVTPEEGAEPLWRLAVRPDPETVDGAYLDRLAPGRVNRQADDVELAEQLWVRSAQLVGVPA

SEQ ID NO: 39147 - protein, 194 aa, Populus trichocarpa
MHIHKALMDINESPVYVLLNPSINPAQKDLPVTIYESELHVIDGIPQLIFVCSSYTIETVEAERISVDHVAHLKPSDGGSAATQLAAHLTGIHSAIKMLNSRIRVLHHYLVAMQKGEIPCENSLLRQVSSLLRRLPAIESEKFQDDFLMEYNDTLLIAYLAMFTNCSSTMNELVDKFNTAYDRHSRRGGRTAFI

SEQ ID NO: 39148 - protein, 587 aa, Zea mays
LIIRTAPIAAAFLLAFLQTIFSNGTQGFSSSDEDSSEDESDDDSDDEPAKKAAAKPLGAVAKNGLKKGKQESSSDGSSSDDESDDDVKPAAPLKKTSVAVAQKKKGDSSESDSDDDSDEEVPPKSKAPAATIKKEDSSESESESDSEVEDASKTQPAKRAASKMKDESSDDSDTDEDEEPPQKKQKEALSAAKKESSSEDEDDSSEESSDDEPTKVEEKKAPKVSENSGSEDESSEDESDKDSEEPANTPKKAAVHASEKKTATKEPKTPTGSQSESTEVNTLFMGNVPWKAEFDDVKEFFEDVGEVVDVRFPTHDDGNRKGFCYVEFVSAEAAAKAYKEKQSKELHGREVRLDFAKGRSTQTPRSGNDGSFQKAARGNSSSIFIRGFDKNLSEDEIRSSLEQHFSDCGEMTRVSIPTDHESGAIKGMAYIDFKDQDSVSKALELSGSDIGGGYELYVDEAKPRGDGQRGGGRSGGRSGGRFGDRSGGRRGGGRFGERSGGRDGGGRFGGRRGGRDGGRGRGGRGFGNKHSAGTPSAGTTHPVIVKFTAFWFEQKNCRPVVSGFKKLEVTAVLPLICTGKKTTFGDD

SEQ ID NO: 39149 - protein, 401 aa, Prochlorococcus marinus str. NATL2A
MSKRSLSSLGAEDLCGKRVLVRVDFNVPLGDEGLITDDTRIRAALPTINDLLDKSARVILSAHFGRPKGQVNETMRLTAVAQRLSELLGKTVVKTESCIGAEAKSKVDAMSNGDVVLLENVRFISGEEKNDTEFAKELASLAEVYVNDAFGAAHRAHASTEGVTKFLSPCVAGYLMEKELKYLQGAIDQPQSPLAAIVGGSKVSSKIGVLESLIDKCDKIIVGGGMIFTFYKARGLSVGNSLVEEDKLELASALEKKAQEKGVEFLLPTDVVLADNFSPDANSKLSKVDAISEGWMGLDIGSESVELFQNALKDCKTVIWNGPMGVFEFEKFANGTNAIANTLAELSAQGCCTIIGGGDSVAAVEKAGLAKKMSHISTGGGASLELLEGKVLPGVSALDDA

SEQ ID NO: 39150 - protein, 410 aa, Pseudomonas syringae pv. syringae B728a
MALIVQKFGGTSVGSVERIEQVADKVKKFREAGDDLVVVLSAMSGETNRLIELARQISDQPVPRELDVIVSTGEQVTIALLAMALMKRGVPAVSYTGNQVRILTDSAHNKARILQIDDQKIRSDLKAGRVVVVAGFQGVDEHGNITTLGRGGSDTTGVALAAALKADECQIYTDVDGVYTTDPRVVSQAQRLDKITFEEMLEMASLGSKVLQIRAVEFAGKYNVPLRVLHSFKEGPGTLITIDEEESMEQPIISGIAFNRDEAKLTIRGVPDTPGVAFKILGPISAANIEVDMIVQNVSHDNTTDFTFTIHRNDYQAALQVLEATAREISAREVSGDTKIAKVSIVGVGMRSHAGVASRMFEALAKESINIQMISTSEIKVSVVIEEKYLELAVRALHTAFELDAPRQGE

SEQ ID NO: 39151 - protein, 192 aa, Zea mays
PSSSLLPPQSPPPQHATTPLALGYHLPSTPLLSPWPAADEHHEEASPLLAPPANEKLPPAQDPVKGCADGVPVVMGEPVTAPAGAEPRESWDSGILSCLGRNDEFCSSDLEVCLLGSVAPCVLYGSNVERLAAAPGTFANSCLPYTGLYMLGNSLFGWNCLAPWFSHPTRTAIRRRYNLEGSFEAFTRQCGC

SEQ ID NO: 39152 - protein, 337 aa, Oryza sativa Japonica Group
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 39153 - protein, 353 aa, Schizosaccharomyces pombe
DVHLSKAALEKARQTLQSQLEDKSAHDEVSGLLRNNPAMLSMIEGRLSSLVGKSSGYIESLAPAVQNRITALKGLQKDCDAIQYEFRQKMLDLETKYEKKYQPIFSRRAEIIKGVSEPVDDELDHEEEIFQNNLPDPKGIPEFWLTCLHNVFLVGEMITPEDENVLRSLSDIRFTNLSGDVHGYKLEFEFDSNDYFTNKILTKTYYYKDDLSPSGEFLYDHAEGDKINWIKPEKNLTVRVETKKQRNRKTNQTRLVRTTVPNDSFFNFFSPPQLDDDESDDGLDDKTELLELDYQLGEVFKDQIIPLAIDCFLEEGDLSDFNQMDEEDSEDAYTDEEDLSSDDEEILSSEISD

SEQ ID NO: 39154 - protein, 274 aa, Kluyveromyces lactis NRRL Y-1140
MYRVFDKLASRPFVSLPGIQLIAKMPLSDLNKLPPLADQLEQAKRIAAYRAVDENFDAKTHKVVGVGSGTTVVYVAERLGEYMDEKTNFVCIPTGFQSKQLILSNKLQLGVIEQFPEVDIAFDGADEVDAGLQLIKGGGACLFQEKLVSTSAKKFIVVADSRKKSPKYLGTNWKKGVPIEVVPSSYVRVLSDLKNKLNCKSAMVRQGGSAKAGPVVTDNCNFIIDADFGEITDPRKLHQDIKLLVGVVETGLFIDNAEKAYFGYPDGSVDLQEL

SEQ ID NO: 39155 - protein, 1276 aa, Ustilago maydis 521
MSSSPRHRAISPPTPAPSPQPDLHTSIRLANNAAAVAVAATAATAVGNPSSSSSSAAQHALAIDPNDPSQLLKHLSLVLPQYTQSARFKLVSQLTDLFSLRELAHLSSVITPKLKVDFLSALPIEVSLNILSFIDDPKTLARASCVSRFWRSLVNDEHTWKVMCLKHKYRRRGSSNAATLSLDHRLMRSIATSSLAPSLSTPSIHPTPAFTLAGARTDPPSVPSASAPATLSNSRSNASSSLGVLFEQPLRATASGEHADDAQDFDNDDDAAVLASLYQRYRDRGLDPSNALHELRTLHDLFLSKQDGAHGSLNAPMSEADLAFYAQLEEIVEEESRARYGDEPTMIDDFAALHSTSASSAAAPASPSSSRLLLISNTDVSATSSASHLGWLSARPASASASQQTRAIASSPSPAAPTSSHHALSGAYRTASGRLDRLSGWQRQQSTPAASTAPRSDLPQRSALLVASADPATPAAQETNRLSAELDEAMDMDDQDILASSSSFADAPSTQPVGHPPNAPQLASLPHYASPTGRFSASAASPSVNTQAAARANANPFSLVPGPRELRRNPLPRQQRRSSTLLSASTGDRHDSISSTGHNLVAGSALRSPLRERSSVTAGPSRPSVASPPTAAHIHRHRSAKLPFSYRTHFKMAYLTESNWRKGGRLQTQHVSADAGHVVTSLAIDSQWIVVGMANSKIHVFSAETGLYAHTLLGHDAGVWCLTLISRTNKDGRNDDDAAASEREKGKMVITNPEDGSGGKPYQAAADGDLRLIHHDPRPDAADVLLSPPPSSADLSEEDLFGNRARPSSSSSTPASGKARQTYGEGETLQWFHKARRALRRQQSIRKAAAAAAASAVGDDLPRGQRHLAMDDHDFIFGAADSDADLSIRSDGPSLVHRETRSSTRARSIRENARAIAEAEAGAIRDAIMADGTGQVPAELAERIRRDDEVASASATATEAFAGRASGRHRTRSASAGGVGAAASQLTGNALGMGNPCGSVLGFGNSDAIVVSGGCDRDVRVWDLRTGECKHVLHGHTSTVRCLKVLDGKPIAVSGSRDSTLRVWNVETGEHLHLLAGHQHSVRCIEVAGNKVASGSYDGTCRIWDLDTGRCLHTLRGHIHYIYAVAFDGKRVATGSLDSTVRVWSAETGDCLALFQGHTSLVGQLQLLDDTLVTGGSDGRVIVFSLNTYECLHRLCAHDNSVTCLQFDDRYIVTGGNDGRVKLWDFATGKFIREICEPCEQVWKVSYRDDKVVVLCKRGEKTCMDVITFRPAADEM

SEQ ID NO: 39156 - protein, 141 aa, Pseudomonas putida KT2440; identical to SEQ ID NO: 1277

SEQ ID NO: 39157 - protein, 591 aa, Vibrio parahaemolyticus RIMD 2210633
MENLLARLLFAQWFPGLIQLKNYQKEWLVNDFRAAFSVVAVALPVAIAYAQLTGVSAIVGLYSCVLPMLVYALMGTSRQLIVGPDAATCAVIAAVVTPIAAGDPTKHWQLVMTMTAMTGIWCVLASRFKLGIFADFLSRPILLGLLNGVALTIIVGQFAKVVGLKYEQRYLLERLWEAPQRLAELHWPTVALSVATVVVYLVTKRYRPTWPAAMLAILVTTASVWLLHLQEMDVAVVGLTQGGFPQFQAPQFELGEVRELVVPALNLAIVSFVSMMLTARSFAAKNGYDIDANKEFQALGFANIASAFSQGFAISGADSRTAVNDANGGKSQLVSIVAAITIAIIAVFIYEPLQFIPIASLGVVLIIASLSLLDLKAIWILKTRDKDAFYLAIITFISVLVIGVIPGITLAVLLGLFQFLRIVMRPSDQLLGLDEKGTIRTIDETGKASPIPGMVIYRFNSPLTYFNAPYFKRRLLEHAEQNKDVSCVVVDAVSSFTHLDLSVMATLADIHEVLKKRGIRLVLAGRKRRLRQWCELTGISTSEGGILLRADMYLAIKLSGSYLSAVGEGIVPTVQKEPDLEQPPKPIPEVA

SEQ ID NO: 39158 - protein, 134 aa, Triticum aestivum
  misc_feature (106)..(106): Xaa can be any naturally occurring amino acid
MAAPSPAVAAVSSAPSSGLLPARRAAPCSAVQVQLPSIRRAAPGGRMATVARAVGDVGAEGNTYLIAGAVAVALVGTAFPIFFSRKDTCPECDGAGFVRKSGSTLXRANAARKDQAQIVCANCNGLGKLGQIDK

SEQ ID NO: 39159 - protein, 125 aa, Xanthomonas campestris pv. vesicatoria str. 85-10
MLFAVPGAFTPTCSAKHLPGYVEHFEQFRKRGIEVLCTAVNDPFVMQAWGRSQLIPDGLHLLPDGNAELARALGLEIDASGSGMGLRSRRYALYADDAVVKALFVEEPGEFKVSAADYVLQHLPD

SEQ ID NO: 39160 - protein, 492 aa, Neptuniibacter caesariensis
MVFPYKKQKMMGDRFMHNLQKFYVDGQWVEPQGAEILDVLNPANDQVVSQIRLGNRDDVETAVAAAVNAFPAFSQTTKEERIALLERIIEGYSARLEDLARATTEEMGAPIGFSRQMQVMAGLGHIKVALSILKKTDFTEVMGTTTVVKEPVGVCAMITPWNWPLNQITCKVAPAIAAGCTMVLKPSEVAPRTAHIFAEILHEAGVPKGVFNLVDGDGPTVGAALSEHPQIDMVSFTGSTEAGKKVSIAAAGNLKKVSLELGGKSANIILDDADFAKVIKRSVRGVMTNTGQSCNAQTRLLVPEDRLAETIEIAKASAESVRTGDPMAEDTAMGPVVSKLQWQRVQALIQKGIDEGAELIAGGVGSPEGLETGCFVKPTVFAGVTPEMSIAREEIFGPVVSIMTYKDEDDAVAIANNHIYGLSGGVYSADLERANAVAARMRTGMVHINGAPADAKAPFGGYRQSGTGREWGRYGMEEFMETKSMMGSIPKA

SEQ ID NO: 39161 - protein, 500 aa, Oryza sativa Japonica Group
MDVNQLWLLWATLAVSLLYYISNRRRRVGGRRRCPPGPMPLPLVGNLLNLRGHLPPALARLARTYGPVMMLKMGLTTTVVISSGDAAREAFTKHDRHLAARTVLDVTRSLDFADRSMIWLPSSDTVWKTLRGVTAASIFSPRGLAALRGVRESKVRDLVGYFRGRAGEVVDVRHAVYGCMLSLVSSAFFSVDVVDLSAESENEFRQSMTFLMEVVSKTNVSDFFPFLRPLDLQGWRRLTERYLGRVTCFLDDVIDRRFAADASANRHGDFLDSLLDLVSTGKIVRENVTTILLDVFIAGSDTITATVEWAMAELLRNPSEMAKVRAEMDGALGGKKTVDEPDIARLPYLQAVVKEAMRLHPAAPLLLPHRAVEDGVEVGGYCVPKGSMVIFNVWAIMRDPAAWERPEEFMPERFIRRGDDDEVDFWGKTFEFIPFGSGRRVCAGLPMAERVVPFMLASLLRAFEWRLPDGVSAEELDMRHRFTIANFRAIPLKAVPVVVS

SEQ ID NO: 39162 - protein, 257 aa, Triticum aestivum
PRVRRASFLQRGYDQVVHDVDLQKLPVRFAMDRAGLVGADGPTHCGAFDVAFMACLPNMVVMAPSDEAELLNMVATAAAIDDRPSCFRYPRGNGIGVPLPENYKGTAIEVGKGRIMIEGERVALLGYGSAVQYCMAASSIVAQHGLRVTVADARFCKPLDHALIRSLAKSHEVIITVEEGSIGGFGSHVAQFMALDGLLDGKLKWRPVVLPDKYIDHGSPADQLVEAGLTPSHIAATVFNILGQAREALAIMTVQNA

SEQ ID NO: 39163 - protein, 351 aa, Vitis vinifera
MSYSLIPKTLSLSSSSPSSLLPFPDKTSPPFLKSSLNSTPNRPTIVPSIKASLSTSQPPILESSKSDLAGQLRVEILSESLPFIQKFRGKTIVVKYGGAAMKSPDLQASVINDLVLLSCVGLRPVFVHGGGPEINLWLGRFGLEPNFLNGLRVTDHSTMEIVTMVLVGKVNKHLVSLINKAGATAVGLSGMDGRLLTARPNPNSAQLGFVGDVARVDPTILRPLIDNNHIPVIASVASDETGQSYNINADTVAGELAASLGAEKLILLTDVAGILENRDDPSSLVKQIDIKGVKKMEGEGKIGGGMIPKVNCCVRSLAQGVRTASIIDGRLPHSLLLEILTDEGAGTMITG

SEQ ID NO: 39164 - protein, 632 aa, Neptuniibacter caesariensis
MSYQVLARKWRPAKFQEMVGQEHVLKALVNALDDDRLHHAYLFTGTRGVGKTSIARLFAKSLNCETGVSSTPCGVCSACKEIAEGRFVDLIEVDAASRTKVEDTRELMENVQYAPTHGRYKVYLIDEVHMLSTHSFNALLKTLEEPPPHVKFLLATTDPQKLPITILSRCLQFNLKNLIPERIVNHLTHVLTQEQISFEEPALWLLARSADGSMRDAMSLTDQAIAFGAGQIAETDVRAMLGTIDQRLVYQMLYSLAAGDANALMQAVTDLAQFSPDYNTVLGDLVSVLHRIAVAQVLPDAVDNSMGDQIQITELAGQLSAEDVQLYYQIALMGRKDLPFVPDPREGLEMVLLRMLAFRPASAKPRNVQLSDTVADLSGAAAQSTHTDAPAPAPAPAPAPAPAPAPAPEFQPSAPSYDEPLPDYDSSYEPAGEGSPAKKSELTKAGDELPPPWEDESAPPQETAVETYSDEAPVENEFANPLSEIVGSVAKTHVEILECPKDFTKIELGHWVHVSRSLGLTGMTESLATHLSMESVAGGIIQLHYTKEQKTMLNEVQQQRIGDAINQYFESSVQLEFIQATQTQETPAQYMNRKREERHAKAIDSIRNDVTVKLLEQEFAAQIELSSVLPID

SEQ ID NO: 39165 - protein, 326 aa, Kineococcus radiotolerans SRS30216
MTRRDVAEQVVVVLGASSGIGRATALEFARRGATVVCASRGEQALRTLVEEITAAGGRAQAFRADITRVQDLQALVAAAESAHGRVDTWVTMAGVSVYGTVDDIPLEEFRRVAEVNYLGHVAAAKVAVPALERSGGGVLVGMASVEGVRSLPFHAPYTASKFAARSFYDALRVELAHAGSPVAVSTILPAGIGTPFWENSRNRTSHLTKPPPPPYAPELVADVVVRMATHPRRQAVVGGASLGFILGEKFNPGLTDVVLSLVGRRMQTSRRPDNGTDIVSTPTPGPGQVHGEHAGHLIRRDLFTTLSARLPRPGEALLALRARWAR

SEQ ID NO: 39166 - protein, 253 aa, Crocosphaera watsonii WH 8501
MGETITLLSKREIEKMRQAGRLAAQLLDHLTPMVKPGVTTLELNDEAEKWTQAHGAISAPLGYHGFPKSICTSVNHVVCHGIPNAKQILKEGDIINIDVTPILDSYHGDTSRTFFVGTPSPLAKRLVEVTEKCLMEAIKTVKPGSRIGDIGAIIQECAEPQGFSVVRDFVGHGVSKVFHTAPQIPHYGKRGKGKKLRSGMVFTIEPMINEGTWEAVILKDGWTAITKDRKLSAQFEHTIAVTETGVEILTLSD

SEQ ID NO: 39167 - protein, 226 aa, Physcomitrella patens subsp. patens
MVVGLGTGSTSSMAIEELGKLAQNKLKDVQFVATSYQSRVLSRQFGVKTMDLNDVNHIDIAFDGADEVDSNMNLIKGGGAAHTMEKVVDSIAKHCVILVDETKVVKTLGLTFPVPVEVLPFALAPVLRALAALGGQPEIRTALRKDGPVMSDLGNMIVDVRFPDGVKNPAELERKINMIPGVVENGLFVNVAHTVLVGTKDGEETSVVTFADFVQTLRNSELEVSS

SEQ ID NO: 39168 - protein, 418 aa, Clostridium clostridioforme
MDGWEAESDAANLLNGLGIETEFHYKYMKELNGAQKVKVLLAQALFGNPDILLLDEPTNHLDLDAIAWLEEFLINFENTVIVVSHDRYFLNKVCTQIADIDYGKIQLYAGNYDFWYESSQLMVKQMKEANRKKEEKIKELQEFIQRFSANASKSKQATSRKRALEKIELDDIKPSSRKYPYIDFRPAREIGNEVLTVQNTIDGVKVLDNISFILNREDKVALVGPNEQAKTVLFKILSGEMEPDEGDYKWGLTTSQCYFPKDNSAEFNNDDTIVDWLTQYSPEKEATYVRGFLGRMLFAGEDGVKKVRVLSGGEKVRCMLSKLMISGANVLMLDEPTDHLDMESITALNNGLVKFQGVLLFSSRDHQIVETTANRIMEIVNGQLIDKITTYDEYLASDEMARKRQVFTLTDEQMQENE

SEQ ID NO: 39169 - protein, 433 aa, Populus trichocarpa
MGLAENQLCFDLIQDWLKKNPKASICSPEGLNEFREIAIFQDYHGLPEFRNAVANFMEKVRGNRVAFDPDRIVMSGGATGAHETIAFCLADPGEAFLVPTPYYPGFDRDLRWRTGVKLIPVDSDSSNNFMVTKEALENAYEMAQLDNIKVKGLLITNPSNPLGTILDRETLRSIVRFINEKNIHLVCDEIYAATVFSQPDFISVAEILQEDIECNLDLVHIVYSLSKDMGFPGLRVGIIYSYNDAVVSCARKMSSFGLVSTQTQYLIASMLSDNEFVEMFIRESKSRLAARYRVFTRGLDQVGIECLKTSNAGLFLWMDLSRLLKEQTFEAEMELWRVIIHEVKLNVSPGCSFHCLKPGWFRVCFANMDDETMQVALSRIKTFVNKEAGTKKSKKNLRWQGSLKLLNSPRIYDDFINSPHSPIPQSPLVRARN

SEQ ID NO: 39170 - protein, 346 aa, Oryza sativa Japonica Group
MFCVRLMQLEEEAKRDPTCALNMERLLEARILSAVDLRRSLGLPSVHTNAYRLINSEGDRLSGLIVDIFADVAVVASSAAWVEKYRHEIQFLVNKVSDVNHIKWRSSTDILKEEGLDVSEQKDPESSSHCGTVEVMENDVLYLVSLEGQKTGFYADQRENRHFISTLSKDQRVLDLCCYSGGFALNAAKGGANNVIGIDSSASALDLANKNIILNKLDTQRISFVKEDATAFMKGAISRNEVWDLVILDPPKLAPRKKVLQSASGMYRSLNALAMQVVKPGGLLMTCSCSGAMTQSGLFLRTIQGAASMTGRKVTVLRQAGAACDHPVDPAYPEGRYLSNYLLRVT

SEQ ID NO: 39171 - protein, 242 aa, Nostoc punctiforme PCC 73102
MLLTDLRTIFERDPAARNWLEVLFCYPGLQALVFHRLAHWLYKIGIPFIPRFISHISRFLTGIEIHPGALIGQGVFIDHGMGVVIGETAIVGDYALIYQGVTLGGTGKESGKRHPTLGSHVVVGAGAKVLGNIQIGDRVRIGAGSVVLRDVPSNTTVVGIPGRVTRQNNLSTNILDHDKVRDVEAEVIRALFERVKALEKQFEELQDQSSFSATELGDEQTYNPKSNKSDGMIEDFLDGAGI

SEQ ID NO: 39172 - protein, 350 aa, Oryza sativa Japonica Group
MSSGQEAGSSSGGSGDGGAAAPRRNTRKPKYSKFTQQELPACKPILTPKWVISVFVLVGVIFVPIGLVSLKASRKVVEIVDRYDDACVPANTTDKLAYIQNPTISKNCRRTLKVPKDMDAPIFVYYQLDNFYQNHRRYVKSRSDAQLRDPKKANDTSTCDPEGTANGMAIVPCGLIAWSIFNDTYGFVRNSKNLPVDKKNISWKSDREHKFGRDVFPKNFQNGSLIGGKTLDPNKSLSKQEDLIVWMRTAALPTFRKLYGRIHTDLKKGDTITVTLENNYNTYSFSGKKKLVLSTSTWLGGKNDFLGLAYLSVGGLCFFLAFAFTLLYLIKPRKMGDNNYLSWNRNPAGR

SEQ ID NO: 39173 - protein, 83 aa, Arabidopsis thaliana
  misc_feature (2)..(2): Xaa can be any naturally occurring amino acid
  misc_feature (21)..(21): Xaa can be any naturally occurring amino acid
  misc_feature (28)..(28): Xaa can be any naturally occurring amino acid
  misc_feature (32)..(32): Xaa can be any naturally occurring amino acid
  misc_feature (55)..(55): Xaa can be any naturally occurring amino acid
  misc_feature (67)..(67): Xaa can be any naturally occurring amino acid
  misc_feature (69)..(69): Xaa can be any naturally occurring amino acid
  misc_feature (76)..(76): Xaa can be any naturally occurring amino acid
MXSSMFSSAVVVTSPVQATMXAPFTGLXSSAXFPVTRKTNKDITSIASNGGRVSXMKVWPPIGKKKXEXSILPPLXLSDVRIG

SEQ ID NO: 39174 - protein, 490 aa, Oryza sativa Japonica Group
MAAALARLGVGGLARALARGRGMCSATAAERAAGAALTSEELMRMERERSAHNYHPIPVVFSKGEGSHILDPEGNKYIDFLSAYSAVNQGHCHPKVLRALKEQAERLTLSSRAFYNDKFPIFAEYLTSMFGYEMMLPMNTGAEGVETAIKLVRKWGYEKKKIPKNEALIVSCCGCFHGRTLGVISMSCDNDATRGFGPLVPGHLKVDFGDTDGLEKIFKDHGERICGFLFEPIQGEAGVIIPPDGYLKAVRDLCSRHNILMIADEIQTGIARTGKMLACDWENIRPDVVILGKALGAGVVPVSAVLADKDIMLCIKPGEHGSTFGGNPLASAVAVASLKVVTDEGLVESCMIVYEYLSSKHLLNYRAAKLGQEFRDQLQKVQQRFPQIIREVRGRGLLNAVDLSNEALSPASAYDICIKLKERGVLAKPTHDTIIRLAPPLSISPEELAEASKAFSDVLEHDLPQLQKQIKKTESAAEKQSCDRCGRDLY

SEQ ID NO: 39175 - protein, 299 aa, Nostoc punctiforme PCC 73102
MWDYTDKVLELFYDPKNQGEIEETGEAGVKVATGEIGSIACGDALRLHLKVEVESDKILDARFQTFGCTSAIASSSALTEMVKGLTLDEALKVSNKDIADYLGGLPEAKMHCSVMGQEALEAAIYNYRGIPLATHDDDDEGALICSCFGISESKIRRVILENHLTDAEQVTNYVKAGGGCGSCLANIDDIIRSVQQEYASPALNNYGVQVATEIVTSKERSLTNVQKIALIQKVLDEEVRPVLIADGGDVELYDVEGDRVKVVLQGACGSCSSSTATLKIAIEARLQDRVSKSLVVEAV

SEQ ID NO: 39176 - protein, 254 aa, Pyrococcus horikoshii OT3
MSVKTWRKIAIDIIRDFDHNIMPLFGNPKASETISISPSGDETKVVDKVAENIIISKFKDLGVNVVSEEIGRIDQGSDYTVVVDPLDGSYNFINGIPFFAVSVAIFHEKDPIYAFIYEPIVERLYEGIPGKGSYLNGEKIKVRELAEKPSISFYTKGKGTKIIDKVKRTRTLGAIALELAYLARGALDAVVDIRNYLRPTDIAAGVVIAREAGAIVKDLDGKDVEITFSATEKVNIIAANNEELLETILRSIEK

SEQ ID NO: 39177 - protein, 448 aa, Pseudomonas syringae pv. phaseolicola 1448A
MNMFEASDVPVASQLKLDAHWMPYTANRNFQRDPRMVVAAHGSYLTDDKGRKIYDGLSGLWTCGAGHTRKEIQEAVSRQLGILDYSPGFQFGHPLSFQLAEKITELTPGNLNHVFYTNSGSECADTAVKMVRAYWRLKGQATKTKMIGRARGYHGVNVAGTSLGGVNGNRKMFGQLMDVDHLPHTLLASNAYSKGMPEAGGIALADEMLKLIELHDASNIAAVIVEPMAGSAGVIVPPQGYLKRLREICDQHNILLIFDEVITGFGRTGSMFGADSFGVTPDLMCIAKQITNGAIPMGAVIASSEIYQTFMNQPTPEYAVEFPHGYTYSAHPVACAAGLAALELLQRENLIQQAAEIAPHFESVLHGIKGAKNVVDIRNYGLAGAIQIAPRDGDAIVRPFEAGMRLWKAGFYVRFGGDTLQFGPTFNSQAQDLDRLFDAVGETLNLID

SEQ ID NO: 39178 - protein, 445 aa, Oryza sativa Japonica Group
MATGRRLSMILLLLLLGLASGDKILFQGFNWESWRQSGGWYNLLMGKVDDIVAAGVTHVWLPPPSHSVSTQGYMPGRLYDLDASRYGTSMELKSLISALHGKGIQAIADVVINHRCADYKDSRGIYCIFEGGTPDGRLDWGPHMICRDDTQFSDGTGNLDTGADFAAAPDIDHLNGVVQRELTDWLLWLKSDEVGFDAWRLDFARGYSPEVAKVYIEGTTPVGLAVAELWDSMAYGGDGKPEYNQDAHRQALVDWVDRVGGTASAGMVFDFTTKGIMNTAVEGELWRLIDQQGKAPGVIGWWPAKAVTFVDNHDTGSTQQMWPFPSDKVMQGYAYILTHPGNPCIFYDHFFDWGLKEQIAALVAVRQRNGVTATSSLKIMLHDADAYVAEIDGKVVMKIGSRYDVSSLIPPGFHLAAHGNGYAVWEKIAAAAAAADHRTSSSASL

SEQ ID NO: 39179 - protein, 265 aa, Zea mays
MAELKAKRGSRTYLTWTDAMDLALLEVLVEHHNNGDRGQNGWKPHVYNAAIRNVKDKCNVDITKDNISARCKTFDKHYEIISKILSQSGFGWDWENNRLSMDSEDVWFRYVEANKGAACYKTKVVKNWDAIYTIYSKDHANGEGAKTGTESGQDVVNDSPTNANENSLVLAPKKQRTGDAIMGVLTDMKASFQEAMQSNAPLELPKKTAPSKILAALQEIPDLPREDMLRSYGMLLSRDDRIFEALMELPMEMRKDWLLFENERK

SEQ ID NO: 39180 - protein, 667 aa, Ustilago maydis 521
MSSSTIPLRSAMALPAPRPSTFNERMAARWATILRVLHRHLYFLGPGIVASVAYADPGNWATDLQAGSEFGYSLLFIVLLTGCFAVFIQILSCRVGVVTNADLARQCRMLILKEDRLGNPTQRHVSRPRLRRWALLYPLYVIAEGAIVATELAELTGSAIALNLLFPALPLWAGILITSVDVIIILFIYKPPPNGSFRLLEALIAALVFTVLACFIVLLVRIKPHWPDVFHGYLPSHHVVQSGALYVSVGILGATVMPHAIILGSHFASIDRLPSLDPPCASDDVQHCADQSRWQLISSSFSRLVRPKSETKTEVLRLTRVVRSLISHRTGTDDIETDSMRQRRRERYKAEDLPPRTLDNIRIHIKHASVDIGMSLVSFAIVINSAILIVAAAAFYYTDNGTGTGTATGQVVVASLYDAFYLLKDRLGSLAAVLFAVALLAAGQSASITVTLAGQLVSEGFINWRTDPFLRRIVTRLVAIVPSLTVSLAVGKDGLDEMLVASQVALSIELPFVLLPLILVTGSKTRMTAQVATERRDACSVRSSVELDAPSVEANDQASAQATACTAQHGRQLERNDSTRASLGVIESLPREQDAPAPDQDNKESQPQQPQASASTRVASLADALDSSQDRSHCFASAWYVQVVAYAIFGVIVVADVYVLVTTFMDI

SEQ ID NO: 39181 - protein, 277 aa, Zea mays
  misc_feature (271)..(271): Xaa can be any naturally occurring amino acid
MAAQVVAAAGTPVARPLGGGSGADALRPAATMPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHASHQKVIDLVKEYNASHADNVIAIMLDTKGPEVRSGDLPQPIFLESGQEFTFTIKRGVGTDTCVSVNYDDFVNDVEVGDMLLVDGGMMSFLVKSKTEDSVKCEVIDGGELKSRRHLNVRGKSATLPXITDKDW

SEQ ID NO: 39182 - protein, 406 aa, Desulfococcus oleovorans Hxd3
MGLVVQKFGGTSVADIEKIRNVANRVIRTATAGNRVVVVLSAMAGITDSLINLANQAAEDPDGRELDSLLSTGEQTTVALLAMMLTDMGYKARSLLGFQAGIRTNAAATKARIISIDAEKIRTLLAGGYIVVVAGFQGIDDDGNITTLGRGGSDTSAVALAAAIKADVCEIYTDVDGVYTTDPSICEKARKLSRISYDEMLEMASLGAKVLQIRSVEFAKKYNVPVHVRTSFGEEEGTMVLQEDTGMEELVISGVTCSKGEARITFKKVADVPGVASEIFGPIAEARILVDMIIQNTRAGGQTDLTFTVPRGDYKKALAIAQETGKAIGAEEVMGAENLAKVSIIGVGMKNHSGVASTMFSTLAAEGINIQMISTSEIRISCVVEEKYAELAVRVLHTAFGLDKKE

SEQ ID NO: 39183 - protein, 319 aa, Bacillus sp. SG-1
MPNSYSNSKLKIFSLNSNPSLAEEIAKEVGVPLGQCTVKQFSDGEIQINIEESIRGCDVFVIQSTSAPVNENLMELLIMVDALKRASAKTINIVMPYYGYARQDRKARAREPITAKLVANLLETAGATRVITLDLHAPQIQGFFDILIDHLMGVPILGDYFLEKGFKAEDIVIVSPDHGGVTRARKLAERLKAPIAIIDKRRPKPNVSEVMNIVGNIDGKIAILIDDIIDTAGTITLGANALVENGAREVYACCTHPVLSGPAIERIQNSKIKELIVTNSIPLSEDKMIDKIEQLSVAPLIGEAIIRVYEQQSVSTLFD

SEQ ID NO: 39184 - protein, 308 aa, Arabidopsis thaliana
MNRGSLCPNPICLPPLEQSISKFLTQSGTFKDGDLRVNKDGIQTVSLSEPGAPPPIEPLDNQLSLADLEVIKVIGKGSSGNVQLVKHKLTQQFFALKVIQLNTEESTCRAISQELRINLSSQCPYLVSCYQSFYHNGLVSIILEFMDGGSLADLLKKVGKVPENMLSAICKRVLRGLCYIHHERRIIHRDLKPSNLLINHRGEVKITDFGVSKILTSTSSLANSFVGTYPYMSPERISGSLYSNKSDIWSLGLVLLECATGKFPYTPPEHKKGWSSVYELVDAIVENPPPCAPSNLFSPEFCSFISQW

SEQ ID NO: 39185 - protein, 382 aa, Pseudomonas putida KT2440
MIRSKLPNVGTTIFTTMSQLAVQTGALNLSQGFPDFNGPQALLDAVGRHVAAGHNQYSPMTGLPALRQQVAAKVERLYGARVDADQEVTITPGATEAIFCAIQAVVHAGDEVIVFDPCYDSYEPSVELAGGRCVHVQLSDGDFRIDWQKFSDALSPRTRMVILNSPHNPSGALITREDLDQLAALIADRDIYLVSDEVYEHLVYDGVRHASVLAHEQLYSRAFVVSSFGKTYHVTGWKTGYVIAPPALSAELRKVHQYVNFCGVTPLQCALADFMAGHPEHIDELPAFYQAKRDLFCGLLDGSRFNFTRTTGTYFQLVDYSQIRPDLNDVDMSLWLTREHGVATIPVSVFYQQPIPEQRLVRLCFAKREETLRQAAERLCAI

SEQ ID NO: 39186 - protein, 236 aa, Triticum aestivum
NKFVQKSRLVPVRNSRDIVDGGGGVRPSLPSAAAGGASGADEPRDARVVRELLRSMGLGEGEYEPRVVHQFLDLAYRYVGDVLGDAQVYADHAAKPQMDADDVRLAIQAKVNFSFSQPPPREVLLELARSRNKIPLPKSIAPPGSIPLPPEQDTLLSENYQLLPALKPPTQTEEAEDDNEGAGASPTNPNPNYPQDQRGSEQHQPQSQRGVSFQLNAVAAAAAKRSLVTIDQLNMG

SEQ ID NO: 39187 - protein, 426 aa, Glycine max
MSGPLDRFARPCFEGFSGSDEKKERRSDFENSEDERRTRIGSLKKKALNASSKFKHTLRKKSSRRKSDGRVSSVSIEDVRDFEELQAVDAFRQSLIMDELLPEAFDDYHMMLRFLKARKFDIEKAKHMWTDMLQWRKEFGADTIVQDFEFKELDEVVKYYPHGHHGVDKEGRPVYIERLGKVDPNKLMQVTTLDRYVKYHVQEFEKAFAIKFPACSIAAKRHIDSSTTILDVHGVGLKNFTKSARELITRLQKIDGDNYPETLCQMFIINAGPGFRLLWSTVKSFLDPKTTSKIHVLGNKYQSKLLEVIDASELPEFLGGTCTCEDQGGCLRSDKGPWKNPDIFKMVLTGGAWRSKQVVKVLNNERKVIVYAKPGYPMVKGSDTSTAESGSEAEDISSPKAMKSYSHLTLTPVHEEVSFNLLEKLL

SEQ ID NO: 39188 - protein, 657 aa, Vitis vinifera
MVLGERLGDKSDSRFCGVETEFQEDMPQLLSFNLSSSAAFDFVVAPVMDPTYRPSLMVNDRNRSGVLPVAGSDLVLSPAQWSSHVVGKLSSWIDLDSEDKILRLDSEITLKQEIAWASHLSLQACLLPTPRGASCANYARCVNQILQGLNNMQLWLRIPLEKTDDDAMDGTHDDLVRQTDSWELWNSFRLLCEHHSQLFIALDVLSSLPSANSLGRWFGEPVRAAIIHTNSFLTNARGHPCLSKRHQKLLTAFFNHSIQMVLSGKPVHSLPKGSLELGSNDADVLRCSCHLGIQRHPLRSYLDYVGYLYQRMDPLPEQERFELGYRDFLQSPLQPLMDNLEAQTYETFEKDTMKYIQYQRAVCKALLDRVPDEKASIVTTVLMVVGAGRGPLVRASLQAAEETGRKLKVYAVEKNPNAVVTLHSLVKLEGWENIVTIVSCDMRQWDAPEKADILVSELLGSFGDNELSPECLDGAQRFLKQDGISIPSSYTSFIQPVTTSKLYNDVKLHKDLVHFETAYVVKLHNVARLAPCKPVFTFTHPNYSTEKSNQRYKKLQFETLSDTGSAMVHGFAGYFDATLYKDVHLGIEPSTATPNMFSWFAIFFPLRTPVCIQPGSTLEVHFWRCCGATKVWYEWCVTSPTPSPIHNSNGRSYWVGL

SEQ ID NO: 39189 - protein, 427 aa, Ajellomyces capsulatus
MAPAPQESLFSTLEIPQYDEVFGLMAQFVADTSPQKVSLGAGVYRDNEAKSWRLNIVEKQLCEDPTFDHEYLPIEGYQPFVDAARDLVFGNSCPIAKGRIASLQTVSGTGANHLGARFLKEHLPRLISPSSSSATPTRKIWLSDPTWANHHLIWDLVASSSTGSPIKTVLYPYYHAQTRSFDFDGMIRTLEANAQRGDVILLHACAHNPTGLDPTRAQWEAIASLCQRKGIFPFFDSAYQGFASGDLDNDAWAMREFVARGMEMCVAQSFSKNLGLYGQRVGAFHLVCHTEDSARRARFQLIELQRGEISMPPAYGSKIAAAVLRDPANVIEWKQDLSIMSSRIKSMRRALYDELRRLGTPGNWDHIINQIGMFSYTGLTKKQIKTLREDYHIYMLESGRASISGLTTNNVKYVAGAFDAVVRDMPY

SEQ ID NO: 39190 - protein, 329 aa, Fusobacterium nucleatum subsp. vincentii ATCC 49256
MLDLENIIVIGVSHENLSLLERENFMRTRPKYIIEKLYIDKKIDAYINLSTCLRTEFYIELNSNINTDEIKKLFSVEMIVKKGIEAIEYLFKVSCGFYSVIKGEDQILAQVKGAYSEAFENEHSSKFLNIIFNKAIELGKKFRTKSMIAHNALSLEAISLKFIKSKFPNIEDKNIFILGIGELAQDILTLLTKEELKNVYITNRTYHKAEQIKKKFDIVNIVDYREKYKEMIEADVIISATSAPHIVVEYDKFVPKMKEDKDYLFIDLAVPRDVDERLANFKNIEIYNLDDIWEVYHLNSMNRDKLLEDYSYLINEQMEKLIKTLNYYE

SEQ ID NO: 39191 - protein, 427 aa, Neptuniibacter caesariensis
MSDSLTDLQRFLAASPTPFHAVQEMVERLEKSGFKSLDERDSWDLKASGRYFTLRNGSSIVAWVMPEESDLATSGMRMVGAHTDSPCLKVKPEPDIHRHGYQQLGVEVYGGVLLNPWFDRDLSMAGRVNYRAVDGSRQSALINFEKPVAVIPSLAIHLDREANKSRSINAQTYLPVITGQGEEKASFKQLLKQRLLEQGADDVGDVLDYEIVLYDTQQPSLVGLNEEFLVSARLDNLLSCFMGLQGLLSSDLTQGCLLVCNDHEEVGSMSAAGAQGPMLQQVLERIAPDAEERIRMIQHSMMISADNAHGIHPNFADKHDANHGPLLNAGPVIKINANQRYATNSETSAAFRDMAEQVDVPVQAFVVRSDMGCGSTIGPITASELGVKTIDIGVPQFAMHSIREMAGTRDIMDLTKVLTKFFNEKAV

SEQ ID NO: 39192 - protein, 335 aa, Fusobacterium nucleatum subsp. vincentii ATCC 49256
MAVKVAINGFGRIGRLALRVMSKNKDFDVVAINDLTDAKTLAHLFKYDSAQGRFDGTIEVTDNGFVVNGDSIKVFAKANPEELPWGDLGIDVVLECTGFFTSKEKAEAHIKAGAKKVVISAPATGDLKTIVYNVNDNVLDGTETVISGASCTTNCLAPMAKVLNDKFGIIEGLMTTIHAYTNDQNTLDAPHKKGDLRRARAAAENIVPNTTGAAKAIGLVIPELKGKLDGAAQRVPVITGSITELVTVLGKDVTVDEVNAAMKAASNESFGYTEEPLVSSDIIGISFGSLFDATQTKVLTVDGKQLVKTVAWYDNEMSYTSQLIRTLKKFVEISK

SEQ ID NO: 39193 - protein, 177 aa, Solanum phureja
MYLRTPIDRVLFSPSYPQFSRTQKGSLRVHSKLNNNVIEISESKSFYELLGIQETVSLLEIKQAYKQLARKYHPDVSPPGRVEENTQRFIRVQEAYETLSDPKSRDMYDKDMSKGLHLAFSPRRKCQNDESMEDTGEWKNRWHSQLSELKRRNTHKDSGNNMSWGARMRRQRNETSL

SEQ ID NO: 39194 - protein, 177 aa, Fusobacterium nucleatum subsp. vincentii ATCC 49256
MKKLITDLDLNNKKVLMRVDFNVPMKDGKITDENRIIQALPTIKYALEHNAKLILFSHLGKVKTEEDKATKSLKAVAEKLSELLGKNVIFIPETRGEKLESAINNLKSGEVLMFENTRFEDLDGKKESKNDPELGKYWASLGDVFVNDAFGTAHRAHASNVGISENIGNGNSANWFS

SEQ ID NO: 39195 - protein, 318 aa, Triticum aestivum
AWSRPRYFAGVMVRLILVAAPAVCLISAIAVSATIKNLTTLIRSKSKSPQTTGKTTGSKAAAKGAVDQPLPFQHNVAVALLLGAFYLLSRYAIHCTWVTSEAYSSPSIVLSARGHNGGRVIFDDYREAYYWLRQNTPTDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRVDKGASPKMLNCLMYKLCYYRFGELTTEYGKPPGYDRVRGVEIGNKDIKLEYLEEAFTTSNWIVRIYKVKPPKNRS

SEQ ID NO: 39196 - protein, 171 aa, Fusobacterium nucleatum subsp. vincentii ATCC 49256
MFTFLKSQEGKNIGASLVEDDKLDLAKDLLEKSNRKIVLPVDTVVANEFKNDTEFSTVDIDNIPDNKMGLDIGEKTVKLFDSYIKTAKTVVWNGPMGVFEMPNFAKGTIGVCESIANLTDAVTIIGGGDSAAAAISLGYADKFTHISTGGGASLEFLEGKVLPGVEAISNK

SEQ ID NO: 39197 - protein, 414 aa, Zea mays
MAATSMMRAPIGPNPRLACHAPARGGGVVRCSLQGAVVGGRAEWQSSCAMLSSKVAALGTHSINGHVAPAPAPAPAVLDLVPVSSMNGAVAKNLPQPLRIADLSPAPMHGSELRVAYQGVPGAYSEKAAGKAYPGCDAIPCDQFEVAFQAVELWIADRAVLPVENSLGGSIHRNYDLLLRHRLHIVGEVQLPVHHCLLALPGVRRELLTRVISHPQALAQCELTLNAMGLNVAREAFDDTAGAAEHIAAGGLRDTAAIASARAAELYGLQVLAAGIQDDAGNVTRFVMLAREPIIPRTDRPFKTSIVFAHDTDGTSVLFKVLSAFAFRDISLTKIESRPHRHRPIRLVDDANVGTAKHFEYMFYIDFQASMADVRAQNALAEIQEFTSFLRVLGSYPMDMTPWDAALSSRASQY

SEQ ID NO: 39198 - protein, 303 aa, Legionella pneumophila str. Paris
MKPLLCSLFDSSEIAGQLQKTLQVDVGKVTFHRFPDTEWYLKIDSEVKNRSIMVVDSLNQPDEKILPLLFFAKTAKELGAKKIGLIAPYLSYLRQDKRFHEGEGITSRYFADILSTSFDWLMTIDPHLHRYHSLDEIYSIPTFVLHATSMIATWIKHHVPKPILIGPDMESEQWVADIAEKGRFPYAILEKTRHGDKEVTISVPYIPELESSTLVLVDDIISTARTMVETVKHLQQAGSKSIVCIGVHALFAEDAYSLLSAMKGVQVITCNTIHHVTNAIDVSGLAVDVLVQNKLAALKSKRK

SEQ ID NO: 39199 - protein, 380 aa, Vitis vinifera
MSGTAGQVIRCKAAVAWEAGKPLVIEEVEVAPPQVMEVRLKILFTSLCHTDVYFWEAKGQTPLFPRIFGHEAGGIVESVGEGVTDLQSGDHVLPVFTGECKECRHCKSEESNMCDLLRINTDRGVMLSDNKSRFSINGKPIYHFVGTSTFSEYTVVHVGCVAKINPAAPLDKVCVLSCGISTGLGATLNVAKPWKGSSVAIFGLGAVGLAAAEGARIAGASRIIGIDLNPKRFNDAKKFGVTEFVNPKDHDKPVQEVIAEMTDGGVDRSVECTGNVNAMISAFECVHDGWGVAVLVGVPNKDDSFKTHPVNLLNERTLKGTFFGNYKPRSDLPSVVEKYMNKELELEKFITHEVPFAEINKAFEYMLSGDGLRCIIRMDA

SEQ ID NO: 39200 - protein, 455 aa, Photobacterium profundum SS9
MIDITNLTGHKYAKIARYYLSSEPFILMTTATTPANFTELGLISPLLARLTELEYQQPTPIQAQVIPSVLAGRDLIAGANTGSGKTAAFALPMLQHLFLQQHLSSKSSKGNYVTRLILVPTRELAKQVADSIKSYAVHFNGAIKTVAVFGGVSANTQMLALRGGTDILVATPGRLLDLISSNAIKLDRVKTLVLDEADRMLSLGFTDELSALLGLLPKNKQTLLFSATFPEQVQTLTQELLNDPVEIQLQSADASTLVQRVFTVNKGEKTALLAHLIKQNEWRQALIFVNAKNSCEHLADKLSKRGITAEVFHGDKGQGARTRVLDAFKAGEIEVLIATDIAARGLDIEKLPVVINFDLPRSPSDYMHRIGRSGRAGEVGLALSLIDHDDYHHFKVIEKKNKIRLEREQVEGFEADEVNEAFLIANKPMAKPEGSGKKKRKNKASLNEDIWLDNF

SEQ ID NO: 39201 - protein, 142 aa, Lactobacillus delbrueckii subsp. lactis
  misc_feature (22)..(22): Xaa can be any naturally occurring amino acid
  misc_feature (31)..(31): Xaa can be any naturally occurring amino acid
  misc_feature (61)..(61): Xaa can be any naturally occurring amino acid
GLTDADHPTQVLADFLTAKEVXKKEYKDIKXAFVGDGHDNVSNALMLGAAVMGMEYHVVTXPELNPSEETLAKANAIAKDTGAKIVVSNDIKEGVKGMDVIYGDVWVSMGESDDKWKKRIELLSPYQITMDVLKATENPNVI

SEQ ID NO: 39202 - protein, 178 aa, Pyrococcus horikoshii OT3
MNPFHDLEPGPNVPEVVYALIEIPKGSRNKYELDKETGLLKLDRVLYTPFHYPVDYGIIPRTWYEDGDPFDIMVIMREPTYPLTIIEARPIGLFKMIDSGDKDYKVLAVPVEDPYFKDWKDISDVPKAFLDEIAHFFKRYKELEGKEIIVEGWEGAEAAKREILRAIEMYKEKFGKKE

SEQ ID NO: 39203 - protein, 409 aa, Bacillus pumilus SAFR-032
MGLIVQKFGGTSVGSTEKIRNAAERVIAERKAGHDVVVVVSAMGKSTDVLVDLAKELTDHPSNREMDMLLATGEQVTISLLTMALQAKGYDAISFTGWQAGMKTEQVHGNARIVDIDESRVKEELNAGKVVVVAGFQGIADDLHITTLGRGGSDTTAVALAAALKADKCDIYTDVPGVFTTDPRYVPAARKLAGISYDEMLELANLGAGVLHPRAVEFAKNYQVPLEVRSSIENESGTLIEEESSMEQNLVVRGIAFEDQITRVTVCGLSSGLTTLSTIFTTLAKQNINVDIIIQSVTSTNQTSISFSVKTDDLSKTVEVLEEYKGALGYEQIETESKLAKVSIVGSGMVSNPGVAAEMFAVLAEKDIQVKMVSTSEIKVSTVVGRDDMVKAVEALHDAFDLSKVAAHS

SEQ ID NO: 39204 - protein, 396 aa, Pyrococcus horikoshii OT3
MARVVVDAQAARAIGKGAMIVFKKGVVRVEGDIKPGDIVEVYTRGGKFLGKGFANPNSNIMVRIVTKDKDVEINKDLFKRRIKKANEYRKKVLKYTNVYRMVYGEADYLPGLIVDRFNDIASLQISSAGMERFKLDVAEAIMEVEPGIETVFEKNTGRSRRREGLPEIERVLLGKEKYRTIIQEGRAKFIVDMRGQKTGFFLDQRENRLALEKWVQPGDRVLDVFTYTGGFAIHAAIAGADEVIGIDKSPRAIETAKENAKLNGVEDRMKFIVGSAFEEMEKLQKKGEKFDIVVLDPPAFVQHEKDLKAGLRAYFNVNFAGLNLVKDGGILVTCSCSQHVDLQMFKDMIIAAGAKAGKFLKMLEPYRTQAPDHPILMASKDTEYLKCLFLYVEDMR

SEQ ID NO: 39205 - protein, 255 aa, Oryza sativa Japonica Group
MASKEEVAVETVEGGAAAAKAPYWDPPPAPLLDTSELGKWSLYRALIAEFMATLIFLYVSIATVIGYKNQRATVDACTGVGYLGVAWSFGATIFVLVYCTGGVSGGHINPAVTLGLFFGRKLSLVRTVLDGYSAAGALGAEIVGTFILVYTVFSATDPKRTARDSFIPVLVPLPIGFAVFVVHLATIPITGTGINPARSLGAAVLYNQHAAWKDHWIFWVGPVIGAFLAAAYHKLVLRGEAAKALSSFRSTSVTA

SEQ ID NO: 39206 - protein, 256 aa, Pseudomonas aeruginosa PAO1
MHPYFSLAGRIALVTGGSRGIGQMIAQGLLEAGARVFICARDAEACADTATRLSAYGDCQAIPADLSSEAGARRLAQALGELSARLDILVNNAGTSWGAALESYPVSGWEKVMQLNVTSVFSCIQQLLPLLRRSASAENPARVINIGSVAGISAMGEQAYAYGPSKAALHQLSRMLAKELVGEHINVNVIAPGRFPSRMTRHIANDPQALEADSASIPMGRWGRPEEMAALAISLAGTAGAYMTGNVIPIDGGFHL

SEQ ID NO: 39207 - protein, 143 aa, Glycine max
  misc_feature (135)..(135): Xaa can be any naturally occurring amino acid
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVSNEVKEXKKEYPGTP

SEQ ID NO: 39208 - protein, 334 aa, Neisseria meningitidis MC58
MSIKVAINGFGRIGRLALRQIEKAHDIEVVAVNDLTPAEMLLHLFKYDSTQGRFQGTAELKDDAIVVNGKEIKVFANPNPEELPWGELGVDVILECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVASGSLTELVSILERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 39209 - protein, 420 aa, Staphylococcus aureus subsp. aureus MRSA252
MKLTVVGLGYIGLPTSIMFAKHGVDVLGVDINQQTIDKLQSGQISIEEPGLQEVYEEVLSSGKLKVSTTPEASDVFIIAVPTPNNDDQYRSCDISLVMRALDSILPFLEKGNTIIVESTIAPKTMDDFVKPVIENLGFTIGEDIYLVHCPERVLPGKILEELVHNNRIIGGVTKACIEAGKRVYRTFVQGEMIETDARTAEMSKLMENTYRDVNIALANELTKICNNLNINVLDVIEMANKHPRVNIHQPGPGVGGHCLAVDPYFIIAKDPENAKLIQTGREINNSMPSYVVDTTKQIIKALSGNKVTVFGLTYKGDVDDIRESPAFDIYELLNQEPDIEVCAYDPHVELDFVEHDMSHAVKDASLVLILSDHSEFKNLSDSHFDKMKHKVIFDTKNVVKSSFEDVSYYNYGNIFNFIDK

SEQ ID NO: 39210 - protein, 342 aa, Vitis vinifera
MVDRYWIAFFAVFVYLVRVFEASVGDADPLYRDCVEQCEKTGCVGERCFPHCKFPSDGAVVDGPWYLQEPLYLRWKQWDCQSDCRYYCMLDREKEREALGNGPVKYHGKWPFKRVYGIQEPASVALSALNLAMQFHGWLSFFILLNYKLPLKPNKKAYYEYTCLWHIYGLLSMNSWFWSAVFHSRDVDLTEKLDYSSAVALLGFSLILAILRSFNVRVEAARVMVSAPLLAFVTTHILYLNFYKFDYGWNMKVCVVMGVAQLLIWTIWAGVTRHPSRWKLWTVVVGGGLAMLLEIYDFPPYEGFVDAHALWHATTIPLTYIWWSFIKDDAEFQTANLLKKVK

SEQ ID NO: 39211 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVNKSA

SEQ ID NO: 39212 - protein, 464 aa, Oceanobacillus iheyensis HTE831
MSKGRVTQLMGPVVDVRFEDAELPAVNNALVVRSDSGEELTLEVALHLGDNSVRTIAMSSTDGFKRGAEVENLGRPISVPVGDVTLGRVFNVLGEKIDLDEPLEEGVRRDPIHREAPDFENLSTETEILETGIKVVDLLAPYIKGGKIGLFGGAGVGKTVLIQELINNIAQEHGGISVFAGVGERTREGNDLYYEMSDSGVIAKTAMVFGQMNEPPGARMRVALTGLTMAEYFRDEQGQDVLLFVDNIFRFTQAGSEVSALLGRMPSAVGYQPTLATEMGQLQERITSTDKGSVTSIQAIYVPADDYTDPAPATTFAHLDATTNLDRKLSEQGIYPAVDPLESTSRALDPEVVGKEHYEVATEVQQTLQKYRELQDIIAILGMDELSDEDKLVVARARRIQFFLSQNFHVAEQFTGQPGSYVPVQETVKGFKEILEGKYDDLPEDAFRLVGRIEEVVEKAKGME

SEQ ID NO: 39213 - protein, 163 aa, Erwinia carotovora subsp. atroseptica SCRI1043
MRRILSVLLENESGALSRVVGLFSQRGYNIESLTVAPTEDPTLSRMTIQTVGDEKVLEQIEKQLHKLVDVLRVSELGQGAHVEREIMLVKLQATGYAREEVKRCADIFRGQIVDVTASLYTVQLAGTSDKLDAFLSAVREVSEIVEVARSGIVGVSRGDKIMR

SEQ ID NO: 39214 - protein, 492 aa, Bacillus anthracis str. Ames
MFQKIAKECLAGFTVAIVALPLAIAFGIAATGTSEGALVGLYGAIFAGLFAALFGGTPGQVTGPTGPITVIATGVIATHGLEASFIAFMMAGLFQILFGVCKLGSYVRYIPYPVVSGFMNGIALIIILGEMKHVQNSFLLVVLTIIVMIVSGKWIKAIPSSLVALVGVTALLPLFSSALEGLTVKLPVIGNLTLNKVIEKIGTIPEAMPTLHIPSLGGTGIAELVLPALSIALLGSIDSLLTSVVMDNVTGTRHKSNKELVGQGIGNMVSGLFGGLAGAGATVRSIVNIRSGGKTALSACMHSVILFIFIMGLGSVVQYIPLAVLSGILILTGIGMFDWESMKKMHVAPKGDVIVMLVTMIVTVKFDLMIAVAFGILLSFLIYMVKCKERKVSIVKEKEATYKIKGPLSFLTVDRVFYALQDVKSPVVLRMKDARYMDVSGAMALLNFIEQSDKSGLSVTLEQVPVHIKKTLVTMASNEQKDKLLFAEVDVM

SEQ ID NO: 39215 - protein, 134 aa, Lactobacillus delbrueckii subsp. lactis
IVDKRRPKANVSEVMNIIGDVKGKRAILIDDMIDTAGTITLAAQALKDAGATEVYACATHAVLSGPAVDRLNNSVIKSLVLTDSIQQPAEKNLDKMILVSVGPLMGDAIKLIMEHKPMSPLFDTRYDANKYKDK

SEQ ID NO: 39216 - protein, 108 aa, Lactobacillus delbrueckii subsp. lactis
  misc_feature (89)..(89): Xaa can be any naturally occurring amino acid
  misc_feature (92)..(92): Xaa can be any naturally occurring amino acid
DAKFLAQGTLYTDVIESGTDTAHTIKSHHNVGGLPEDMQFKLIEPLRQLFKDEVRVLGEKLGLPHDLVWRQPFPGPGLAIRVIGEITEXKLXIVRDADAILREEVKNA

SEQ ID NO: 39217 - protein, 174 aa, Zea mays
  misc_feature (15)..(16): Xaa can be any naturally occurring amino acid
  misc_feature (26)..(26): Xaa can be any naturally occurring amino acid
  misc_feature (32)..(32): Xaa can be any naturally occurring amino acid
  misc_feature (41)..(44): Xaa can be any naturally occurring amino acid
  misc_feature (49)..(49): Xaa can be any naturally occurring amino acid
  misc_feature (51)..(52): Xaa can be any naturally occurring amino acid
  misc_feature (54)..(55): Xaa can be any naturally occurring amino acid
  misc_feature (61)..(65): Xaa can be any naturally occurring amino acid
  misc_feature (67)..(67): Xaa can be any naturally occurring amino acid
  misc_feature (71)..(71): Xaa can be any naturally occurring amino acid
  misc_feature (73)..(73): Xaa can be any naturally occurring amino acid
  misc_feature (75)..(77): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(92): Xaa can be any naturally occurring amino acid
  misc_feature (95)..(95): Xaa can be any naturally occurring amino acid
  misc_feature (97)..(97): Xaa can be any naturally occurring amino acid
  misc_feature (100)..(101): Xaa can be any naturally occurring amino acid
  misc_feature (104)..(105): Xaa can be any naturally occurring amino acid
  misc_feature (108)..(110): Xaa can be any naturally occurring amino acid
  misc_feature (113)..(116): Xaa can be any naturally occurring amino acid
  misc_feature (119)..(121): Xaa can be any naturally occurring amino acid
  misc_feature (124)..(126): Xaa can be any naturally occurring amino acid
  misc_feature (129)..(129): Xaa can be any naturally occurring amino acid
  misc_feature (134)..(135): Xaa can be any naturally occurring amino acid
  misc_feature (138)..(141): Xaa can be any naturally occurring amino acid
  misc_feature (143)..(146): Xaa can be any naturally occurring amino acid
  misc_feature (149)..(151): Xaa can be any naturally occurring amino acid
  misc_feature (157)..(159): Xaa can be any naturally occurring amino acid
  misc_feature (162)..(162): Xaa can be any naturally occurring amino acid
  misc_feature (167)..(167): Xaa can be any naturally occurring amino acid
  misc_feature (169)..(169): Xaa can be any naturally occurring amino acid
LKMLYLQHIRATKTXXLPAAFSRLMXVSSARXEDRGFETAXXXXVLGSXGXXAXXSWLWCXXXXXVXGAVXSXAXXXVGALVVVXPXRGXXXAGXVXGGXXLRXXFVXXXSSXXXXVGXXXAGXXXLVXVGPGXXVLXXXXLXXXXRVXXXPVVGGXXXLGXVSFGXVXRAVVA

SEQ ID NO: 39218 - protein, 259 aa, Bacillus pumilus SAFR-032
MEKILTLHHEGQTALITIQHPPANALSSQLLSELNDMFDQLEQNEEVRAIVIHGEGRFFSAGADIKEFTTLQEESDYSSLADRGQQVFERIEQCPKPVIASIHGAALGGGLELAMSCDIRIATKDAKLGLPELNLGIIPGFGGTQRLPRYVGSAKALEMMGTAEPITGEEAFACGLVSKLAETEEEALEAAKTLASKFATKSPKSLEYVLDLLNATKLYSYDGGMKLEAKKFGEIFQSNDAKEGIQAFIEKRKPNFKGE

SEQ ID NO: 39219 - protein, 495 aa, Staphylococcus aureus subsp. aureus MRSA252
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPNGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 39220 - protein, 644 aa, Oryza sativa Japonica Group
MRRRSLGVGGGGGGAEFAFADGNDTYRLNDFGFLHYAVVALGTPNVTFLVALDTGSDLFWVPCDCLKCAPFQSPNYGSLKFDVYSPAQSTTSRKVPCSSNLCDLQNACRSKSNSCPYSIQYLSDNTSSSGVLVEDVLYLTSDSAQSKIVTAPIMFGCGQVQTGSFLGSAAPNGLLGLGMDSKSVPSLLASKGLAANSFSMCFGDDGHGRINFGDTGSSDQKETPLNVYKQNPYYNITITGITVGSKSISTEFSAIVDSGTSFTALSDPMYTQITSSFDAQIRSSRNMLDSSMPFEFCYSVSANGIVHPNVSLTAKGGSIFPVNDPIITITDNAFNPVGYCLAIMKSEGVNLIGGYNFDESSRLPVNPSPSAVPSKPGLGPSSYTPEAAKGALPNGTQLRRGGMDRYQRVEKPREEAPIKENEIRITTQGRMRNYITYATTLLQDKGSDEVVFKAMGRAINKTVMIAELIKRRIVGLHQNTTTGSTDITDMWEPLEEGLLPLETTRHVSMITITLSKKELDTSSIGYQSPLPADKVKPLVEYENEEDAPSPAGRGRGRGGQGRGRGRGRGTRGNGYMDYADGGWEDDHAPPAYAGNGYTRGRGRGFRGRGRRGGGYGAQPDYQQDGGYYDEAPVHAPPRGGYMIC

SEQ ID NO: 39221 - protein, 208 aa, Zea mays
MDLHYGARVGEAMAVGEAAYIATAGAGVGAGPSTVVDVVTRESAAQALGTVVQLHFDKTVEKKRAADAQKQELWRLFLAFFFLLALVLSGVAASPPARLQCRHLWAPAGLLSLAHLAFYAAVAHHLRCLNGFRYQRRCHKLTLALAADRLRMLKSAADVVPAADVEVPYQEPPEAYLAKFRRSWAIHFAFLITTFAFCVAASVAILCF

SEQ ID NO: 39222 - protein, 338 aa, Archaeoglobus fulgidus DSM 4304
MELAVIVFAAAIAAIISRMLRITPIPAYILVGMALGKAGWHLSEVEFLGKLGIVFLLFYVGLKIPPSTIKKTWQRTLKSGTIDFLFNFLPPLVLLYLIGFDLRDAFILASAIYISSSAINLKMLVDDRKLVFTFAEVVVLLMVFEDIVLVALLFLFSASEPLTLLYLALIALTALALYAISPQIEKLMSREDEVPYLLTFSIPSISLFLAEKFRISEALMAILFGVALNRLRIDKMLVPFKEVFLAVFFVFFGTMVDLHFSYLSLLLIAVAVIGKLAGAYFIARFTTSKSDAVEVFKYTLARGEFTVIFPALFAPEFATTLAAVVLFTSIAGSLIAKL

SEQ ID NO: 39223 - protein, 502 aa, Pseudomonas sp. Y2
MTRSLTMNSSLSAIDGLRLPHQMLIGGQWVSAQSGKTLNVYNPATGDILTEVPDGDVEDVNAAVESAAGTLRSDTWRRMPPSARERILLRLADLLEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 39224 - protein, 287 aa, Pyrococcus horikoshii OT3
MNKVFVIGSGAKHLEEEISKNAKILKTEIKKFPDGEKYVRILEHGEEVIVVQSTYRPQDEHLIETIIIGDALKEAGFEKLKLVVPYLAYSRQDRVTKEGEPISVRAIMKMLGLYYDELYVFDIHNPKTLDFFPGKAVNIYPAKVIAEYFRDKLENGLVLAPDRGALERAKEVANILGLEYSHFEKERISPTEVKMTPVDVNVKGRNVLIVDDIISTGGTMIRAAEILKDLGAEKVFVVATHGVFAEGAIERVSKAVDELAVTNTIPTKVSKISIVPEIMRSILEVKS

SEQ ID NO: 39225 - protein, 434 aa, Bacillus cereus E33L
MNRLLMNENQKWNTFIETPFYTKVGKVHSVQEQFFVAKGPKAKIGDVCFVGEHNVLCEVIAIEKENNMLLPFEQTEKVCYGDSVTLIAEDVVIPRGNHLLGKVLSANGEVLNEDADNIPLQKIKLDAPPIHAFEREEITDVFETGIKSIDSMLTIGIGQKIGIFAGSGVGKSTLLGMIAKNAKADINVISLVGERGREVKDFIRKELGEEGMRKSVVVVATSDESHLMQLRAAKLATSIAEYFRDQGNNVLLMMDSVTRFADARRSVDIAVKELPIGGKTLLMESYMKKLLERSGKTQKGSITGIYTVLVDGDDLNGPVPDLARGILDGHIVLKRELATLSHYPAISVLDSVSRIMEEIVSPNHWQLANEMRKILSIYKENELYFKLGTIQENAENAYIFECKNKVEGINTFLKQGRSDSFQFDDIVEAMHHIV

SEQ ID NO: 39226 - protein, 135 aa, Zea mays
VFMFQKTAIHKCNLEGKPVIITRVVDSMIDNLRPTRAEATDVANAVLDGTDGILLGAETLRGLYPVDAVSTVGRICAEAETVYNQPLQFKKVMWHVGDPMPHEESIMFCLWDTPANLAAVLVCCCQYWPLKIQHR

SEQ ID NO: 39227 - protein, 470 aa, Desulfovibrio desulfuricans G20
MSNIGKITQVIGAVVDVEFADGNLPNILNALVIKNPNNADCPELICEVAQHLGDNVVRTIAMDATEGLVRGMEVTDTGNPIMVPVGSASLGRIMNVVGRPVDEMGDIDAAKSLPIHRPAPEFNEQNTNVELLETGIKVVDLLIPFPKGGKMGLFGGAGVGKTVILMEMINNIAKQHGGISVFAGVGERTREGNDLYHEMKDAGVLEKAALVYGQMNEPPGARARVALTALACAEYFRDEENQDVLLFVDNIFRFTQAGSEVSALLGRMPSAVGYQPTLGTDLGGLQERITSTTKGSITSVQAVYVPADDLTDPAPATTFSHLDGTLVLSRQIAELGIYPAVDPLDSTSRILDPNVVGAEHYSVAREVQMVLQKYKDLQDIIAILGMDELSDEDKQTVARARRIQRFLSQPFHVAEVFTGTPGVYVKLEETIKAFRGILNGEYDHLAENDFYMVGGIEMAVERYNQRQQAA

SEQ ID NO: 39228 - protein, 198 aa, Candida glabrata CBS 138
MSAFVTCGATVPFPALVEAVLAPEFVGCLSREGYRVLCVQFGRGYDFEAQFTSVTCTRMPLESAEVSELRQLVRDERVTVMGYKVQDVVVLGFAYSNNILQIIDRYGDVVISHAGTGSILDSLRLNKKLIVVVNHTLMDNHQKQIAEKFQNLGHILATNPTAIELCDAMKRLKHEDLIPLSSETNTEFMERLKSIAYS

SEQ ID NO: 39229 - protein, 468 aa, Staphylococcus aureus subsp. aureus N315
MTQQIGVIGLAVMGKNLAWNIESRGYSVSVFNRSSEKTDLMVEESKGKNIHPTYSLEEFVNSLEKPRKILLMVQAGKATDATIDSLLPLLDDGDILIDGGNTNYQDTIRRNKALAQSAINFIGMGVSGGEIGALTGPSLMPGGQEEAYNKVADILDAIAAKAKDGASCVTYIGPNGAGHYVKMVHNGIEYADMQLIAESYAMMKELLGMSHEDIAQTFKDWNAGELESYLIEITGDIFMKLDENKEALVEKILDTAGQKGTGKWTSINALELGIPLTIITESVFARFISSIKEERVNASKELNGPKASFDGDKKDFLEKIRKALYMSKICSYAQGFAQMRKASEDNEWNLKLGDLAMIWREGCIIRAQFLQKIKDAYDNNPGLQNLLLDPYFKNIVTEYQDALRDVVATGVQNGVPTPGFSSSINYYDSYRAADLPANLIQAQRDYFGAHTYERKDKEGVFHTQWIEE

SEQ ID NO: 39230 - protein, 474 aa, Nocardioides sp. JS614
MPEYKLPDPGEGLTEAEIVKWHVAVGDVVEINQVVVEIETAKSIVELPSPYAGEVSAILVAEGELVPVGTPIIAIGDDVAAEPAAGAAPEARAAAPVEIDLSNPAASGGGEGESLVGRNKADRGPVRRARKVTSGAMAAHMQAQAAFETGGAPMVEADEEPVPATAAAPLDAPAAVRTLAKPPVRKLAKDLGVDLTTLTPSGPNGTVSREDVEAAAGGDAVLGGRVAAGERGGESRPAEREWREPIKGVRKMMGQAMVQSAFTLPHVTEWVTVDVTATMELVERLKTRREFREVRVSPLLVLARAVMLAMRRTPEINSWWDDAAHEVVYKRYVNLGIAAATPRGLVVPNVKDAESMTLLELAQAINAVTATAREGKTQPAEMSGGTFTITNVGVFGVDSGTPIINPGESAILAFGAVRKQPWVVETDGQDTIVPRQICTLALAFDHRHIDGEKGSRFLADVAEIMADPATALLY

SEQ ID NO: 39231 - protein, 358 aa, Oryza sativa Japonica Group
MAASSPASSGKAASDSSAPAVAVANGNGTTPQKLPPASAFDMPKPNLRGLNKPKCIQCGNVARSRCPFQCCKSCCYKAQNPCHIHVLKQNNTLPDKPPLSTAPLSEQPSANIPSTGSSRLASLQRLPHHFLNSLRTKKSLAKKDVMGINKWRFEKLKEHIQGDIDAENEAYERYTQNVGLLEETFGLTEDAADEPEPEATSSEERMETLVSEAKVRLKSDSANADGFRDRIATILDQKIKELLESKSTYEDDNPPDQNPDDHPKPVKLSIKQQMERGAKMTELLAKMIRAQSEVDLKICSGIAAQLFGKKNELSNQESVASVTIPYSFPKLWTRVEIDDAMMCKINGEFSSSTEVMQL

SEQ ID NO: 39232 - protein, 292 aa, Vibrio parahaemolyticus RIMD 2210633
MSIKIKTAEEIERMRIAGKLAAEILEMIEPHIQVGVTTDELNKICHEYALEKGAYSAPLDYHGFPKSICTSINHIVCHGIPAEKDEIGSNGQMKPAVLKDGDILNVDITVIIPNDENADLSVRPQGYHGDTSKMFLVGDVSPANKRLCMVAQEALYVGMRTVKPGSTVGDIGTAIEKYIKENNKNNPRNKFSIVKDFCGHGIGDEFHEEPQVVHYKNKDRRVLKEGMCFTIEPMINAGKFGCTVDAQDDWTVYTGDGKNSAQWEHTIVVTKDGCEVLTLRSDDTIPRLMKNA

SEQ ID NO: 39233 - protein, 218 aa, Neisseria meningitidis MC58
MAFTLMRRAMIRKMPYTEDMRPGDTANPYGASKAMVERMLTDIQKADPRWSMILLRYFNPIGAHESGLIGEQPNGIPNNLLPYICQVAAGKLPQLAVFGDDYPTPDGTGMRDYIHVMDLAEGHVAAMQAKSNVAGTHLLNLGSGRASSVLEIIRAFEAASGLTIPYEVKPRRAGDLACFYADPSYTKAQIGWQTQRDLTQMMEDSWRWVSNNPNGYDD

SEQ ID NO: 39234 - protein, 363 aa, Erwinia carotovora subsp. atroseptica SCRI1043
MTKSYHIAVLPGDGIGPEVMAQAHKVLDAVRQRFGIRITTSEYDVGGIAIDRQGTPLPQATVAGCEQADAILFGSVGGPKWEHLPPAEQPERGALLPLRKHFKLFSNLRPARLYQGLEAFCPLRSDIAAKGFDILCVRELTGGIYFGQPKGREGSGQYERAFDTEVYHRFEIERIAHIAFESARKRRSIVTSIDKANVLQSSILWREIVTEVAKAYPDVKLSHLYIDNATMQLIKDPSQFDVMLCSNLFGDILSDECAMITGSMGMLPSASLNEQGFGLYEPAGGSAPDIAGKDIANPIAQILSLALLLRYSLGADDAAEAIEKAVNTALAEGYRTADLASASNAIGTSEMGDVIARFVAQGA

SEQ ID NO: 39235 - protein, 228 aa, Oryza sativa Japonica Group
MAAEAAAALEGSEPVDLAKHPSGIIPTLQNIVSTVNLDCKLDLKAIALQARNAEYNPKTQHEVLGDFVTICNIRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQCVLYKYRNNT

SEQ ID NO: 39236 - protein, 925 aa, Arabidopsis thaliana
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVPIFDGSAKEWVDAIQGVGINAAQNHDGESVEKMVAHVNKPVYVCKNDTFVAAFPALETRITCGIDFPQVPAIGCQWFSWRPIHESSFAKDIASSRTFCVYEEVERMREAGLIKGGSLDNAIVCSAEHGWMNPPLRMRRRRCDLQPKRTRMCDLQPKRTSMCDLPPKLVGEKILTRIPITSLRAVRSTCKLWNALTKDRVLVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 39237 - protein, 462 aa, Photobacterium profundum SS9
MSQTAFSTLNLHADLLKNLTSLGYESMTPIQALSLPHILAGEDVIAQGKTGSGKTAAFGLGLLEKLNVKRFRVQSLVLCPTRELADQVAKEIRKLARTIHNIKVLTLCGGMPFGPQIGSLEHGAHIIVGTPGRIEEHVRKGTLNLDDLEILILDEADRMLEMGFQDSLDEIIDAAPQRRQTLLFSATYPPQIKSVADRIMHKPVMAKVESTHDESTIQQHFYKVDGNEQRLTALRLLLLKHRPESTVVFCNTKREAQEVSDDLVDYGFSSIALHGDLEQRERDQALVLFANKSTSVLVATDVAARGLDIDSLDAVINYHLARDTEVHVHRIGRTGRAGSKGIACSLISDKEHYKVAMLEDYLDRAISGEPLPSMDLLDQPTFRPAMTTLQIDGGKRQKIRPGDILGALTGESGIAGAQVGKIQIFDNFAYVAVKSESVRAAMKKLEDGKLKGRSFRVRQIRG

SEQ ID NO: 39238 - protein, 383 aa, Arabidopsis thaliana
  misc_feature (1)..(1): Xaa can be any naturally occurring amino acid
  misc_feature (15)..(15): Xaa can be any naturally occurring amino acid
  misc_feature (85)..(85): Xaa can be any naturally occurring amino acid
  misc_feature (87)..(87): Xaa can be any naturally occurring amino acid
  misc_feature (159)..(159): Xaa can be any naturally occurring amino acid
  misc_feature (190)..(190): Xaa can be any naturally occurring amino acid
  misc_feature (228)..(228): Xaa can be any naturally occurring amino acid
  misc_feature (284)..(284): Xaa can be any naturally occurring amino acid
XEESRESPAEHGYYXPAEWDSHAQTWIGWPERQDNWRHNALPAQRVFAGVAKAISKFEPVTVCASPAQWENARKQLPEDIRVVEXSXNDSWFRDSGPTFIVRKRPVKLSSLNRNIAGIDWNFNAWGGANDGCYNDWSHDLLVSRKILALERIPRFQHSXILEGGSIHVDGEGTCLVTEECLLNKNRNPHXSKEQIEEELKKYLGVQSFIWLPRGLYGDEDTNGHIDNXCCFARPGVVLLSWTDDETDPQYERSVEALSVLSNSIDARGRKIQVIKLYIPEPLYXTEEESSGITQDGEAIPRLAGTRLAASYVNFYIANGGIIAPQFGDPIRDKEAIRVLSDTFPHHSVVGIENAREIVLAGGNIHCITQQQPAEPTSVAENGH

SEQ ID NO: 39239 - protein, 835 aa, Photobacterium profundum SS9
MVSIVIVSHSPDLAKGVHALAEQMTQGKVQIAVAAGVNDPENPIGTDAIAIMMAIEEVYSPEGVLVLVDMGSAILSTDMALELMGSEQTTNVHICAAPLIEGAMSASVAAAAGMSLEEVTNEAHNALLAKYQLLNQSAKLPNGIPTDVLPTPADSENETEIEWLVQNPHGIHARPASAIVAAISTFDAQIWLRCHDRRVSAKSINSIALLDVKQGDTLVCIASGKEAQQALQAFKLLAHNHFNESIDEQIDVMNKQNSVNTIHQVTDIIEDEHGCLRAIGISEGIAIAPIWHYRATMPKARDRSYLGYEQEWTLYTQASDAAQQELSQLADRTAHAGSKSESDIFTAHCAMLADPDLSNQIAQQLSNKINVENAWSSIIEQTAQAYKDVSSEYMQARAKDIYDIGRRVMRLLIGEAEQKIVLTEPVILAAVDLSPSDTAQLDPTMIKGIILEQGGSTSHSAILARALGIPAITGLNKLMSRSQEGSVAVINGCSGEVWLSPTSLQLESAQKELEKQQFQKEQAQATMIEKAYTQDGVSVDVFANLATLDDAEQALNSGAEGVGLVRSEFLFMEREQAPSEQYQYEFYSQIANSFGNKQVIIRTLDIGGDKPLAYLQQGHEDNPFLGCRGLRLCLQNEELFKVQLNALLRARAKHPNLHVMFPMVATPEELHQAKSLLSDCHNALQRDGISSTIPEIGIMIEVPAAVVNAKQLAKEVSFFSVGTNDLTQYVMAADRGNNAVSYLVSSTQPAVLRMIELAVKAAHDAGIPIGICGEMAGDPKLTETLIGMGIDKLSMSPIRIAAVKQAVRATHHQQAERKAKEVLNAETLPQILAIL

SEQ ID NO: 39240 - protein, 236 aa, Fusobacterium nucleatum subsp. vincentii ATCC 49256
MSGKGGVGKSTVTTLLAKELRKKGYAVGVLDADITGPSIPRLMGVSEQKMTTDGKNMYPVVTKDGIEIVSINLMIDENEPVVWRGPVIAGAVIQFWNEVVWGDLDYLLIDMPPGTGDVPLTVMKSFNIKGLIMVSVPQDMVSMIVTKAIKMARKLNMNIIGLIENMSYITCDCCNNKIYLTDENDTQTFLKENDVELLGELPMTKQIAKLTKGENEYPEEIFSKIADRVIEKVKEL

SEQ ID NO: 39241 - protein, 107 aa, Lactobacillus delbrueckii subsp. lactis
  misc_feature (104)..(104): Xaa can be any naturally occurring amino acid
LKAAEGSNLHVGAENCYWENSGAFTGETSPAVLKEMGVQYVIIGHSERRDYFHETDEDINKKAKAIFANGLTPILCCGESLEIREAGKEKEWVVSQIKADLEGXTSE

SEQ ID NO: 39242 - protein, 99 aa, Nostoc punctiforme PCC 73102
MATYQVRLINKKEDIDTTIEVDEETTILEAAEENGIELPFSCHAGSCSSCVGKVVEGEVNQEDQNFLDDDQVSKGYALLCVTYPRSNCTIKTHQEAYLV

SEQ ID NO: 39243 - protein, 657 aa, Bdellovibrio bacteriovorus HD100
MAATDVDVFCNAVRVLEPTFGGINLEDIKAPECFEIEERLKKEMNIPVFHDDQHGTAIVSGAALLNACSITNRKMETVRIVVNGAGASANSCAKIFIALGARRENIIMCDSQGVIYKGRTAGMNKYKEYFASETEARTLTEALRGADVFVGLSVAGALTPEMLKDMAKDPIIFAMANPEPEITPDKARAARPDAIIATGRSDYPNQVNNVLGFPSIFRGALDTRSTQINEEMKLAAVHALAKLAREDVPDKVSATYGGKSFKFGRDYLIPKPFDTRVLLWVAPEVAKAAMKSGVATRAIEDWDQYRESLEALQGPSKVFIRSAINRVHQNSAANGGELPRIVFPEGTSTKVLKALATLVEEKICQPILLGYPERVKEKIKALDIPLLNDVSIVHPSSHPKYFSFVEKLYSLRQRKGINLGEAERLMADPNYFAAMMVNQGEADGMVSGSSINYADAVRPILQTIGVYKEGIPAGLNFVLLEDKFLVLADTTVNLNPTAEQCAQIALQAAKIVEYFGIEPRVAMLSYSNFSGAEGTPRKMKKAAEIARSLRPDLMIEGDMQADTAVNPEIMERLFPFSGLKGGANVLVFPNLESSNIAYKLIQQIGKAEVIGPFLTGVRRSANVLQRTTTVDGIVNSVVFTALEAQYIKEVLKSRGKK

SEQ ID NO: 39244 - protein, 122 aa, Bdellovibrio bacteriovorus HD100
MDNKTETKIEPKTGTTNFDQEALLYHQQGKPGKIEVISSKPCATEKDLSLAYSPGVAAPCKAIAKDPAKVYDYTAKGNLVAVISNGTAVLGLGNIGPAAGKPVMEGKGILFKQFAGIDVFRH

SEQ ID NO: 39245 - protein, 411 aa, Saccharomyces cerevisiae
MDATTPLLTVANSHPARNPKHTAWRAAVYDLQYILKASPLNFLLVFVPLGLIWGHFQLSHTLTFLFNFLAIIPLAAILANATEELADKAGNTIGGLLNATFGNAVELIVSIIALKKGQVRIVQASMLGSLLSNLLLVLGLCFIFGGYNRVQQTFNQTAAQTMSSLLAIACASLLIPAAFRATLPHGKEDHFIDGKILELSRGTAIVIPIVYVLFLYFQLGSHHALFEQQEEETDEVMSTISRNPHHSLSVKSSLVILLGTTVIISFCADFLVGTIDNVVESTGLSKTFIGLIVIPIVGNAAEHVTSVLVAMKDKMDLALGVAIGSSLQVALFVTPFMVLVGWMIDVPMTLNFSTFETATLFIAVFLSNYLILDGESNWLEGVMSLAMYILIAMAFFYYPDEKTLDSIGNSL

SEQ ID NO: 39246 - protein, 426 aa, Daucus carota
MKGSMAKICKQIMSVFLVLMIVGVSSDDQQQSWWKWFSSGASSSVVSSVGSSVVLPLYGNVYPSGYYHVQFNIGQPPKPYFLDPDTGSDLTWLQCDAPCIQCTPAPHPLYQPTNDLVVCKDPICASLHPDNYRCDDPDQCDYEVEYADGGSSIGVLVNDLFPVNLTSGMRARPRLTIGCGYDQLPGIAYHPLDGVLGLGRGSSSIVAQLSSQGLVRNVVGHCFSRRGGGYLFFGDDIYDSSKVIWTPMSRDYLKHYTPGFAELILNGRSSGLKNLLVVFDSGSSYTYFNTQTYQTLLSFIKKDLHGKPLKEAVEDDTLPVCWRGKKPFKSIRDAKKYFKPLALSFGSGWKTKSQFEIQQESYLIISSKGSVCLGILNGTEVGLQNYNIIGDISMQEKLVIYDNEKQVIGWQPSNCDRPPKGDTFSM

SEQ ID NO: 39247 - protein, 324 aa, Nocardioides sp. JS614
MGDDSRTGRGRYLTSGDFDRDMTYIPDRITKDGRRPEHGPVQGGLWPVEPGRYRLVAAKACPWATRSIIVRQLLGLEDVISMGLCGPTHDERSWTFDLDPGGRDPVLGIERLQEAYFARYPDYPRGITVPAVVDVPTGAVVTNDFPWITHDLFFEWRDHHRPDAPDLWPDDLREEMDQVMQRIFTEVNNGVYRCGFAGTQEAYDAAYDRLWTALDWLEERLADRRYLMGDRLTEADVRLFTTLARFDAVYHGHFKCNRNKLAEMPVLWAYARDLYQTPAFGENTDFDQIKAHYYVVHEDINPSKVVPKGPDPSVWLTPHGRDRL

SEQ ID NO: 39248 - protein, 307 aa, Archaeoglobus fulgidus DSM 4304
MKHLLSMADLEKDELFEILKLAEKLKEERYKGVVTDYLKNKSLAMIFELPSTRTRVSFEVAMTDLGGHALYLGWDELQLGRGEPIKDTARVLSRYVHAVMMRVREHSTIEEFARYSTVPVINGLSNLEHPCQVIADLLTIYEYRGDFKDVTLAWVGDGNNVCNSMILAAALTGMKMVISTPENYDPNPEIVKKAEEMGAKLRFVRDPKEAVKEADVIYTDVWTSMGQEAEKEARLKAFQPYQVSDELLKFSKDDVVVMHCLPAHRGEEITDEVMEGKHSIVFDQAENRLHAQKAILLKLLGKESEVY

SEQ ID NO: 39249 - protein, 162 aa, Glycine max
  misc_feature (60)..(60): Xaa can be any naturally occurring amino acid
  misc_feature (124)..(124): Xaa can be any naturally occurring amino acid
KIMQAVKKGDTIFIGKYLFTRSETASVWLEVREEKGEDVTCLVKMTATLSGSLFTVHVSXICIDLPTLADKDKEVISTWGVRNNIDFLSLYTRHVEDIRHAREFLSKLGDRKQTHIYAKIENTXGLQHFDEILREADSIILARGNLGIELPSEKEVMQFSLE

SEQ ID NO: 39250 - protein, 300 aa, Nicotiana tabacum
RPPTLSDMPAGEYRNATPATPHPPTDTAEESTWLWTQIKAEARRDAEAEPALASYLYSTILSHSSLERSLSFHLGNKLCSSTLLSTLLYDLFLNTFSNEPELRAAASADLLAARYRDPACVSFSHCLLNYKGFLACQAHRVAHKLWTQSRRPLALALQSRISDVFAVDIHPAAKIGKGILFDHATGVVVGETAVIGNNVSILHHVTLGGTGKIGGDRHPKIGDGVLIGAGATILGNVRIGEGAKIGAGSVVLIDVPPRTTAVGNPARLVGGKEQPTKHEECPGESMDHTSFISEWSDYII

SEQ ID NO: 39251 - protein, 411 aa, Saccharomyces cerevisiae
MDATTPLLTVANSHPARNPKHTAWRAAVYDLQYILKASPLNFLLVFVPLGLIWGHFQLSHTLTFLFNFLAIIPLAAILANATEELADKAGNTIGGLLNATFGNAVELIVSIIALKKGQVRIVQASMLGSLLSNLLLVLGLCFIFGGYNRVQQTFNQTAAQTMSSLLAIACASLLIPAAFRATLPHGKEDHFIDGKILELSRGTAIVILIVYVLFLYFQLGSHHALFEQQEEETDEVMSTISRNPHHSLSVKSSLVILLGTTVIISFCADFLVGTIDNVVESTGLSKTFIGLIVIPIVGNAAEHVTSVLVAMKDKMDLALGVAIGSSLQVALFVTPFMVLVGWMIDVPMTLNFSTFETATLFIAVFLSNYLILDGESNWLEGVMSLAMYILIAMAFFYYPDEKTLDSIGNSL

SEQ ID NO: 39252 - protein, 256 aa, Staphylococcus aureus subsp. aureus MRSA252
MKFIVIKIGGSTLSDMHPSIINNIKHLRSNNIYPIIVHGGGPFINEALSNQQIEPHFVNGLRVTDKATMTITKHTLIADVNTALVAQFNQQQCSAIGLCGLDAQLFEIKRFDQQYGYVGVPTTLNIDSLSYLCTKFVPIINSIGFNNHDGEFYNINADTLAYFIAASLEAPIYVLSNIAGVLINDVVIPQLPLADINQYIEHGDIYGGMIPKVLDAKNAIKNGCPKVIIASGNKPNIIEAIYNNDFVGTTILKSSV

SEQ ID NO: 39253 - protein, 394 aa, Staphylococcus aureus subsp. aureus MRSA252
MNSIIELTDYYSSNNYAPLKLVITEGKGGKVWDTDGKQYIDCISGFSVANQGHCHPTIVKAMTEQASKLSIISRVLYSDNLGKWEEKICHLAKKDKVLPLNSGTEAVEAAIKIARKWGSDVKGITDGQVEIIAMNNNFHGRTLGSLSLSNHDAYKSGFHPLLQGTKTVDFGDIEQLTQAISPNTAAIILEPIQGEGGVNIPPKGYIQAVRQLCDKHQILLIADEIQVGLGRTGKWFAMEWEQVVPDIYILGKALGGGLYPVSAVLANNDVMRVLTPGTHGSTFGGNPLAIAISTAALDVLKDEQLVERSERLGSFLLKALLQLKHPSIKEIRGRGLFIGIELNTDAAPFVEQLIKRGILCKDTHRTIIRLSPPLVIDKEEINQIVAAFQDVFKN

SEQ ID NO: 39254 - protein, 326 aa, Xanthomonas campestris pv. vesicatoria str. 85-10
MHRTPPAHVVISGASSGIGQATAEAFAEQGARLVLAARGEEALNAVAERCRARGAEVLVAPTDVKQAEQVKALATSAQSFLGRIDLWFGNVGVGTVGKFHEVPMEASAAVIHANLLGRMHDAHAAIPIFVEQGHGIFVNMISSGGFASTPFAAAYGASKFGQRGFSEALRAELSDYPHIHVCDVYPYFVDTPGLTHGANYVGRRISGPPLMLDTRTVAAAVVRLLDRPRNTVVLGTAVHAMRLGHALAPQTLARAMYRIFKQYLAQAPQVARSSGNVFAAPGIAGGIDGGYRRRPALRARSAHDKMLIGAAAAAVTGLAVLALRRK

SEQ ID NO: 39255 - protein, 292 aa, Nocardioides sp. JS614
MTRQPLVARRAEELLGSSVVATAPIAGGDISTATRLRLSDGTTALMKTLPHAPDEFFAEEAAGLRWLAEATPAGGAQVPEVLGVDHECVIVRWVEPGKNSVDAATAFGRALAATHAAGAPSYGRDRDGFIGRLPMPNRPTDTWAEFYAARRVLPYLKLARDRGAATAEQAAAIEAVLPRLADLVPEEPPARLHGDLWNGNVLWGLDGQAWLIDPASYGGHREVDLAMLALFGLPHLPRVLDAYAEATAGTTPLADGWADRVALHQVFPLLVHACHFGGGYAGRAAEAAARFV

SEQ ID NO: 39256 - protein, 533 aa, Arabidopsis thaliana
MAAITVDFQLCFIFILLGIFSLFCLSAFFFKKPKDPQLQGCGLPPSPPSLPVIGHLHLLLSVPCHKSFQKLSSKYGPLLHLRAFNIPIVIVSSGSMANEVLRTQDLNFATRQREVSIMEKSLLFGSFGFVSAPYGDYWRFMKKLLVTNLFGSHSLEQTRLIREKELKTFRTMLFDKAAKKGTVDVGKEMMKLTNNSICRMIMGRRCSEENSEAEKVEDLVIKSFSLVKKVLIANTVGRLLKKFGISLFEKEIMEVSQRYDELLEKIIKEHEEDPNKKEDRDMMDVLLEVCADDKAEVKITRNQIKALIVELFLGGTDTSAQTIQWIMAELINHPEILKILREEIESVVGTTRFIQETDLSNLPYLQAVMKEGQRLHPHSPMLVRNATKGCKIGGYYIPQNTTMLINTYAMMIDPDSWENPDKFQPERFMVSPSKGKDDEREQLALNFIPFGSGRRACPGEKLGYLFTGVAIGTMVQCFDWIIDGDKVNVEEAGEMTLTMAHPLKCTPVTRVNPLASFESEDPKWLMEEFDMYC

SEQ ID NO: 39257 - protein, 243 aa, Vitis vinifera
MEIGRDDGRTANQLRPLACSRNILNRAHGSASWSQGDTKVLAAVYGPKAGTKKNENPEKACIEVVWKPKTGQIGKPEKEYEVILKRTLKSICLLNINPNTTTSIIIQVVSDDGALLPCAINAACAALVDAAIPLKHLAVAICCCLTESGYVILDPTKVEEQKMKAFAYLVFPNSAISIIPEGSSHMEGELMEHGIITSVTHGVMSVDDYLHCLERGQAASTKMSAFLRRSLQSQAPNDSSRAG

SEQ ID NO: 39258 - protein, 187 aa, Bradyrhizobium sp. ORS278
MAPGLVDAAHRDLDAIAAHDPATTALLPPLLNYKGYIALQAFRVAHWLWTAGRSDLALLLQAESSTALQVSMHPSARIGTSVFLDHATGIVIGAHSSIGDEVTILQNVTIGRRDALPGRGPRIGRGVLLSSGAIVLGDVAIGDFAKIGAGAVVTADVPAGCTAVGTPARLTNCPRQPVSTQSDHGTA

SEQ ID NO: 39259 - protein, 632 aa, Fusobacterium nucleatum subsp. vincentii ATCC 49256
MAILQVNDIYMGFSGETLFKDINFSVDEKDKIGIIGVNGAGKTTLIKLLLGLENSEINPATNERGTISKKSNLKVGYLAQNTQLNKENTVFNELMTVFNNLLEDYNRMQEINFLLTVDVDNFDKLMEELGEISERYERHEGYSIEYKIKQILNGLNIPENLWTMKIGNLSGGQNSRVALAKILLEEPDLLILDEPTNHLDLTSIEWLEKILKDYNKAIILISHDVYFLDNVVNRIFEIEGKRLKDYKGNYTDFLIQKEAYLSGEVKAYEKEQEKIKKMEEFIRRYKAGVKSKQARGREKILNRMEKMENPVVTTKKIKLKFDIKAQSVDLVLDIKNLSKTFEDKLLFKDLNLKIYRGERIGLIGKNGTGKSTLLKIINGIEKASSGEFKIGERVSIGYYDQNHQGLGLNNNIIEELMYYFTLSEEEARNICGAFLFREDDIYKKISSLSGGEKARVAFMKLMLEKPNFLILDEPTNHLDIYSREILMDALEDYPGTILVVSHDRNFLDTVVNKIYELKTDGVETFDGDYEAYKQERDNIKVKNEEAVKSYEDQKKAKNKLASLEKKLIKLEEEIQKIEAQKEEINKKYLLAGEKNNIDELMSLQEELDSLDNKILKKYQEWEEIEEELKNLQ

SEQ ID NO: 39260 - protein, 787 aa, Zea mays
MDSSRSWIFTELGQPTYCPETFPEVPFERPTPPIIFFDEEHIFEEESSSSTTATPRNPSDPKQAGGDLDSIATAALSASEEIPQSLLVIDLERATSKCIRTHAVNDVPAVHSIIKGLQLERIGLAGSAPDLDTLTTARHCGSELSCQLGSNKRDVSLRVGCDQSYEWVDPETLDRSFVVLDNACATHEVFEVLPLSFPAAWVNVGKLPTTLCWKIPWPPPVLWVNLHAGGRYITSLLEECQLVFTIFFGGVCSLAKIQWPYMVLEYLANLHVIHGKIHMHPVQVCVRSYAVMPSAKGLVAETHLHFIGTYRGVVSTAFCTEIVESADAYIFADSIFKDYSSVGYSFLLKKAKAIIVQPERVGVGNGLSFRCLMMKEYWTEIAKKVKKNTTTYENYKRNFVPEGQALESEPNEPLRVNVLFKYIQKMMTVNSVVMAETDDSWFNCHKLKLPESYGYQFQMQYGLIGWSMGALLGYAQGANHKILSPVTALHPLVAVCYDHDIIMDAAGFGDELVVISLGADCQIIASYHRWPFGQTGTGHFSPIGGYQVRQDMVLILDVARFIPLQFFWEAMNTTNDSTLRGSMLISRKVAESSLLYTVSCRDENWKIMPKFCVEDLPSLLKAGIGACVGLVTSSLSAVSSDQGNFSVFVWDPGDRGLVTYGLRVVSIARVTAIMSGTYARAAATTSSPKMRQTQFRWRAEERRDAFNNDANPQMKLILHRQRLGGKPRFKEWGMLGVAAMWGHCQGARAAAETESWRRINGGSEEVGEEVEEEAAAARMSTLLWNMV

SEQ ID NO: 39261 - protein, 717 aa, Bdellovibrio bacteriovorus HD100
MSIQESIKIVPQGEVAVVEFDLVGEKVNKFSTPVMMRLKEVVEELKKSSYKAVIFKSNKPKIFIAGADIEEIKSMTKAEEFEAAVKGGQEVISMVEDLPMPTIAAVNGACMGGGCEFILACDYRIASEDSSTKIGLPEIQLGILPGFGGCIRMPRVIGLQAALDIILAGKSVNSKKALKIGLVDKVVHPNLLESFSLKWAKEIIADGAKKRRKTFKPQGAVNVILESALGRSIVFKKAREGVLKATKGHYPAPLQALEVIQKTYGMSDRDAALRIEREGFCKLGVTDISKNLIHVFYLTEMVKKQNGVPGVDVKPRDVKGLGVLGAGTMGGGIAYVAADKGIQVRMKDLNTDALGKGLKHASDLWMKLVKRKSIDKYQFQQKMDLVSVSTDYAGFKNLDVVVEAIVEDMGIKQKVIGECAGQMRPDAIIATNTSSLSVTEMAKGHPRPEYFAGMHFFNPVNKMPLIEVIRGEKTSDETIATIYELSKKMGKMPVVVKDGPGFLVNRLLLPYMGEAAFLLQEGMSIEFVDKVYVKEFGMPMGPFELMDEVGLDVCLKVLKIFKKAFGERIELAPCMEALGNSGRLGRKNGKGFYTYSEDGKRGAVDQTVYAALGLGQPTNPYDSKECIERGVFAMINECSLALVEDRIVETPHEVDLAMIMGTGFPPFRGGLMKYTDSIGTQYVADQLAMYASSRKAARLKPATPLTNMAKSNSKFYK

SEQ ID NO: 39262 - protein, 323 aa, Fusobacterium nucleatum subsp. vincentii ATCC 49256
MSILVCGGAGYIGSHVVKYLLEKNEDVVVVDSLITGHVDAVDEKAHLELGDLKDEEFLNRVFEKYQIDGVIDFAAFSLVGESVGEPLKYFENNFYGTLCLLKVMKNHNVNKIVFSSTAATYGEAENMPILETDRTEPTNPYGESKLAVEKMFKWCANAYGLKYTALRYFNVAGAYPSGEIGEAHTCETHLIPLILQVALGQREKISIYGDDYPTPDGTCIRDYIHVMDLADAHYLALNRLRDGGDSQIFNLGNGEGFSVKEVIEVTRKVTGHPIPAEVSPRRAGDPARLIASSKKAIDVLKWKPKYNKLEQLLKLLGTGIKSS

SEQ ID NO: 39263 - protein, 583 aa, Novosphingobium aromaticivorans DSM 12444
MKMPPLLLRYAPLAGVLLASACVPPPSAPVAPAPRPAADGSVPVEGPGLVSAADPRAAEAGAQMLRLGGSATDAAIATMLALTVVEPQSSGIGGGGFLVTGDAAGAVSTIDGRETAPRAATPEWFYVGGKPLPYADAIPGGRSVGVPGNLRLAAHAHNARGRLSWRTLFQPAIRLARDGFAITGRLRSSLESFARTGALDPAARALFYGPDGQPLPVGTIVRNPALAATLEGIAARGADSFYTGDNAATLAAKVGTAPVNPAPMTTADIAAYKAVERTPLCGQYRTYRICGMGPPSSGATTVYAILEQLERFDMKTLGPASPVAWHLIAESQRLAYADRDQYLADADFVQVPVAGLSDPAYLAGRSALISESATMPTVLPGTPPGAKLAFARAEPQDENGTTHFVAVDRWGNAASYTSTIEGPFGSGLMVGGYYLNNELTDFNIVPDKDGKPTANRVEGGKRPRSSMAPTLVYGPDGKLRLAIGAAGGATIPAQVAKAIIGVLDWNLSARDAIALPVIFAPGGDTVFVERGTSLEAMIPALQKLGHAKILARPPGFKANAIERVGNTWRGAADPRSEGIAVAP

SEQ ID NO: 39264 - protein, 526 aa, Glycine max
MHSSPLLLEEPIRMASILEPSKPTFFPAMTKIVGTLGPKSRSVDIISHCLDAGMSVARFDFSWGDPEYHQETLENLRVAIKSTKKLCAVMLDTVGPELQIENKTDHPITLEADTLVVLTPDQTKEAGSNLLPVNFNGLSKAVKKGDTIFIGKYLFTGSETASLWLEVSEVKGEDVTCLVKNTATLSGSLFTAHVSQIHIDLPTLADKDKEVISTWGVRNNIDFLSLYTRHVEDIRHAREFLSKLGDLKQTHIYAKIENIEGLKHFDEILREADGIILARGNLGIELPPEKVFLFQKAAIYKCNMVGKPVVVTRVVDSMTDNLRPTRAEATDVANAVLDGSDAILLGAETLRGQYPVETISIVGKICAEAEKVHNQDLYFKKAVKYVGEPMSHLESIASSAVRAAIKVKASVIICFTSSGRAARLIAKYRPIMPVISVVIPQLKTNQLRWTFTGAFEARQSLIVRGLFPMLADPRHPAESKSGTNESILKVALDHGKAFGIIKPHDRVVVCQKVADSSVVKILELED

SEQ ID NO: 39265 - protein, 87 aa, Brassica napus
  misc_feature (35)..(35): Xaa can be any naturally occurring amino acid
MDSFSSSPSSSGPGANPDVVMEQIKTQLAQAYAQXFLETVGNKCFEKCVTKPGSSLSGSESSCISRCVDRYIEATGIVSRALFTSQR

SEQ ID NO: 39266 - protein, 391 aa, Physcomitrella patens subsp. patens
MEDQPQSKRRRRPSVRLGEIGFAAPYNASALWTEAPKHRKKQAGAGTSSSAERGLSAGKAINGVKPPRIRPLEHVAGDKAAIEEEWSVVEPAAASADEAKVAQTVTGDGAAPVSTLIEEQQAKRRRGFVSKANGKVRGKGPGGARSGWASTGKQDEATISELPVDTDLLETREGEEKEKESLPLQADDEAPFLAEISSGSEELMGSELKGNEELPADDSGNGASDGSEEHDTHANPNSHGDEMQGAIEDGPGQANGNGFITVKQRGGERRSGRQTARGVIACRDIVSRDTVSRDTSGEPSGRFQAATAAPNGTTIITPSSSQRVSLSSGVSGWLQEFGLSKYAELFELNEVDTEVLPLLTMDDLREMGVDAVGARRKMFTAIQELGQLRGI

SEQ ID NO: 39267 - protein, 183 aa, Bordetella parapertussis 12822
MPRPFGRTSPEKPESLMTIKVGDRVPDGTLTEFIETETAGCTLGPNAFQVADLVKGKKIALFAVPGAFTPTCSAKHLPGYVEQAAALRAKGIDEIWCVAVNDAFVMGAWGREQQAGGKVRMLADGSALWTTALGLELDLVQRGMGVRSQRYSALIDDGVVKQLNIEAPGKFEVSDAATMLAQA

SEQ ID NO: 39268 - protein, 474 aa, Glycine max
MATILSPIQTLKFRSPNPKPLFSPKPPPISTPLTFRADKLTLFVSSATSSATVSTNGPPSPPSPARSKVRRHTISVFVGDESGMINRIAGVFARRGYNIESLAVGLNEDRALFTIVVSGTDKVLRQVMEQLQKLVNVLKVEDLSREPQVERELMLIKVHADPKHHAELKWLVDIFRAKIVDISQHSVTIEVTGDPGKMAAVQRNFSKFGIKEIARTGKIALRREKMGASAPFWRYSAASYPDLEGRTPVNALVGAKNMKPVAKLDTPVGGDVYPIEPSDGFTVNQVLDAHWGVLNDEDTSGIRSHTLSMLVNDAPGVLNIVTGVFARRGYNIQSLAVGHAEVEGLSRLTTVVPGTDESISKLVQQLYKLVELHEVRDITHLPFAERELMLIKIAVNAAARRDVLDIASIFRAKAVDVSDHTITLELTGDLDKMVALQRLLEPYGICEVARTGRIALVRESGVDSKYLRGYSYPL

SEQ ID NO: 39269 - protein, 156 aa, Schizosaccharomyces pombe
MVAVGSTLPKVTLWENKPEKVVEFPSQGKFIIVGVPGAFTPPCSSQVPGYIANEKQFAAKGISGIYVVAVNDVFVTKAWKKSFDGGEQSGVHFVADWNGEFTKAFDAGFDASGLLGPLRSKRYAAVVENGKVVKVFIENEVTDVDISSADKVLSSL

SEQ ID NO: 39270 - protein, 428 aa, Pyrococcus horikoshii OT3
MENPYEITAIVAREILDSRGNPTVEVDVHTPIAMGRAAVPSGASTGTHEAVELRDGGKRYHGKGVRRAVENVNKIIAPELIGMDVRWQREIDKLLIELDGTENKSNLGANAILAVSLAVAKAAANSLELPLYQYLGGVNAYVLPVPLSNVINGGVHAGNELDFQEFMIMPIGASSFREAIRWVSETYHVLKRVIMGKYGKNAVNVGDEGGFAPPMKEVTEPLDALIKAIEEAGYKPGDEIALAIDAASSEFFKDGKYIVGGKEYTREELLDLYKELVSTYPIVSIEDPFHEEDWEGFVMITNELGKKIQIVGDDLFVTNPRRLKKGIELGAANALLLKVNQIGTLTEAMDAAYTAFRAGYSVIVSHRSGETEDTTIADLAVALNAGQIKTGAPARSDRNAKYNQLIRIEEELEGIAVYAGKNFRKVFF

SEQ ID NO: 39271 - protein, 546 aa, Staphylococcus aureus subsp. aureus MRSA252
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENAATEIPRLINTAIAERRPVHLHLPIDVAISEIEIPTPFEVTAAKDTDASTYIELLVSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLSSLLQQLTDISYTNNASFPAYHRPTSPDYTVGTEPLTQQTYFKMMQNFLKPNDVIIADQGTSFFGDYDLALYKSNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQEVFNTINGHPDVMHFVEVKMSVEDAPKKLIDIAKAFSQQNK

SEQ ID NO: 39272 - protein, 512 aa, Arabidopsis thaliana
MDIIFEQALFPLFCFVLSFFIIFFTTTRPRSSRKVVPSPPGPPRLPIIGNIHLVGRNPHHSFADLSKTYGPIMSLKFGSLNTVVVTSPEAAREVLRTYDQILSSRTPTNSIRSINHDKVSVVWLPPSSSRWRLLRKLSATQLFSPQRIEATKTLRENKVKELVSFMSESSEREEAVDISRATFITALNIISNILFSVDLGNYDSNKSGVFQDTVIGVMEAVGNPDAANFFPFLGFLDLQGNRKTLKACSERLFKVFRGFIDAKLAEKSLRDTNSKDVRERDFVDVLLDLTEGDEAELNTNDIVHLLLDLFGAGTDTNSSTVEWAMAELLRNPETMVKAQAEIDCVIGQKGVVEESDISALPYLQAVVKETFRLHPAAPLLVPRKAESDVEVLGFMVPKDTQVFVNVWAIGRDPNVWENSSRFKPERFLGKDIDLRGRDYELTPFGAGRRICPGLPLAVKTVPLMLASLLYSFDWKLPNGVGSEDLDMDETFGLTLHKTNPLHAVPVKKRGRN

SEQ ID NO: 39273 - protein, 186 aa, Desulfovibrio desulfuricans G20
MPCLPVPFFPPRILDLPTRVLIAIEYTHHPLAPQENPMPQKYRKTPEALAALTDEQRRVTQENGTERPFSNAFHDHTAAGLYVDIVSGEPLFSSLDKFDSGCGWPSFSRPVELNIVEKKDTSHGLVRTEVRSKHADSHLGHVFTDGPEHLTGLRYCINSAALRFIPADKLEEEGYGEYAHLFTTRE

SEQ ID NO: 39274 - protein, 482 aa, Nocardioides sp. JS614
MENPHVIVLFGATGDLSRRKLLPGLLRLWQAGLIQDARIVGTSLEDVDTETFVKIARTACEEFGQSRFDEADWARFSRMLRYVPQSAGPAALAEAVRGCRADLGAPGRDVDCLHYLSVPPKAALDVVRQLDEAGLAAHSRIVMEKPFGTDLASAERLNARLHEVFDESQIFRIDHFLGKEAAQNILAFRFANGLFEPIWNRNFIDHVQIDVPETLGLEGRTRFYETTGAYRDMVVTHLMQVLAFMAMEPPTSLAPDPISDEKLKVFRSMRPIEPRNVVRGQYAGYRDHPEVADDSDTETFVALKVEIDNWRWAGVPFFLRTGKKLAEGARIISIAFKEPPLAMFPAGSNAGTQGPDHLTFDLADQSRMSLSFYGKRPGPGMKLEKLSMQFATHETMSSGGVLEAYERLIHDAIRGDHTLFTTADGIETLWEKSMPLLENPPPVRTYAPGSWGPNAIHQLIAPHAWRLPFERSWRESKDPYDA

SEQ ID NO: 39275 - protein, 137 aa, Leptospira interrogans serovar Lai str. 56601
MSRTFIMIKPDGVKNKHVGNILSRIEKEGFKILGLKYLKLSLEDAKQFYKVHSARPFYNDLCNYMSSGPIVAAALERDNAVLHWREVIGATDPKEAAAGTIRALYAESKEANAVHGSDSDDNAALEISFFFKGNELF

SEQ ID NO: 39276 - protein, 416 aa, Bacillus sp. 42
MKCCRIMFVLLGLWFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPWFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLRP

SEQ ID NO: 39277 - protein, 428 aa, Mycobacterium tuberculosis
MALVVQKYGGSSVADAERIRRVAERIVATKKQGNDVVVVVSAMGDTTDDLLDLAQQVCPAPPPRELDMLLTAGERISNALVAMAIESLGAHARSFTGSQAGVITTGTHGNAKIIDVTPGRLQTALEEGRVVLVAGFQGVSQDTKDVTTLGRGGSDTTAVAMAAALGADVCEIYTDVDGIFSADPRIVRNARKLDTVTFEEMLEMAACGAKVLMLRCVEYARRHNIPVHVRSSYSDRPGTVVVGSIKDVPMEDPILTGVAHDRSEAKVTIVGLPDIPGYAAKVFRAVARRRRQHRHGAAERLQGRGRQDRHHLHLLPQTSGPPPWKNWTRSETRSASTQLLYDDHIGKVSLIGAGMRSHPGVTATFCEALAAVGVNIELISTSEDQRSRCCAATPNWTRPWSRCMKRSGSAATRRPRCTRGRDGRWACQ

SEQ ID NO: 39278 - protein, 348 aa, Burkholderia vietnamiensis G4
MKAVVYEAFGAAPRLMDVDDPTPAPDGVVIEVKATGVCRSDWHGWMGHDPDIVLPHVPGHELAGVVVAAGAAVTRWKAGDRVTVPFVGGCGHCPECHSGNQQVCERQFQPGFTHWGSFAQYVGIHHADLNLVRLPDALDFPTAASLGCRFVTSFRAVVDQGRTSAGQWVAVHGCGGVGLSAIMIANAIGANVVAIDISERALTLARALGAAATVDASQVTDVVDAVKEITRGGAHVSLDALGHPTTCFNSISNLRRRGKHVQVGLMLGEHATPAVPMSKVIAHELEILGSHGMQAHRYGAMLDMVHAGKLAPERLIGKEISLGESIDALMNMDRFEGAGVTVVTDFSG

SEQ ID NO: 39279 - protein, 542 aa, Bradyrhizobium sp. ORS278
MIYTGASMIDHPRCPARNGARDDTELQMSLSHQPLHLAAEATEILTSLGVAPERLRGGTRAARSPVTGEVLAQVRDDTRADATAVIARAHAAFLQWRLVPAPKRGELVRLFGEELRAHKTALGRLVSIEAGKIVSEGLGEVQEMIDICDFAVGLSRQLYGLTIATERAEHRMMETWHPLGVTGVISAFNFPVAVWAWNAAIALVCGNSVVWKPSEKTPLTALASDALLARALARYRSEGGVAPEGLAGLMLGGREVGEMLVDDARVPLVSATGSTAMGRVVGACLAGRFARAILELGGNNAAIVTPTADLDLTLRAVAFAAMGTAGQRCTSLRRLFVHADVYEQLVPRLKQAYGSVAIGNPLQPGTLIGPLVDRAAFEAMQDALSAARDHGGRVFGGDRVAVDGCAEAYYVRPALVEIPTQSGPVERETFAPILYVMPYRDLAAAIELHNAVPQGLSSSIFTNDLREAELFVSSRGSDCGIANVNIGPSGAEIGGAFGGEKETGGGRESGSDAWKAYMRRATNTVNYGRSLPLAQGVKFDLG

SEQ ID NO: 39280 - protein, 522 aa, Arabidopsis thaliana
MVVSADCRISLSAPSCIRSSSTGLTRHIKLGSFCNGELMGKKLNLSQLPNIRLRSSTNFSQKRILMSLNSVAGESKVQELETEKRDPRTVASIILGGGAGTRLFPLTKRRAKPAVPIGGAYRLIDVPMSNCINSGINKVYILTQYNSASLNRHLARAYNSNGLGFGDGYVEVLAATQTPGESGKRWFQGTADAVRQFHWLFEDARSKDIEDVLILSGDHLYRMDYMDFIQDHRQSGADISISCIPIDDRRASDFGLMKIDDKGRVISFSEKPKGDDLKAMAVDTTILGLSKEEAEKKPYIASMGVYVFKKEILLNLLRWRFPTANDFGSEIIPFSAKEFYVNAYLFNDYWEDIGTIRSFFEANLALTEHPGAFSFYDAAKPIYTSRRNLPPSKIDNSKLIDSIISHGSFLTNCLIEHSIVGIRSRVGSNVQLKDTVMLGADYYETEAEVAALLAEGNVPIGIGENTKIQECIIDKNARVGKNVIIANSEGIQEADRSSDGFYIRSGITVILKNSVIKDGVVI

SEQ ID NO: 39281 - protein, 351 aa, Oryza sativa Japonica Group
MMEEASTSASGGGGAAANGGQRGFPPARSGVFYRFTQQNLPAWKPAMTPGCVITIFLMIGVTFVPVGLVCLHASNHVAEIAHRYDIDCVPNAYKRNRQAYIKDSSISKNCTQEVKVKYLMRAPIYVYYELDNFYQNHRRYVKSRSDKQLRYGQKYTHSSCDPIERNDGLPIVPCGLIAWSLFNDTYGFTCGSTEIKVNRKNISWKSDREHKFGKDVYPFNFQNGSLIGGGKLDPALPLNQQEDLIVWMRTAALPQFRKLYGVIEEDLQADEIITMHIANNYNTYSFGGKKSLILTTSTWLGGKNDFLGYAYLITGSLSLFLTILFALIHVKNPRPHGDANYLSWNRPNSNS

SEQ ID NO: 39282 - protein, 703 aa, Iberis amara
AISNLTNLQVLDLTSNNFTGTIPAEIGKLTELNELTLYLNGFSGSIPSEIWELKNLASLDLGNNQLTGDFPKEMCKTRSLMLIGVGNNNLTGIIPDCLGDLVHLQMFVADINRLSGTIPVSIATLVNLTGLILSDNQLTGKIPREIGNLSNLQILGLGNNVLEGEIPAEIGNCSSLIQLELYGNQLTGGIQAKLGNCKSLINLELYGNQLTGKIPEELGNLVQLETLRLYGNNLSSSIPSSLFRLRRLTNLGLSRNQLVGPIPEEIDSLKSLEILTLHSNNLTGEFPQSITNMRNLTVITMGFNQISGELPENLGLLTNLRNLSAHDNFLTGQIPSSISNCTGLIFLDLSHNQMTGEIPSDLGKMDLIHLSLGPNRFTGEIPDEIFNFSNMETLNLAGNNITGTLKPLIGKLQKLRILQLSSNSLSGIIPREIGNLRELNLLQLHTNHFTGRIPREISNLTLLEGLLMHMNDLEGPIPEEMFDMKQLSELELSNNKFTGPIPVLFSKLESLTYLGLHGNKFNGTIPASFKSLLHLNTFDISDNLLTGTIPAELLSSMSNMQLYLNFSNNFLTGAIPNELGKLEMVQELDFSNNLFSGSIPRSLQACRNVFLLDFSRNNLSGQIPEEVFQKGGMDMIRILNLSRNSISGEIPENFGNLTHLVSLDLSSNNLTGEIPESLANLSTLKHLKLASNHLKGHVPESGV

SEQ ID NO: 39283 - protein, 336 aa, Oryza sativa Japonica Group
MGGDWQELAQAAVIGLLFAFLVAKLISTVIAFKEDNLRITRSTPTSPSAADTPAAPAPPPASLDGGHGDTSDGSGSDSDSDWEGVESTELDEEFSAASAFVAASAASGTSVPEQAQLQLYGLYKIATEGPCTAPQPSALKLKARAKWNAWHKLGAMPTEEAMQKYITVVDELFPNWSMGSSTKRKDEDTTVSASSSKGPMGPVFSSLMYEEEDQGNDSELGDIHVSAREGAIDDIAKHLAAGVEVNMRDSEGRTPLHWAVDRGHLNSVEILVNANADVNAQDNEGQTALHYAVLCEREDIAELLVKHHADVQIKDEDGNTVRELCPSSWSFMNLAN

SEQ ID NO: 39284 - protein, 167 aa, Populus trichocarpa
MIGILASIRRPELFTKLIMIGASPRFLNDKDYHGGFEQEEIESVFVAMEANYEAWVKGFAPLAVGADVPAAVREFSRTLFNMRPDITLFVSRTVFNSDLRGILGLVKVPCCVIQTSKDVSVPASVAKYLKNHLGGKATVEMLRTEGHLPHLSAPAMLAPVIRRALSR

SEQ ID NO: 39285 - protein, 679 aa, Brassica carinata
AIANLTYLQVLDLTSNSFSGEIPSEIGNLTELNQLILYLNYFSGSIPSEIWRLKNIVYLDLRDNLLTGDVPEAICKTISLELVGFENNNLTGTMPECLGDLVHLQIFIAGLNRFSGSIPASIGTLVNLTDFSLDSNQITGKIPREIGNLSNLEALVLAENLLEGEIPAEIGNCTSLNQLELYSNQLTGAIPAELGNLVQLEALRLYKNKLNSSIPSSLFRLTRLTNLGLSENQLVGPIPEEIGFLTSVKVLTLHSNNLTGEFPQSITNMKNLTVITMGFNLISGELPANLGLLTNLRNLSAHDNLLTGSIPSSISNCTSLKLLDLSHNQMTGEIPRGLGRMNLTFLSLGPNRFAGDIPDDIFNCSYMETLNLARNNLTGTLKPFIGKLQKLRILQLFSNSLTGPIPREIGNLRELSLLQLNTNHFTGRIPSEISNLPLLQGLQLDTNDLEGPIPEEIFGMKQLSELYLSNNKFSGPIPILLANLESLTYLGLHGNKFSGSIPASLKTLSHLNTLDISDNLLTGTIPEELISSMRNLQLTLNFSNNLLSGTIPNELGKLEMVQEIDFSNNLFSGSIPRSLPACKNMLFLDFSRNNLSGQIPDEVFQQGGMDMIKSLNLSRNSLSGGIPQSFGNMTHLVSLDLSYNNLTGEIPESLANISTLKHLKLASNHLKGHVPESGV

SEQ ID NO: 39286 - protein, 424 aa, Magnaporthe grisea 70-15
MADRKRATDYFIDIVVFAGMTATLYLLTKNILSSLSSTLGDPDKEKHEQARLRAKANLQRLRKIQNGDGTANGEAQDGEGGQRNGPAVEELQLNEYENMIAMDVVAPEDINVGFDAIGGLEDIIEEVKESVIYPLTMPHLYSHAAPLLSAPSGVLLYGPPGCGKTMLAKAVAHESGASFINLHISTLTEKWYGDSNKLVRAVFSLARKLQPAIIFIDEIDAVLGTRRSGEHEASGMVKAEFMTLWDGLTSANASGVPSRIMVLGATNRINDIDEAILRRMPKKFPVPLPGTEQRRRILELILGETKRDPEHFDLEYIAAVTAGMSGSEIKDACRDAAMSPMREFIRTQRAAGTPMASIDPTQVRGIRTDDFFSRKGAGPRVRSMGENKKSTAKQNSTTEKHAERAEDSEYEDVDEEHTRPVSPD

SEQ ID NO: 39287 - protein, 1468 aa, Ehrlichia chaffeensis str. Arkansas
MKKFIILLLFFVTGCGVNCIEGSKGISGNSVVVEVSPTVKKVSKVLQPNWIDTELRVSKDQPPMRVAVTGALNMCPKDFLNPKNLIVPAVSCISDIKDISYKDESTYQNIKDVCSNASLRTKAANSEYLSGVAHTVSAFRLNKGDAFKVSLIPRKVKVTDCSSAALKELGVIYYSDDEIFEDSNCQQAIPAENICQNGVPKFYVKVNQECKESGGMAGAIPRLQGTEVSALVDNTDTPYGNKIFYSEDAKKNWINAPFVYDARIIKNQKVNVETLKKHCTIIKELNEKKIINHVDTISTSQFEYYQKQKAQGDITTDIIKELIDVINNFTTYDINCVCGTICNSKSKLVTGKEIATISNYGSDGNCIISGSYEYNKDATFEEISKAKLEDISKNANNSDPIIQGLTAFFGTRVTHKQEKDARNYYCFPQKVQGGSCYADISSQNIDSNSLKSNISYAYDSDESVTLRFAVIGEKQKYASYSGGYNIHVERICNFMYGKKLYMYIGDNPPTIFPGDPGTIELFVPDPENPESGTGVYMINKDGSEKKSGKIYLGIDVRGYENQFDYSSLPGIESANKYFVDFFIKRWNPNFSKVFVMIRDFLLRILYGVPKDTQVDNIAQALDVARTSKSQGAIQSIYANQTGAGSLWRALQALCSLYIVFTVLGYAIGVVKFTKYDLGVRIAKIAIVVGLISQGSWEFFSDHFFSIFIQGTSDLVAAFNGELDGDNSFRFLDTTLGILLTGEVWIRLLTLILTGPIGWLIFYIIFWAFFVFFMCVIEAIIAYLLTIVAVAFLATLAPIFITFIFFQLTKTLFDAWVKMLVNFSLQPIILFAALAFLNQVVLTVLYKVTSFTVCNQCYLGFDLPTSAVEEGAPYDICLVSVLLPVGYSPDLSITESIRESYVQGNGGLLGLPFDIASALILLLAAHAMRGFKGMSETIAHSISGSVAGLSASVYGATQALASIVGRDQETQNIIKEAMRNRKSTGKSDVDIVSRSNPNPESRGESVERSGGSDSDLPPKGHDGGLRTGISDKGDNVPQQPQSGDDIKEDSKTGRASEQLHNDVSPLSSSSVLDTTPFTLSYNEMQGADNLDSNPSVTRNDTSADGTSGMDSQDASSDAGSELHGDGDTGNVATTQDTGDNEGDGAQNGSRDNGENAGNASNVTEQDTSSGENDEVQGGSRDNSESADDASSITEQDSSSGESDEAQGGSRDNSESADDTSSVAEDTSSDESDEAQGGSRDNDENGDSTLSVAEQDTSSDESDEAQGGSRDNDENADDTSSVAEQDTSSDESDEAQGGSRDNDENADDTSSVAEQDTSSDESDEAQGGSRDNDENDDSASSVTEQDADSVSDGTEVSTSDGDNNLGNDQSTDNTLDGNENTSGNNDTDVQEEAGKASSVVESSDSDDSDGRKRGRKDINFLDGPQRKRLYMDEYSSVAEKIAGHESAIAVEEESYERGIVKKRGKKDQQE

SEQ ID NO: 39288 - protein, 486 aa, Rhodococcus sp. RHA1
MSTPTLTTATKVNQLIGGQWGPADSGNWLEVENPARREILALIPDSGEADVNRAVAAAKDAFGPWKALPARDRGALLIKLGDKIAENQEELARIIASETGNALRTQARGEAASGADIFRFYGQIASEQKGETLPFGENLVSYTVREPLGVVGGIVPWNAPVTLSSLKIAMALAMGNTLVLKTAELAPLAVLKLAEWAHEILPAGVLNVLTGSGQKVGVPLSKHPDVAKLTFTGSTGVGKEILAAAADRIVPVTLELGGKSPAIVFPDSDDDATVDGVIAGMRFTRQGQSCTAGSRLNLHEDIFDSFLEKLKNKLGQFKIGDPLDEATDIGAIVSEKQFDTVCRYITSGITQGGTVITGGPERPVDGDGFFVAPTVITGADADWDITREEVFGPVLVVIPWKDEDQVLAAANDSTYGLAGYVWTKDITKAIRTANALEVGWVQINRGGGQLPGMSYGGIKQSGLGREYSVDGALESFTQVKNITIAV

SEQ ID NO: 39289 - protein, 414 aa, Cryptococcus neoformans var. neoformans JEC21
MPISFSRLAIALGIASIILLPFAYASSGDRNPTFQHCLRGCAATYCDPSQPPIAFYLRLFGWTCAENCAYHCSHSFTDKIGPGSRYHQFYGKWAFYRLGPFQEPFSIIMSLGNLLVNLQGVSAVRRRIRSENKLRKWLVSLGFVQVNTWIWSAVFHARDKPWTERLDYFSATLTIAFTLLYSIIRILHFQTPLYTSRFLLPACVAVALLVLSHFKYILSFPLGQFPYGYHTMFNLCLGLIHNLLWVLWSFSFRFPYPTLRFGRFLSLSFPYPYPPHNPYKNPSPKESSTPAVLVGLTTLAMSLELWDFAPLFRVIDAHSLWHTATIPLTMGWWHFLMADALELEGSLMGQGGMGVGLLEEPIGRRRGGGPLERDADMPMTPTFQELDSGRVKLTSSSPSPGTRMRISPKSSEFK

SEQ ID NO: 39290 - protein, 477 aa, Rhodococcus sp. RHA1
MTVDSSHEQLNEDGLAQGLNKRHIRMIAIGGAIGVGLFLGSGKGISYAGPALVGVYAITGVFIFIIMRALGELLMYRPVTGSFAEYAREFLGPVYGFITGWGYWITWTIIGMAELTAAGIFVRFWFPSMPQYLTALIALIALVTLNLAKVGFFGEAEFWFASIKVITIVALIAGGIFALVFNVGKAGQEGGIANLWDHGGIAPHGLLAVLLAFQIVVFSYQGVELIGMTAAETKNRATVLPKAINSIPWRIGIFYVGTLVVLLSLFPWDQFNADSSPFVKGFTQIGLPAAASIMNFVVLASALSSCSAGLFSNGRLLKKLAADGVAPKMFEKTNRGHVPAAAIIASGSLMLVSVAINAIVPEQAFSYISSVATLGAIWSWGVIVACHLVYRRRVERGEVPASTFRLPLATPLCWATLAFLAAVTVLLAFDEGQRIALYALPIWAAVLLTGYYLSARRTASPVAPSPATENDRPALHP

SEQ ID NO: 39291 - protein, 388 aa, Thermotoga maritima MSB8
  misc_feature (1)..(1): Xaa can be any naturally occurring amino acid
  misc_feature (96)..(96): Xaa can be any naturally occurring amino acid
  misc_feature (159)..(159): Xaa can be any naturally occurring amino acid
  misc_feature (284)..(284): Xaa can be any naturally occurring amino acid
  misc_feature (334)..(334): Xaa can be any naturally occurring amino acid
  misc_feature (348)..(348): Xaa can be any naturally occurring amino acid
  misc_feature (374)..(374): Xaa can be any naturally occurring amino acid
XGSDKIHHHHHHVDALEVHRFLKGKIRTALPVEKVDRETLSLLYTPGVADVARACAEDPEKTYVYTSRWNTVAVVSDGSAVLGLGNIGPYGALPVXEGKAFLFKAFADIDAFPICLSESEEEKIISIVKSLEPSFGGINLEDIGAPKCFRILQRLSEEXNIPVFHDDQQGTAVVVSAAFLNALKLTEKKIEEVKVVVNGIGAAGYNIVKFLLDLGVKNVVAVDRKGILNENDPETCLNEYHLEIARITNPERLSGDLETALEGADFFIGVSRGNILKPEWIKKXSRKPVIFALANPVPEIDPELAREAGAFIVATGRSDHPNQVNNLLAFPGIXKGAVEKRSKITKNXLLSAVEAIARSCEPEPERIIPEAFDXKVHLNVYTAVKGSA

SEQ ID NO: 39292 - protein, 201 aa, Zea mays
MAGPAVLNERILSSMSQKHVAAHPWHDLEIGPGAPHFSGQVVEIPRGSKVKYELDKASGLIKVDRVLYSSVVYPHNYGFIPRTLCEDNDPLDVLILMQEQVVPGCFLRARAIGLMPMIDQGEKDDKIIAVCADDPEFRHYTDITDLPPHRLQEIRRFFEDYKKNENKEVAVNEFLPAKDAINAIKYSMDLYGSYVIESLRK

SEQ ID NO: 39293 - protein, 403 aa, Novosphingobium aromaticivorans DSM 12444
MSVDTITRGAQWPGLLNPDGSRWHYLDTAATAQKPQVVIDAVTRALGADYATVHRGVYARSADMTLAFEAARRKVAGLVNGDEGEIVFTRGATEAINLVAQTWGQANLKAGDRILLSTLEHHSNIVPWQLLRDRTGVEIDVCPLTEDGRIDLAAAERILTPAHKLVALAHVSNVLGSVLDVAQAVRLARAVGAKILLDGCQAVPRLAVDVKAMDADFYVFSAHKLYGPTGIGALWAKAAILDAMPPWQGGGAMIDRVTFERTTYAPAPQRFEAGTPAIVEAIGFGAAVDFVQAQGLDAIHAHEVALVAKAREALGRMNSVRLFGPEDSAGIVSFAIEGVHPHDLGTILDEEGVAIRAGHHCAQPLMDHLGVPATARASFGIYSDESDIAALVRGIERTKRIFG

SEQ ID NO: 39294 - protein, 224 aa, Myxococcus xanthus DK 1622
MSDTRSPQVLPTRKHTQHLERFSEADIPTERGSLRTIVFRDKRNGREHVALVVGQVSGHEGVPVRIHSECLTSEVFGSLKCDCREQLDRSLDFITQAGQGVVLYLRQEGRGIGLGNKIKAYALQSKGLDTYEANRQLGFADDLRTYDIAAEMLRSLDVRSVDLMTNNPLKIAGMVEEGIPVRRRIPSRTEHNPHNVDYLRTKRERTGHLIELFAEDDDTEAKTG

SEQ ID NO: 39295 - protein, 168 aa, Saccharomyces cerevisiae
MNKWSRLYVITVRRTFPGRRNIVLTQYWNKSKKMSDESNDVKWNDALTPLQLMVLRDKATERPNTGAYLHTNESGVYHCANCDRPLYSSKAKFDARCGWPAFYEEVSPGAITYHRDNSLMPARVEICCARCGGHLGHVFEGEGWKQLLNLPKDTRHCVNSASLNLKKD

SEQ ID NO: 39296 - protein, 354 aa, Zea mays
MYKNQLQELAQRSCFSLPSYVCTREGPDHAPRFRAAVTFNGETFEGPSGCTTLRQAEHAAAEVALARLSLRGPSTTLAARVLDETGVYKNLLQETAHRAGLKLPAYTTVRSGPGHSPVFSSTVELAGLSFAGDPARTKKQAEKNAAMAAWSSLKQMPEARKEPGAGDEQEHVAVARALAALKPRDGGDGKAAPPLQKHSSNGSSSSALPNPSLYRHQWRPRTSTPAQAQPLPPRTGALPLQPPAGPRILPPLHLLQRPACGSRDAAAAELVRMLERAMVRDREATPPSPCYYAAPAASAYRHGSAPRTFAAGGFHAPAVSVRSVIPVCAAPPPQTPVKEERNGPATPSGACKRA

SEQ ID NO: 39297 - protein, 488 aa, Leptospira interrogans serovar Lai str. 56601
MSEKTKIAIAYGDGIGPEIMDATLKILNAAGAKIEPIEIEIGEKVYKEGHSSGIKPEAWDILRQTKVFLKAPITTPQGGGYKSLNVTVRTTLGLFANVRPCFSLYPYVETKHPSLDIVIIRENEEDLYTGIEHRQTNDTVQCLKLISHPGSEKIIRYAFEYARAYGRKKVTAMVKDNIMKQTDGLFHDIFKEVAKEYPELEVNSQIIDIGAANLADRPQNFDVVVTLNLYGDIISDIVAQIAGSVGMAGSSNIGEIVSMFEAIHGSAPDIAGKNLANPSGLLNAAVMMLVHIGQPDIAAKINNAWLLTIEEGIHTGDIFKPGVSRIKVGTKEFSDAVIGNLGHLPGKFKPVSFGKAKKIIIPEYKRNIQKKDLVGVDIFLDWVGKDPNELGNKLKSVSDELMLKIITNRGVKVYPDGQPETFLIDHWRCRFVSKNALIKQEDPSYHPISHKQVAELLLKLDLAGFDTIKTENLYYFNGKRAFSLGQGE

SEQ ID NO: 39298 - protein, 450 aa, Geobacter metallireducens GS-15
MSPQLIDERLAGIYQDVLKRNPGEVEFHQAVAEVLESLGPVVTKHPEYLERKIIERIAEPERQIIFRVPWQDDKGQVHINRGFRVEFNSALGPYKGGLRFHPSVYLGIIKFLGFEQIFKNSLTGMPIGGGKGGSDFDPKGKTDDEVMRFCQSFMTELYRHIGEHTDVPAGDIGVGGREIGYMFGQYKRITNRWEAGVLTGKGLKFGGSLVRPEATGYGATYFINEALKVRKDSFDGKTCLVSGSGNVAIYTIEKIHQLGGKCIACSDSNGVIIHEKGLDVELIKQLKEVERRRIADYATYHKDAKYIANGNIWDIPCQVAMPSATQNEINGKDAKTLVKNGCIAVGEGANMPTTPEGIKVFIEAQIAYGPGKAANAGGVATSALEMQQNAQRDSWSFEETEKKLEKIMVGIHKLCYETAEEYGDKGNYVTGANIAGFIKVADAMVAHGLV

SEQ ID NO: 39299 - protein, 358 aa, Archaeoglobus fulgidus DSM 4304
MKAALALEDGTYLEGKAFGAERGGLGEIVFCTSMTGYVEALTDPSYKGQILMMTYPLIGNYGVNREDFESDGVKVEGFVVKELCKNPSNWRSEMSVDELLKQYDVPGIEGVDTRMLTRKIRIYGSMKAAIGIGDVDREKLVRKAVEQPFISDIDLVDKVCVKEAKRFESDGDLEVVLVDCGVKMSIVRQLLKRGVNLTVVPYDFPAEKIKEMNPDGVFISNGPGDPARVKPTIETIRKLAGQIPMAGICLGHQLTALALGAKTFKLKFGHHGSNQPVKDFETGRVFISSQNHNFAVDTKTLPKEFEVTQINLNDHTVEGMVHKDFPLITVQYHPEAGPGPHDTYFFFDRYVDMLREYR

SEQ ID NO: 39300 - protein, 668 aa, Staphylococcus aureus subsp. aureus MRSA252
MVINLNDKQTKTSKEGLISVSHPLAAKIGKDVLDQGGNAMDAVIAIQLALNVVEPFASGIGGGGYLLYYEQSTGSITAFDARETAPAHVDKQFYLDDSGEYKSFFDMTTHGKTVAVPAIPKLFDYIHKRYAKLSLEDLINPAIELAIEGHSANWATEKYSRQQHARLTKYHETAQVFTHENQYWREGDWIVQPELGKTFQILREQGFNAFYKGDIAKQLVNVVKACGGTITLEDLANYDIQIKAPISATFKDYDIYSMGPSSSGGITVIQILKLLEHVDLQSMGPRSVDYLHHLIQAMHLAYSDRAQYLADDNFHEVPVQSLIDDDYLKARSKLIDSNKANIDIEHGVVSDCISHTDVEENHTETTHFCVIDKEGNIASFTTSIGMIYGSGITIPGYGVLLNTTMDGFDVVTGGINEIAPYKRPLSNMAPTIVMHHGKPILTVGAPGAISIIASVAQTLINVLVFGMDIQQAIDEPRIYSSHPNRIEWEPQFSQSTILALIARGHAMEHKPDAYIGDVHGLHVDLNTRDASGGADDTREGTVMGGEVLSIRKQPLPYRQMYGSNVYRVYFNDVQLPLLADQVRWMHDKYWVDESVVRIIFSEVSAHIEDLRSYENAGENYIDITWLARKKGYQVTLKDDGLYLTDDTYTSVKRNTNAYYRYDRDSITR

SEQ ID NO: 39301 - protein, 577 aa, Saccharomyces cerevisiae
MADITDKTAEQLENLNIQDDQKQAATGSESQSVENSSASLYVGDLEPSVSEAHLYDIFSPIGSVSSIRVCRDAITKTSLGYAYVNFNDHEAGRKAIEQLNYTPIKGRLCRIMWSQRDPSLRKKGSGNIFIKNLHPDIDNKALYDTFSVFGDILSSKIATDENGKSKGFGFVHFEEEGAAKEAIDALNGMLLNGQEIYVAPHLSRKERDSQLEETKAHYTNLYVKNINSETTDEQFQELFAKFGPIVSASLEKDADGKLKGFGFVNYEKHEDAVKAVEALNDSELNGEKLYVGRAQKKNERMHVLKKQYEAYRLEKMAKYQGVNLFVKNLDDSVDDEKLEEEFAPYGTITSAKVMRTENGKSKGFGFVCFSTPEEATKAITEKNQQIVAGKPLYVAIAQRKDVRRSQLAQQIQARNQMRYQQATAAAAAAAAGMPGQFMPPMFYGVMPPRGVPFNGPNPQQMNPMGGMPKNGMPPQFRNGPVYGVPPQGGFPRNANDNNQFYQQKQRQALGEQLYKKVSAKTSNEEAAGKITGMILDLPPQEVFPLLESDELFEQHYKEASAAYESFKKEQEQQTEQA

SEQ ID NO: 39302 - protein, 290 aa, Archaeoglobus fulgidus DSM 4304
MENVELLIEALPYIKDFHSTTMVIKIGGHAMVNDRILEDTIKDIVLLYFVGIKPVVVHGGGPEISEKMEKFGLKPKFVEGLRVTDKETMEVVEMVLDGKVNSKIVTTFIRNGGKAVGLSGKDGLLIVARKKEMRMKKGEEEVIIDLGFVGETEFVNPEIIRILLDNGFIPVVSPVATDLAGNTYNLNADVVAGDIAAALKAKKLIMLTDVPGILENPDDKSTLISRIRLSELENMRSKGVIRGGMIPKVDAVIKALKSGVERAHIIDGSRPHSILIELFTKEGIGTMVEP

SEQ ID NO: 39303 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADISYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVRENSGPPDDADAAEEPPSSGKIPVFGELLGALKDLPRPMLLLLIVTCLNWIAWFPFILFDTDWMGREIYGGTAGQGKLYDQGVRAGALGLLLNSVVLGLTSIAVEYLVRGVGGVKILWGFVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 39304 - protein, 308 aa, Burkholderia vietnamiensis G4
MSAAVPEILALGEAMIEFNQSQPGRPEFLQGFGGDTSNFCIAAARQGASTGFVSAIGDDPFGRLLAGMWADEHVDTRYVRVDRSAPTGVYFVTHGPDGHQFDYLRAGSAASRYTAADLPLDALAAAKAVHLSGISVAISTAACDAAFAAIVHARSNGALISFDTNLRLKLWPLARARAVIREALCHTDICLPSWDDVAALTGANDRDAIVDAMLELGPQIVALKLGREGAYVATPSERRVVPGFAVEAVDATGAGDCFGGAFVARIVAGDDPFAAARYANAAAALSTTGYGAVAPIPHRDAVERLLRG

SEQ ID NO: 39305 - protein, 411 aa, Neptuniibacter caesariensis
MQIVNILIMFLIMLMLAALLRPLASRLHLPYSLVLVFAGFIGSEVITSLGYDTGLRWQHFQLLVFYIFLPVLIFEAALHIDAKRLCKKLLPILLLSTPLMLLATAVSAVFLYYGIGYPNHYPVLAALLTGALLSATDPAAVISLLKKAGVSEDLILLMEGESLFNDASAIMMFGLISSLLLMPEGDFSFSYAALSFAKIFFGGIAVGGAVLVILGGCFYLVKDSFSRMVFMLSGAYAGYVIAESVLHVSGVMCVLVTGVGFGELIRRYSRDEQKIRLSNHWLFAGELSSAMIFLLLGVTVTLAMFQQQWLAMLLGIAAVLIARGVGLVIIGPLINVIPGTRLNWKDHCIIYWGGLRGAVTIALALSLPLELDAWFTIQSIAYGVVMFSLCVQATSTPWLLTKLARKEKEGK

SEQ ID NO: 39306 - protein, 235 aa, Photobacterium phosphoreum
YMAYMLKYDSTHGRFNGTVEVEGGNLIVNGKTVRVTAERNPEDLKWDAINVDVVAEATGLFLTDETARKHITAGAKKVVLTGPSKDATPMFVMGVNDSTYAGQDIVSNASCTTNCLAPIAKVLNDNFGIVSGLMTTVHATTATQKTVDGPSAKDWRGGRGASQNIIPSSTGAAKAVGVVLPEINGKLTGMAFRVPTANVSVVDLTVNLEKGASYAAICAAMKAASEGELKGILGY

SEQ ID NO: 39307 - protein, 679 aa, Eruca vesicaria
AIANLTYLQVLDLTSNNFSGEIPSEMGKLTELNQLILYLNHFSGSIPSEIWRLKNIVYLDLRDNLLTGDVPEAICKTTSLELVGFENNNLTGRIPECLGDLVHLQIFIAGSNRFSGSVPVSVGTLVNLTDFSLDSNQLTGKIPREIGNLSNLQSLILTDNLLEGEIPAEIGNCSSLIQLELYGNQLTGAIPAELGNLVQLESLRLYKNKLNSSIPFSLFRLTKLTNLGLSENQLVGPIPEEIGFLTSVKVLTLHSNNLTGEFPQSITNMKNLTVITMGFNSISGELPANLGLLTNLRNLSAHDNLLTGPIPSSISNCTGLKVLDLSYNQMTGEIPSGLGRMNLTLLSLGPNRFTGEIPDDIFNCSNMEILNLARNNFTGTLKPFIGKLQKLRILQLFSNSLTGAIPREIGNLRELSHLQLGTNHFTGRIPGEISNLTLLQGIELDANDLEGPIPEEMFSMKQLTELDLSNNKFSGPIPVLFSKLESLTYLALHGNKFNGSIPGSLKSLSHLNTLDISRNLLTGTISSELISSMRNLQLTLNFSNNLLSGSIPNELGKLEMVEQIDFSNNHFSGSIPRSLQACKNVFFLDFSRNNLSGQIPDEVFQQSGMDMIKSLNLSRNSLTSGIPQSFGNMTHLLSLDLSYNNLTGEIPESLANLSTLKHLNLASNNLKGHVPESGV

SEQ ID NO: 39308 - protein, 500 aa, Oryza sativa Japonica Group
MQQLYAKFGSVFTVSVAGLLKATFLVGPEVSAHFFQGLESEVSHGDLFEFTVPMFGKEVGHGVDNATRIEQGRFFAEALKPVRLRIHVDPMVQEVEDYFAKWGQHGTVDLKHELEQLLLLISGRCLLGKEVMGTKFDEVCNLFRDIEGGVNLMSVFFPYTPLIPSNRRRDMARERLHAIFSDIVRSRKQQQGDQEEVNDKDVLQSFIDSRYKADGRATTEAEVAGLITGVLFAAKHTSTHTSVWTGARLLTHEKFLAAAVDEQDQIVRKHGIINGRIVTDHYGFLMEMHMLHICIKETLRLHPPAPMIVRTALRQFTVRTREGHEYCVPAGHTMASPIVISNRVPYIYKDAHLYDPDRFGPRREEDKVGGKFSYTSFGGGRNSCVGENYAYMQIKAIWSHLLRNFELKLLSPFPKTDWSKLVPEPQGKVMRERERETPEHVASDHRDGKREEVAGDMLVVAGSATLRGRRTPPTMLAVVGQREAVRGEDADDLAGDYGSG

SEQ ID NO: 39309 - protein, 105 aa, Arabidopsis thaliana
IIGTFVLVYTVFSATDAKRNARDSHVPILAPLPIRFAVFLVHLATIPITGTGINPARSLGAAIIFNKDNAWDDHWVFWVGPFIGAALAALYHVIVIRAIPFKSRS

SEQ ID NO: 39310 - protein, 470 aa, Oryza sativa Japonica Group
MAIILAITAAVTKIARGGRRRSATDPTCKMPPPPPVVNSIALLRLLPTLFRSGLPAILHELYTKFGSVFTINLAGLLKMTFLVGPEVSAHFFQGLESEISHGNLLEFTVPMFGKEIAHGVDSATRNEQARFFVDALKPARLRIHVDPMVQEVEDYFAKWGQHGTVDLRRELEQLLLLISGRCLLGKEVMGTMFDEVCNLFRDIEGGVNLMSVFFPYTPLIPSNRRRDMARKRLHAIFSDIVRSRKQREGDNVDKDVLQSLIDSSVWTGARLLSHERFLTAAVDEQDKIAREHSNINGGGRITDDRYGSLMEMRTLHSCIKETLRLHPPVPMLVRTAHKQFTVRTREGHEYAVPAGHTIASPIVISNQVPYIYKDGHLYDPDRFGPAGREEDKVGGKFSYASFGGGRTGCVGEGYAYMQIKAIWSHLLRNFELRLLSPLPKSDFTKFVPEPHGELMIYHPVASPAPEPSSP

SEQ ID NO: 39311 - protein, 949 aa, Arabidopsis thaliana
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVSKEWVDAIQGVGINAAQNHDGESVEKMVAHVNKPVYVCKNDTFVAAFPALETRITCGIDFPQVPAIGCQWFSWRPIHESSFAKDIASSRTFCVYEEVERMREAGLIKGGSLDNAIVCSAEHGWMNPPLRFDDEACRHKILDLIGDLSLVSRGGNGGLPVAHIVAYKNEEEEVRSSTEENENVRSSTEENEYVRSSTEAGRGEDPHEDSDNISESGAIHLQIMERFNQRSGSGKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 39312 - protein, 324 aa, Oceanobacillus iheyensis HTE831
MGLFEQLAEKVTAADKKIVFPEGLDERILTAASRLAEEGIMTPILIGGTQDVEAKAKDLDVSLKGCEVIDPANYDEFSDMVSAFVERRKGKATEEDAKKILLDGNYFGTMLVYLNKADGLVSGAAHSTADTVRPALQIIKTKEGVKKTSGVFIMVRDEEKYVFADCAINITPDSNDLAEIAVESAKTGALFDVDPKVAMLSFSTKGSAKSPETEKVSEALEIAKEKDPSLVIDGEFQFDAAFVPSVAEKKAPDSVLKGNANVFVFPSLEAGNIGYKIAQRLGGFEAVGPILQGLNRPVNDLSRGCSSEDVYNLALITAAQAVGE

SEQ ID NO: 39313 - protein, 589 aa, Arabidopsis thaliana
MTMITPSSNTTHYRESWYACRYRSGIPGSTHASVASRRVLSSLLRSSSGRSAAKLGNRNPRLPSPSPARHAAPCSYLLGRVAEYATSSPASSAAPSSAPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKESAA

SEQ ID NO: 39314 - protein, 235 aa, Photobacterium iliopiscarium
YMAYMLKYDSTHGRFNGTVEVEGGNLIVNGKTVRVTAERNPEDLKWDAINVDVVAEATGLFLTDETARKHITAGAKKVVLTGPSKDATPMFVMGVNDSTYAGQDIVSNASCTTNCLAPIAKVLNDNFGIVSGLMTTVHATTATQKTVDGPSAKDWRGGRGASQNIIPSSTGAAKAVGVVLPEINGKLTGMAFRVPTANVSVVDLTVNLEKGASYAAICAAMKEASEGSLKGVLGY

SEQ ID NO: 39315 - protein, 267 aa, Thermotoga maritima MSB8
MGSDKIHHHHHHMKEVFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 39316 - protein, 680 aa, Sinapis alba
AIANLTYLQVLDLASNNFTGQIPAEIGKLTELNQLVLYLNYFSDSVPSKIWELTKLASLDITNNLLTGNVPESICKTRSLVSVRIGSNNLAGEIPNCLGELVRLEMFVADVNQFSGLIPVSIGTLVNLTAIDLGSNQLTGKIPREIGNLRHLQVLGLYNNLLEGEIPAEIGNCRSLIQLELYGNQLTGRIPTELGNLVQLESLRLYKNKLSSPIPSSMFRLTRLTNLGLSGNQLVGPIPEEIGNLKSLKVLTLHSNNLTGELPKSITNLRNLTAITMGFNFISGELPADLGLLSNLQNLSAHDNLLTGPIPSSISNCTGLKVLDLSFNQMSGKIPRGLGRTNLTGISLGPNRFTGEIPDDIFNCSDVEVLNLARNNLTGTLKPLIGKLQKLRILQVFSNSLTGTIPREIGNLRELIILQLHTNHFTGRIPREISNLTLLQGLELDTNELECPIPEEMFGMKQLSVLELSNNKLSGPIPILLAKLESLTYLGLHGNKFNGSIPASLKSLSHLNTFDISDNLLTGTIPGELISSMRNLQLNINFSNNLLTGTIPSELGKLGMVQEIDFSNNLFSGSIPRSLQACKNVFLLDFSRNNLTGQIPDQVFQQGGMDMIKSLNLSRNSLSGEIPKRFGNNLTQLVSLDFSNNNLTGEIPETLANLPTLKHLNLSSNHLKGHVPESGV

SEQ ID NO: 39317 - protein, 679 aa, Alyssum alyssoides
AIGNLTFLQVLDLTSNNFSGEIPVQIGELTELNQLILYLNYFSGSIPSVIWELKNLAYLDLRGNLLTGDFPKEICKTKSLELVGVSNNNLTGKIPKCLGDLVNLQIFFADINRLSGMIPVTIGNLVNLTDFDLSDNQLTGKIPREIGNLLNLRALALTGNLLEGEIPSEMGNCTSLVQLELYGNQLTGKIPAELGNLVQLESLRLYRNKLNSSIPSSLFRLTRLTNLGLSLNQLVGPIPEEIGFLRSLQVLTLHNNNFTGKFPQSVTNLRNLTALTMGFNNISGELPADLGLLTNLRNLSAHDNILTGPIPSSISNCAGLKVLDLSFNQMTGEIPRGLGRLNLTAISLGPNKFTGHIPDEIFNCTSVETLNLAENNLTGTLKPLIGKLRKLRILQVKSNSLNGTIPREIGNLRELSLLQLEANHFTGRIPREISNLTLLQGLGLHMNDLESPIPEEFFDMKQLSELELSNNRFSGPIPALFSKLESLTYLGLRGNKFNGSIPVSLKSLSQLNKFDISDNLLTGTIPPELISSMKNMQLSLNFSKKFLTGTIPNELGNLEMVQEIDFSNNLLSGPIPRSLQRCKNVILLDFSRNNISGDIPDKVFKQGGMDMIKTLNLSSNNLSGEIPESFGNLTRLVSLDLSVNNLTGEIPESLANLSTLKHLKLSSNHLTGHVPETGV

SEQ ID NO: 39318 - protein, 444 aa, Cryptococcus neoformans var. neoformans JEC21
MSVVTKVHARQIFDSRGNPTVEVDLYTEKGLFRAEVPSGASTGAHEAVELRDKGSDYMGKGVLKAVENVNKVIAPALIDSKLPVTSQKEIDDLLIKLDGTENKGKLGANAILGVSMAVSEAAAADKGVPLYGYLAQLAGVSEPYVLPVPAFNVINGGSHAGNALAFQEFMLLPTGASSFTEAMKMGSETYHTLKKVITKKYGIDAANVGDEGGFAPNVSGAEESLDLLTEAIKQAGYTGKVQIGLDVASSEFFKEGKYDLDFKNPNSDSSKWLSGKELADLYHGYCEKYDICSIEDPFHEDDFDAWAAYNQTAKIQIVGDDLLVTNPRRIKMAIEKKACNALLLKINQIGTISESIQAVQLAQSNGWGVMTSHRSGETESTYIADLAVALRTGEIKTGAPCRSERMAKYNQLLRIEEQLEGKSIFAGGKGLSKGTTAPELHSSK

SEQ ID NO: 39319 - protein, 436 aa, Oryza sativa Japonica Group
MGFVESIGRYRVGRTIGAGTFAKVRLAVDADTGATVAVKVIDKRMVIRNNLMYQVKREITAMKLLNHPNIVKIYEVIATKTKICLVMEYVSGGQLSDKLSYLKRLDEKEAKKYFYQLIDAVDYCHRRGVYHRDLKPENLLVDNQGNLKVSDFGLSVLKKPGQFLSTSCGSPCYVAPEVIQHKSYDGAAADVWSCGVILFELLAGYLPFQDCSLTNLYRRISRAQFVFPQWLSVPQKKIIIRILDPSPITRAKISDIFDDKWLQDHCNPSARIENDDDCDVIEEASTDSDSSHNTEVKETEEMTAETDRFINAFQLIARCSDLDLSGLFQEQKTKLASPHPVQETFDKIKVAAKDVSMAVKRMNSSLVEIQDSKLLPRSNLDLTLSAEVIKVTPAHCVVEVSKSTGDLRSYKEFCRSLSSLLNGGQLSASSSDMECD

SEQ ID NO: 39320 - protein, 467 aa, Streptococcus pneumoniae R6
MESKMNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIALPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKVPKNATILTGLASAVAAGMFPLASIAAFLNICTLAYLILLAYGLIRLRKEKGMPKAGEFKTPLVPLLPILSIIICLSFMLQYNVNTWIAFLVALLVGSIIYFTYGYKHSTIEE

SEQ ID NO: 39321 - protein, 141 aa, Burkholderia thailandensis E264
MALERTLSIIKPDAVAKNVIGQIYSRFENAGLKIVAARMAHLSRADAEKFYAVHAERPFFKDLVEFMISGPVMIQVLEGEDAILKNRDLMGATDPKKAEKGTIRADFADSIDANAVHGSDAPETARVEIAFFFPEMNVYSR

SEQ ID NO: 39322 - protein, 294 aa, Physcomitrella patens subsp. patens
MEQYEKVEKIGEGMYGVVYKARDRVTNETIALKKIRLEQEDEGVPSTAIREISLLKEMHHGNIVRLQDVVHSEKRLYLVFEYLDLDLKKHMDTCPDLAKDPRLIKTFLYQILRGIAYCHSHRVLHRDLKPQNLLIDRRTNALKLADFGLARAFGIPVRTFTHEVVTLWYRAPEILLGSCHYSTPVDVWSVGCIFAEMVTQRPLFPGDSEIDELFRIFRLLGTPTEETWPGVTSLPDFKSAFPKWPAKNVGSVVPGLEPLGIDLLSKMLILEPSRRITARTALEHEYFKDVGLVP

SEQ ID NO: 39323 - protein, 552 aa, marine gamma proteobacterium HTCC2080
MSTEARSNFLKTQIQSDLDTGGARRLVTRFPPEPNGFLHLGHAKSITVNFELAKQFGGECHLRFDDTNPEKESQIFIDAIQEDVRWLGYQWHGEVRYASSYFQQLYVWALHLIDQGHAYVCDLSADEAREYRGSLTEAGRNSPHRSRSIEANRDLFERMRAGEYPDGSRVLRAKIDMASPNINLRDPILYRIRKAHHHQTGDAWPIYPTYDFAHGQEDAIEGVTHSICTLEFEDHRPLYDWFIEHLPVPSRPRQIEFARLNTSYTMTSKRKLKQLVDSKAVEGWDDPRMPTLAGLRRRGYPPAAIRHFCEEVGTSRSDSVVDVAMLESAVRNQLNAESPRVMAVLNPLPLTITNRERPEVLAVANHPGDEAMGTRSVPFTSEIYIDAADFREEANKKYKRLVIGKRVRLRGGYVIEADRCDHDSAGEVSHVYAHVVEGTLGEDPPDGIKAKGVIHWVSATEGLSAEIRCYDRLFTDPNPGKAEDMMALLNPKSLVRLEHAVIEPSAALAAREGAYQFEREGYFVADRYDHTPEKPVFNMTIGLRDTWSDSHG

SEQ ID NO: 39324 - protein, 163 aa, Chlamydomonas reinhardtii
MLASLLPSAASALSAPAVGALPLLAQQLGRRLYHKNVVEHYERPRNVGSFDKSDPDVGTGLVGAPACGDVMKLQIKVDEQGNIVDARFKTFGCGSAIASSSVATEWVKGKSLDEVLKIKNSDIAKHLSLPPVKLHCSMLAEDAIKAAVKDIQAKRTKTATAAA

SEQ ID NO: 39325 - protein, 519 aa, Xylella fastidiosa 9a5c
MWPLRFNNRFIAVLPCDPEVSLRSRQVLEAWSGVAPTPVPVPCLLAYSSEVAAILNFDAEELVTPRFVEVFSGNALYPGMQPYAVNYGGHQFGQWVGQLGDGRVITLGELLGADGVYYELQLKGAGPTPYSRGADGRAVLRSSIREFLCSEAMHHLGIPTTRALSLIATGDTVIRDMLYDGHPAPEPSAIVCRVAPSFVRFGTFELPASRGDIDLLRRLVEFTIMRDYPHLHGAGETLYVDWFAEICTRTAELVAHWMRVGFVHGVMNTDNMSILGLTIDYGPYGWIDNNDLDWTPNVTDAQSRRYRFGAQPQVAYWNLGCLARALAPLFSDAASLQAGLERFRATYLAAERRDAAAKLGFAACFDEDLELFDALRTCMHQAEMDMTLTFLGLADWEPNMPDSLSLWAEAFYDPVKRDAQAPMLRDWLQRYAARLSVDPLPVAERHERMRLANPRYVLRNYLTQQAIECAEQGDLIELHALLEVMRRPYDFQLGREAYAMRRPEWARSRIGCSMLSCSS

SEQ ID NO: 39326 - protein, 319 aa, Nostoc punctiforme PCC 73102
MRIAQDITELIGRTPLVQLNKIPQAEGVVARIVVKLEGMNPAASVKDRIGLSMVLSAEAAGSIQPGKTILVEPTSGNTGIALAMVAAARGYRLILTMPETMSQERRAMLRAYGASLELTPGAEGMRGAIRKAEEIVANTPDAFMLQQFRNPANPKVHQETTAEEIWTDTDGEVDIVIAGVGTGGTITGIAEVLKGRKKTFKAIAVEPSNSPVLSGGEAGPHRIQGIGAGFIPDVLRLELVDEVIRVSDEQAIAYGRRLAKEEGLLSGISSGAALCAAIQVGKRPENAGRLIVMIQPSFGERYLSTPMFQDLSLETAGVR

SEQ ID NO: 39327 - protein, 265 aa, Burkholderia thailandensis E264
MHTFNGKVALITGGGTGIGAAVARKFVEAGGRVVLLGRRREPLDAVAKPLGAAAIAVAGDAADAHDVRRALDDARAAFGSVDVLVANAGGHGVGSALDTDDASWAQSTRVNLDTAFVCARELLPELIERRGSIVILSSLAGHFAGPNVVGYVTTKHALIGLTRSLARDYGRCGVRVNAVCPGWVRTAMADEQMDALRDAHGLATREDAYRLVTRDVPLGRPAEPDEVADTVLYLASPHASMITGTSLLVDGGASAVDLPTIEFAR

SEQ ID NO: 39328 - protein, 299 aa, Saccharomyces cerevisiae
MSTFSASDFNSERYSSSRPSYPSDFYKMIDEYHDGERKLLVDVGCGPGTATLQMAQELKPFEQIIGSDLSATMIKTAEVIKEGSPDTYKNVSFKISSSDDFKFLGADSVDKQKIDMITAVECAHWFDFEKFQRSAYANLRKDGTIAIWGYADPIFPDYPEFDDLMIEVPYGKQGLGPYWEQPGRSRLRNMLKDSHLDPELFHDIQVSYFCAEDVRDKVKLHQHTKKPLLIRKQVTLVEFADYVRTWSAYHQWKQDPKNKDKEDVADWFIKESLRRRPELSTNTKIEVVWNTFYKLGKRV

SEQ ID NO: 39329 - protein, 425 aa, Bacillus sp. SG-1
MVAEKDAASNNPEDKNDVLKSTQTVIQLALEKLGYSEEVYELLKEPVRMLTVKIPVRMDDGKIKVFTGYRAQHNDAVGPTKGGIRFHPHVTEKEVKALSIWMSLKCGIVDLPYGGGKGGIICDPRDMSFRELERLSRGYVRAISQIVGPTKDIPAPDVFTNSQIMAWMMDEYSRIDEFNSPGFITGKPLVLGGSHGRETATAKGVTICIREAAKKKGIDLVGARVVVQGFGNAGSFLAKFMHDAGAKVIGISDAYGGLHDPNGLDIDYLLDRRDSFGTVTKLFNNTISNKELLELDCDILVPAAIENQITEENAGNIRASIVVEAANGPTTLEATKILTERDILLVPDVLASSGGVTVSYFEWVQNNQGYYWTEEEVEEKLEKILVASFNNVYEASQTRRVDMRLAAYMVGVRKMAEASRFRGWI

SEQ ID NO: 39330 - protein, 430 aa, Gibberella zeae PH-1
MASALFFLDLKGKTLLARNYRGDIPMSAVEKFPVLLSEAEEDSSAVPPCFSHEGINYLYIRHNNLYLLALTKRNTNAAEILLFLHKVVEVFTEYFKALEEESIRDNFVIIYELLDEMMDFGYPQTTESKILQEYITQESHKLEIQARPPIAVTNAVSWRSEGIRYRKNEVFLDVVESLNLLVSANGNVLRSEILGAIKMKCYLSGMPELRLGLNDKVMFETTGRATRGKAIEMEDVKFHQCVRLSRFENDRTISFIPPDGEFELMSYRLNTQVKPLIWVECVVESHSGSRIEYMLKARAQFKRRSTANNVEIVVPVPDDADSPRFRTNIGSVHYAPEQSAIVWKIKQFGGGKEFLMRAELGLPSVRGDDEQGKGAKRPIQVKFEIPYFTTSGIQVRYLKITEPKLQYPSLPWVRYITQSGDIAVRLPDAV

SEQ ID NO: 39331 - protein, 332 aa, Bacillus sp. SG-1
MEDFRGVKAMRQEECIIVGGGPCGMSAAIELKKIGINPLIIEKGNIVNAIYNYPTHQTFFSSSEKLSIGDVPFIIEQHKPKRNQALVYYREVAKLHDLRINRFEEVQSVTKINEHLFNVKTAKEQYETKRVIIATGYYDHHNELNVKGGDLEKVHHYFKEAHPYFDTDVVVIGGKNSAVDAAIELEKAGARVTVLYRGSDYSSSIKPWILPEFDALARSGRVKMVFNAEVEEVTENTVKYFVAGDMKEIKNDFVFAMIGYHPDHSFLTKMGVNIDQETGRPQFNPDTMETNIEGIFIAGVIAAGNNANEIFIENGRFHGGMIAKAIKAKEDI

SEQ ID NO: 39332 - protein, 217 aa, Brassica napus
  misc_feature (213)..(213): Xaa can be any naturally occurring amino acid
MKKIKKKYRREKSRNLFFSRLQFSQLLLDLSSILPRRDSYEMDHDKTGCQSPPEGPKLCINNCGFFGSSATMNMCSKCHKAILFQQEQGARFASAVSGGTSSSSNILKETFAATALVDAETKSVEPVAVSLQPSSVQVAAEVVAPEAAAAKLKEGPSRCATCNKRVGLTGFKCRCGDLFCGTHRYADIHNCSFNYHAAAQEAIAKANPVVKAXKLDK

SEQ ID NO: 39333 - protein, 326 aa, Bacillus sp. SG-1
MKKQILVIHTGGTISMMEDADTGAVKPGEENPLSAHSSSLEHLADITVREAFHLPSPHITPEHMLQLKQLMEEEYNKEKFQGVVITHGTDTLEETAYFLDLTVDLPVSIVVTGAMRSSNEIGADGLYNLLSSIKVASNENSVDKGVLVVLNDEIHSAKNVTKTHTSNVSTFQSPQYGPIGIVTKRGVIFHHKPTTVEKYSVKSVAKKIALIKAHAGMDSALLSALKELQFEGVIIEALGQGNIPPAAVNGIETLINENIPVVLVSRCFNGIAQDIYGYAGGGKQLKEMGVIFSNGLNGQKARLKLLVALSTSSSPGLKELEEIFRN

SEQ ID NO: 39334 - protein, 326 aa, Ralstonia eutropha JMP134
MAKVVRMYETGGPEVLRYEDMDVGEPGPGQVRIRHVAVGLNYADTYFRNGTYPVPLPAGMGVEAAGVVQAIGPGVTNVAVGDRVTYTGFINTLGAYSTERLVPAAPLIRLPETIGFETAAAMTMRGLTSAYLMRRIYNFKAGDTILLHAAAGGVGLIVSQWAKLLGLTVIGTVSSEAKAEVARAHGCDYIINYSHEDVAKRVRELTDGVGVSVVFDSVGKNTFMASLDSLKRRGTLVCVGTASGPIPPFDPVLLAMKGSLFLTRPALADYIGDPAEKAELAGEIFGHVGAGRIKIEINQRYALEDAVQAHRDLESRKTTGSSIFVI

SEQ ID NO: 39335 - protein, 382 aa, Erwinia carotovora subsp. atroseptica SCRI1043
MIKSALLVLEDGTQFHGRAIGAEGLAVGEVVFNTSMTGYQEILTDPSYSRQIVTLTYPHIGNVGANANDEESPSVQAQGLVIRDLPLIASNYRSEESLSEYLKRNNIVAIADIDTRKLTRLLREKGAQNGCIIAGDAPDAVVALEKAKAFPGLKGMDLAKEVTTAESYSWLQGSWTLEGELPAAKNESELPYHVVAYDYGVKRNILRMLVDRGCRLTVVPAQTPAEDVLKLNPDGIFLSNGPGDPEPCDYAIRAIKTFLETGIPVFGICLGHQLLALASGAKTTKMKLGHHGGNHPVKDLDNNCVMITAQNHGFAVDEDNLPDTLRVTHKSLFDHTVQGIHRTDKPAFSFQGHPEASPGPHDAAPLFDHFIDLIQTYRSSAK

SEQ ID NO: 39336 - protein, 284 aa, Xanthomonas campestris pv. vesicatoria str. 85-10
MSESSSPSCAQVRLRNGRRVPALGLGSWNLGQGRHAPEQEIQALQLGQQLGMQLIDTAEMYGNGRSEQLISQAIGRAQPPYVVSKVLPGNASARGIARACEASLQRLGVRTLDLYLLHWRGGSDLAEVVDAFEALRDAGKIRDWGVSNFDVDDMEELWAIDGGSRCLVNQVLYHAGSRGIEFDLLPWCAAHEVAVMAYSPLGSRALLDHPVLHAIGERRGVAATAVALAWAIRSGNVIAIPESGTPAHVRANAAACTLQLHADDLAEIDRAFAPPTRKQPLDLL

SEQ ID NO: 39337 - protein, 470 aa, Desulfovibrio desulfuricans G20
MRTKIIATVGPASSGRETLSRLIQAGVRIFRLNFSHGDASQFVDLIALMRQLEAEYQTPITLLQDLSGPKIRIGELPDGALTLAKDDRILLGIPGKAAADGLPFVPFTHKTILDGMEPGDRVVLSDGGLQFHVESKVGPDLFCLVANNSGIITSRKGLALPGKPIHLAALTEKDKKDLQDGLRMGVDAVALSFVQTPEDVAEAKALIKAAGRNVPVIAKLERRNAVDRLEEILEVTDIVMVARGDLGVECPLPELPAMQKRIIRACNRKAKPVIVATQMLLSMVNSPSPTRAETTDVANAVLDGADCVMLSEETAMGNFPVETVQFMRQIVRAAEELHLEQSSVLPPLDEQKTPDFLAYSACLLADKTCAGAIVAHSMSGSAARVLSARRPRQTIHALTPDDEALRFLNFSWGVWPHKVDETLPGHLERAELFVDNAPQFEDGAEVVITAGQPKPGEKPRGTNLVKIYRK

SEQ ID NO: 39338 - protein, 536 aa, Mycobacterium tuberculosis H37Rv
MFDTGHQTYPHKLLTGRGKDFATLRQADGLSGYPNRHESPHDWVENSHASVSLAWVDGIAKALALQGQCDRRVIAVIGDGALTGGVAWEGLNNLGAATRPVIVVLNDNGRSYDPTAGALAAHLEELRVGTPRGPNLFENMGFTYIGPVDGHNIPDTCAVLRKAAAAARPVVVHAVTSKGRGYPPAEADERDHMHACGVVDIATGLASTPSQRSWTDVFEDEIARIADDRSDVVGLTAAMRLPTGLGALSRRYPHRVFDSGIAEQHLLASAAGLAAAGTHPVVAVYSTFLHRAFDQLLFDIGLHRLPVTLVLDRAGVTGPDGPSHHGLWDLALLACVPGFQIACPRDAPRLRQQLRTAIATAAPTAVRFPKGAPGEPITAEHTIGGLDVLHTPPPHWRPDVLLVAVGAMSRPCMDAARCLSEEQIGVTVVDPQWVWPISPALTELAGRHRITVCVEDAIADVGIGAHLSHHIGRTHPRTRTYTLGLPPAYIPHASRDHILSSHGLTGPAIRIRCKSLLNALHEVPGPEDHPDSGDSY

SEQ ID NO: 39339 - protein, 485 aa, Neptuniibacter caesariensis
MKLQLNDSSLLQTQAFINGEWVNGDAGETFPVSNPATGEVIAEVASVGAEETARTIDLAEAAMSAWKKLAPAERSGILERWYDLIIENTDDLAAIMTLEQGKPLFEAKGEVMYGASYLKWFAEEGKRIYGDVLPSPGDRRSIVIKQPVGVVAAITPWNFPNAMITRKAAPALAAGCSILLKPAAETPLSALALAELSKRAGVPAGLFNVLPTKSSSTVGGEMTSNTKVKKLTFTGSTPIGKLLIKQCADTVKRTSMELGGNAPVIVFDDADLDLAVKGALASKYRNSGQTCICANRLLVQEGIYDQFVEKFAAAVKEFKLGHGFDEEATHGPVVSKKALSDIDAIVQNAVEQGANVVAGGKPSELGNCFYEPTILTDVNDKMSIFGEEIFGPVAPVFKFSTEEEAIAMANDTEFGLASYVFTQNLGRIWRVSEGIEYGMVGVNETAISSEVIPFGGVKESGQGREGSKYGLEDYLETKYICMGGL

SEQ ID NO: 39340 - protein, 273 aa, Bradyrhizobium sp. ORS278
MNVIETQGVRLPKLGLGTFRMQGTVCRDAVESALALGYRHIDTAEMYANEDAIGAALAAAQIAREDLHVTTKVWPENLAPDAIRRAFDTSLKKLRLDFVDLYLIHWPATGMNLPAAMETLMALKQEGRTRAIGVANFTVALLKQAVEDIQAPVACNQVEYHVMLDQSKLMAYMKSRSIPLVAYCPLAQGRAAGDETLAGIGRKHGAGAAQVALKWLLDQDGVAAIPKAARPESQQANWDAMKVQLDDEDRATIAALPKDKRFVNPGFAPDWDR

SEQ ID NO: 39341 - protein, 233 aa, Arabidopsis thaliana
MPGPVIEEVNEEALMDAIKEQMKLQKENDVVVEDVKDGDEDDDDVDDDDDEIADGMFLESCCGFVIESICFESGLGAGENEASKQSRSEKKSRKAMLKLGMKPVTDVSRVTIKRSKNVLFVISKPDVFKSPNSETYVIFGEAKIDDMSSQLQAQAAQRFKMPDVASMIPNTDGSEAATVAQEEEDDEDVDETGVEAKDIDLVMTQAGVSRPKAVKALKESNGDIVSAIMELTT

SEQ ID NO: 39342 - protein, 257 aa, Gluconobacter oxydans
MYMEKLRLDGRVAVVTGGAQNIGLACVTALAEAGARVIIADLDETLAAQSAEDLRKQDLNVDSIRMDVTSTESVQSAIKTLHEKEGHLDILVACAGICISEVKAEDMTDGQWLKQVDINLNGMFRCCQAVGRIMIEQKKGAIVAIGSMSGQIVNRPQQQAAYNASKAGVHQYIRSLAAEWAPHGIRANAVAPTYIETTLTRFGMEKPELYDAWIAGTPMGRVGQPDEVASVVQFLASDAASLMTGAIVNVDAGFTVW

SEQ ID NO: 39343 - protein, 202 aa, Myxococcus xanthus DK 1622
MPTLVLVRHGQSLWNQENRFTGLVDVPLTDQGRQEARRAAEALSGMTFDVAYTSALIRAQETLSILLDALGQQVPTIRDAALNERNYGDLQGLNKADAAKRWGAAQIKEWRRSFDVPPPNGESLEMTAERVLPFYERAIAGDLRLGKNVLVVAHGNSNRSLVMKLDNLTGEQVVGLELATGVPLIYEMSPDGEVLSKRTASP

SEQ ID NO: 39344 - protein, 424 aa, Cryptococcus neoformans var. neoformans JEC21
MDTPGAGPSRQSSSAPAANNKLDPNVKPGTVLLTSDLLSSFQPAKRFKDAVLEPTSTPSGPKTHSVTTLTFDDTGDRLISAGDDNQFILWDARKGKKIKSFYSKKYGIDHVRSTHKTGTILHASTQGGDHAVRYHSTHDNAYLAYFKGHTARVRSIDMSPADDSFVTAGDDGTVRLWDLRANACKGLVNDVGGSAIAAMDNTGVVFAVACSDTQTIMMYATKTADVHPFIHQGLIDIALEDISTPPPKPIFTSLHFSNNGQYLLVGTSSDVHYVLDAIYLTPLRRLVGHVGLERDAQGNKGVEPRRGISGEELCWTADSNWVISGSANGEVVAWDLRPEPGQSQLTRSDVAGGNWHTANPPDWTTLRIPDLKPKVVLHGDGAGSGPTRAVKFNPRYNLMAVGGYDLTLWMPIKDEEARLAAEGW

SEQ ID NO: 39345 - protein, 210 aa, Oryza sativa Japonica Group
MRGPSTTTMATFKQSFLKNLLSSLKSSSKNKAAMSTLSERKRAIKSSADIAMATARTGIAGAARWPHAILASSSSSSSSSSSSSSSSSMPRTTFPCKMMQGKVRRRCKSIVRRRTPLMSSSSEVARRLVKKRDKVLRRMIPGGELIADEISLLHEAMDYVVHLHAQVDVLRRVSRAAVARRSSASSSSSGGLAQLKERTVQISGETENPC

SEQ ID NO: 39346 - protein, 387 aa, Bacillus cereus E33L
MEFEFFFQIALILLSTKLAGDLSVRLGQPSVLGKLIVGIVIGPAVLGWIENSELLTQLSNVGVILLMFMAGLETDLEELNANRNSSLAVALGGIILPFVGGYVSGLVMGMEQGNAVFLGLLLCATSVSISVQTLRDLGKMKTRESTTMLGAAVFDDILVVILLAFAMSFLGTDDVNLTMIILKKVVFFASIILIGWKGVPAIMRWLSPLRVSESIVSAALIICFSFAYFGELLGIAGIIGAFAAGIAISQTNYKHEVEKKVEPIAYAMFVPVFFVSIGMNITFDGIGDQIWFILALTVIAVLTKLIGCGLGARMTGFDAKSSAIIGSGMVSRGEVALIIAGTGLSSGLLAQDYFTAIVIVVILTTMITPPMLKYTFGAKDKAMKASK

SEQ ID NO: 39347 - protein, 648 aa, Ostreococcus tauri
MRARWVQYRTYGDSRPPHGAMPSASSLAHANAPLCNHEYASTARARTRAACASRTVGRPLIPIARAVDSNASARGGVVGPCLQNTRVSPTKHPRVTPTKHPRVSPTKHPRVRVHDPPGPPPFPPRDGRNGGPTSTHPPPNARGRRNVRARWCSPEDGKRTRRRAATQVMEPHTAKNLKESKSNKLKDFVQVSGPLGISHFVMLSSSDANKYLKIAKTPRGPTLTFKIHSFSLAREVAATQKNPRNPAKAFLSPPLVVLNNFGDEAHQKLATITFQNMFPPINVRKVKLSTCQRAVLVDYDAKAKRFQFRHYSINAVPVGANKKLKKLLQSRNAPDLGELQDVSEFFDKRVGDASDSEGSDDESRRVHLTQDFNRIAHADSTSKIVLSEIGPRMELELVKVEEGMCDGRVLYHAYVKKTADEIKTLEQKKVDREKLRKKRRLEQEANVKRKNREKEARADAERERQGKPGKKKSPLDEKRTTPSGPPHSRRKSASGARATSTTRRQNPSSPPARVDLSDRDAATTSSFAPIDDTGDRWRHRPHVGRAPPSTTSRARRSIVLTRVLCAQAVKAFSRGYDSSKTKGTRCVRSRDASARGGTDEDAEADSHWMVKTPVRTQRSSDVRTLTRACGRTRASRAVNGSRVIYSCF

SEQ ID NO: 39348 - protein, 309 aa, Saccharomyces cerevisiae [sequence omitted]

SEQ ID NO: 39349 - protein, 449 aa, Bacillus cereus E33L
MKTKQTDEILAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKEEIGEHPLVGDIRGKGLLVGIELVNDKETKEPIDNDKIASVVNACKEKGLIIGRNGMTTAGYNNVLTLAPPLVISSEEIAFVIGTLKTAMERI

SEQ ID NO: 39350 - protein, 548 aa, Vibrio cholerae O1 biovar eltor str. N16961
MFQARFADLNLRCDLFGGVTTAIISLPLALAFGVASGAGAEAGLWGAILVGFFAALFGGSSTLISEPTGPMTVIMTAILTAMVARYPESGAAIAFTVVMMAGAFQILLGTLKLGKYITLMPYSVVSGFMSGIGVILIILQLSPLLGHPSPGGGVLGTLSALPDLLANLKFSELFLGLLTLGILFFLPQKYRKQVPAQLVALVVVTLFSVIFFDTDDIRRIGEIPAGLPSIVVPTFTGDIVVTMVIDALVLGTLGCIDTLLTAVIGDSLTRKEHDSDRELQGQGIANMVAGLFGALPGAGATMGTVTNIQVGARSPLSGVTRALMLALVVLVAGGLTEPIPMAVLAGIAVYVGVNILDWAFIQRAHKISLQGMAIMYGVMLLTVFVDLIVAVGLGVFISNILVIERLSREQARQVKAISDADDDDVPLTESERKLLDKANGKVLFFYLSGPMIFSVSKAITRQHSSVDQYQAMILDLTDVPMIDVTVGLALENAIRDAQEAHCEVYLLCPNEKTRAELEKFKVIDLVPDQNMFTFRYEALNAAVKQVNT

SEQ ID NO: 39351 - protein, 423 aa, Burkholderia thailandensis E264
MHTVTLKPSKDKSLLRRHPWVYANAIDRVDGKPAPGATVIVRAHDGRFLARAAYSPHSQIRLRVWSFDENEPIDHAFFKRRVQRAVAHRRAMIAGTGAVRLVFGEADGLPGLIVDHYVAAPIPAGDAAACAAEGGATQQAEPAEGAGRGQLVCQFMAAGVEHWKDAIVAALVAATGCPNVYERSDVSIREKEGLEQTTGVLAGDAPPDTLIANENGVLYHVDVRNGHKTGFYVDQRENRALVAQYARDRDVLNCFCYTGGFSLAALKGGAKRVVSIDSSGDALALAQRNVAANGFDAARAQWLDADAFKTLRRLVDEGERFDLIVLDPPKFAPTRDSVDRAARAYKDINLSGFKLLRPGGLLFTYSCSGAIDMDLFQKIVAGAAADAKVDARILKRLGAGVDHPLLTAFPEGEYLKGLLLQIA

SEQ ID NO: 39352 - protein, 534 aa, Nocardioides sp. JS614
MSANREAMLDKLADLDTEHGKAVAGGGEKYVARHHARGKLLPRERIELLVDEGSAFLELSPLAGWGSDFPVGASVVTGIGVIEGVECMITANDPTVKGGASNPWTVKKIFRASQIAEENGLPTVSLVESGGADLPTQKEIFIPGGKLFRDITRASARKQPTVALVFGNSTAGGAYVPGMSDYTVMVKEQAKVFLGGPPLVKMATGEESDDESLGGAEMHARISGLADYLAEDERDAIRIGRRIVARLNWRKRGPAHPAGISTSSITGPSYAEPEEDPEGLLDLIPGDLKEPFDPREVIRRICDGVSATNGAVFDEFKPLYGSSLVTGWARIHGRPVGILANAQGVLFSEEAQKATQFVQLANQSDTPLLFLHNTTGYMVGKEYEQGGIIKHGAMMINAISNSTVPHLSVIMGASYGAGNYGMNGRAYDPRFLFTWPSAKSAVMGPQQLAGVLEIVAQQSAEAKGEVFDAEGFKGIKELVEAQIEEQSLPHFLSGMLYDDGVIDPRDTRTILGICLSVIENQPYVGTDRFGVFRP

SEQ ID NO: 39353 - protein, 733 aa, Archaeoglobus fulgidus DSM 4304
MSDKKGEEITLRVAEAFYRDVGRGVARIDPAVMEKYGLQSGDIIEIIGKSTVPAIVWPSYPEDRGTGIIRIDGSIRSNAGVGIDDKVRIRKVTAKPAEKVTLAPTEPVRLMGGEAYLLRLLEGRPVIKGQKIRVEVFGHTLTFVITATRPSGVVVVTRNTAIELKEKPAEEVKRAVPDVTYEDIGGLKRELRLVREMIELPLKHPELFQRLGIEPPKGVLLYGPPGTGKTLIAKAVANEVDAHFIPISGPEIMSKYYGESEQRLREIFEEAKENAPSIIFIDEIDSIAPKREEVTGEVERRVVAQLLALMDGLEARGDVIVIAATNRPDAIDPALRRPGRFDREIEIGVPDKEGRKEILEIHTRKMPLAEDVDLEELAELTNGFVGADLEALCKEAAMHALRRVLPEIDIEAEEIPAEVIENLKVTREDFMEALKNIEPSAMREVLVEVPNVKWEDIGGLEHAKQELMEAVEWPLKYPEVFRAANIKPPRGILLFGPPGTGKTLLAKAVANESNANFISVKGPELLSKWVGESEKHVREMFRKARQVAPCVIFFDEIDSLAPRRGGIGDSHVTERVVSQLLTELDGLEELKDVVVIAATNRPDMIDPALLRPGRLERHIYIPPPDKKARVEIFKIHLRGKPLADDVNIEELAEKTEGYSGADIEAVCREAGMLAIRELIKPGMTREEAKEAAKKLKITKKHFEEALKKVRPSLTKEDVEKYEKLIEDFHRMYA

SEQ ID NO: 39354 - protein, 254 aa, Solanum chacoense
MGRTFFVGGNWKCNGTSEEIKKIVATLNAGQVPSQDVVEVVVSPPYVFLPLVKNELRSDFHVAAQNCWVKKGGAFTGEVSADMLVNLGIPWVILGHSERRAILGESNEFVGDKVAYALSQGLRVIACVGETLEQRESGSTMDVVAAQTKAIAERVKDWSNVVVAYEPVWAIGTGKVATPAQAQEVHAELRKWLQANVSAEVAASTRIIYGGSVSGANCKELAGQPDVDGFLVGGASLKPEFIDIIKAAEVKKGA

SEQ ID NO: 39355 - protein, 287 aa, Glycine max
MDDSKQQQRKKNYRKRSAPTDKDELPQSQSNNESDDERERRMALEEIKLLQKQRERKSGIPANPSLQVQSGTGGGLAAKAAEKNDGDGGEKDELVLQDTFAQETAVMDEDPNMVKYIEHELAKKRGRKIDAADQVENELKRAEDELYKIPEHLKVKRRNSEESSTQWTTGIAEVQLPIEYKLKNIEETEAAKKLLQEKRLMGRTKSDFSIPSSYSADYFQRGRDYAEKLRREHPELYKDRSHQDDSSGSKQNDSSTDAAGAVQRQAATDEFMLERFRKRERHRVMRR

SEQ ID NO: 39356 - protein, 159 aa, Glycine max
MIEINMKHQGKLRVFLPNMIILVTILLHSTTWISAQEVEDESEFDYIKGSEKGPSHWGELKKEWETCKSGKMQSPIDLSSHRVRVVPKLGELKKYYTPQNATIKNRGHDIELKWEDAGSININGTEFFLHQCHWHSPSEHTINGRRYDLELTWFMKAKH

SEQ ID NO: 39357 - protein, 1416 aa, Geobacter metallireducens GS-15
MKIIRLFISSTFRDMHAERDWLNRVVFPELRSRCRRRGAEFVGVDLRWGVTEEESRQRGALSVCLDEIEHCDLFLGLLGERYGWVPPPEKVPAELFAAVRDSGQLSEEEITLVDACYQWDRTTLPARFRLRRDAAISPETADTLTRLWQRAGLLGAGESATALEMRHGALNRSLAQGKALIFLRSEGIHRHSAFPPACIPIFTEPETEAQQRLSRLREELRAAAGPNLIVRQYRAGFGGFRIDPLFLPAAEAGSALQDGVIKPEEWGIISEKARQAVATHGTIALTGMEEFGTRVLNDLWWAIEPLLKNGKRPEITGQSWHTRFARERAARCLGRDDGIALVMGYIQDQGDQSPYILTGLPGCGKSTLMAACVERLREKSPDMVVIPWFVGAAPGSTEVTAMLRSLCEQLRRACRLDLEPSPDPDKLRLQLPAFLAAAGAVRPVALFIDALNQLDPLGGSHGLDWFPRTLAPTVRVVASTLAGPCLDRLTERLPADHLVILPPLPADSRATLAEEHLARRGKRLSATQQALLLDTAARPDAALPLYLVAALEELCCHGDFETLTERIAALPPTVTELFDQILERLERDHGADLATAALSAVAVSRDGLLEPEIIDLIRDGGEATSPLFWTRFYRALEPFLRPSGEEGGGGLIGFFHEQLRFAAFRRYLAMDPPAALPSSQFRQAHERLAGYFRAGARKNGADGEWNPEHPRPLAELPFHLAGAGKEAVLRSLIFDFAWLQTKLQALDVAALLADLNLLPPEPAIAHLAHALRLSTSVVAVDKSQFAGQLTGRLLSRQEPELRALITQAGAHRGNGWLKPATPSLYQAGGAIERILGTHTHPVRGVAITPDGRRAISAADDATLRVWDLASGAELMVLKGHESEVLAVAVFPDGRRIASGSRDATVRLWDTETGECLLILRGHTLPVSSLAAAPDGSWLASGSWDNVVRLWDPETGQERGIIWGHTYGINALAVTPDGQTLLSASFDRTIKAWNPANGELRRAFEGHSRQVLAVAVTPDGRQFVSGSEDCTLKRWDLAEGTELWTYYGHTDGVSSVTVSPDGREIVSGSWDFTLRRWDLEQPRAREVLRGHTFKVSAAAITPDGATAVSAAQDTTLKVWNLAGATASPPLTGHGATVTAAVFTPSGNRFVTASWDRKIKVWGAATGAEIFSLTGHETWVRDVAITPDGRRAVTASHDRTVRVWDLEERRELWVFRGHDAEVWSVVVTPDGRRAFSAGQDATLREWDLETFQPLGVTGLPSPARVTDVSPDGTLLALVAHFPTFIIRDLRAGSLRPYPPLHRDQVNDCVFLPDGLRVLTASSDRTLKLWHLTTGQVMYTLRGHNREIWSVSVTPDGRRAVSASDDRSLILWDLEALKPLATFTGDGALVPAAITPDGKTVVTGDEAGAVHLLRAEGVR

SEQ ID NO: 39358 - protein, 358 aa, Bradyrhizobium sp. ORS278
MADSIQEVLHAFAKGEMVVVTDDDDREGEGDLIVAASLCTPDKMAFIIRHTSGIVCAPITADDARRLRLDPMVAHNDSNHTTAFTVSIDYKPDGGTGISAEERASCCRALANPNAGANDFARPGHIFPLIARDGGVLLRSGHTEAAVDLCKLSGLPPVGVISELMNDDGTVMKGEQVVRFAAAHNLKHVTIADLISYRQAREKLIERVSTFTTESPIGPLQGYAYRSPFDPITHAAFVYNGIGDGKNVLTRLHKPNIVKDLIAGPQRIQAVLQHFKKNGRGVLIYLRDGAAGVPVEPVAEPHTAEADRHRQWREVGVGAQILRDLGVTSIRNLTSSVHDYKGLSGFGIEIVANERLEG

SEQ ID NO: 39359 - protein, 203 aa, Zea mays
MAPSAASSNTKEGESGEEGYTALEKHVAFFDRNGDGVIYPWETYQGFRAIGVGRLPSAIAGLFINMGLSQKTRPGKGFSLLFPIEVKNSHFCIHGSVTEVYDKNGRFVESKFEEIFKKHARSHRNALTYKELLQLLKSNRDPGDFGGWIAAYGEWKLLYELCKDEDGLLTREAVKGAFDGSIFRKLEKERLSSSHKKKEKRRR

SEQ ID NO: 39360 - protein, 317 aa, Glycine max
  misc_feature (35)..(35): Xaa can be any naturally occurring amino acid
  misc_feature (43)..(43): Xaa can be any naturally occurring amino acid
MFYIFSITVGGLLNATCGNVTELIIAIFALSSNKXAVVKYSLXGSILSNLLLVLGTSLLCGGIANLKVEQKYDRRQADVNSLMLLLGLLCYLLPMLFKYSGASAALTVDPSLHLSRASSIVMLIAYVVYIVFQLWTHRELFEEEDDGKDGEDGSEEQAVIGLWSGIAWLVGMTEFIAVLSEYVVDTIEDASDSWGLSVSFLSIILLPIVGNAAEHAGAIIFAFKNKLDISLGVALGSATQIAMFVVPLCVIVAWIMGIDMDLNFNLLETGSLALAIIVTGFTLQDGTSHYMKGLVLLLCYIVIGACFFVQRTPFNSK

SEQ ID NO: 39361 - protein, 256 aa, Bacillus sp. SG-1
MFLPSFELNGKTAIVTGAGRGIGRAIAIGMAEAGADVALLSRTEEDLKETASHIEKIGKKAYIVTSDVTSREEVARAVSSVKEQAGTIDILVNNAGMNIRSQALEVTDEEWQKIMDTNLKSAFMMSQEVGKVMKEQNSGKIITIASVAGHVALRTGVVYAATKAALIQMTKVLAFEWGKYNINVNSIGPWYFKTPLTEKLLQDEEYVNDILAVTPLKRVGELEELVGPAVFLASPAGNYVTGQTLFVDGGMTIQGF

SEQ ID NO: 39362 - protein, 250 aa, Panax ginseng
MPIHEIAVGRYEEFRHPGALKAAAAEFFSTLIFVFAGQGSGLAFSKLTDGGATTPSGLVSAALAHAFGLFVAVSVGANISGGHVNPAVTFGAFIGGNLTLIRGILYIIAQLLGSTVACLLLSFATGGSPISAFALSGVSVWSAFVFEIVMTFGLVYTVYATAIDPKKGELGIIAPIAIGLIVGANILAGGAFTGASMNPAVSFGPALVSWDWTNHWVYWAGPIVGGGVAAVVYELIFISSSHEPLPVADY

SEQ ID NO: 39363 - protein, 600 aa, Oceanobacillus iheyensis HTE831
MVPSLLFEIMLIGVLGVASQWIAWRFRLPAIVVMSVTGLAIGPVFGVINPEEDFGALYSPFISAAVAIILFEGSLNLSFKELRGIGRPVFRISTIGAFIAWILGSLTAHYIAGLSWAVAFVIGGLFVVTGPTVIMPLLRQAKLKARPAKILKWEGIIVDPIGALLAVFAFEIITFLTASNPDAMQLILFFAASLFAVFIGYVLGKGLGWMFEMGHIPEFLKSPAIVVVVLLCFTLADEVMHETGLLSVTAMGITLANMGISSISDMRHFKENISVLLISTIFIMLTASLDRETIMQIFSPNIILYVLLMMFAVRPLSIFLSTIGTGLSLNEKTLLGWIAPRGIVALTVSGYFANVLSDAGYEDASILTALTFALVIFTVVAHGFSIGWLSKKLGLSNEGNPGALIVGSNPFTIELAKSLGEAKYPAIIVSSSWEDLALARNAGLHVYHGSMLSEQTEQHLDTIPYEYLLTVTHDHAYNSLICTTFMPEYGRTNVFKVSPYTNFEDGYSTGVVSKVGGRILFDKKFSLEELVEKVEDGFTIRQTTLSEKFTFDHYKEKKDPETVFLFLIKPSGQLKFFSEEMRTIPVSGDVIVSLTKPNNE

SEQ ID NO: 39364 - protein, 363 aa, Arabidopsis thaliana
MKKGGFSNNLKLAIPVAGEQSITKFLTQSGTFKDGDLRVNKDGVRIISQLEPEVLSPIKPADDQLSLSDLDMVKVIGKGSSGVVQLVQHKWTGQFFALKVIQLNIDEAIRKAIAQELKINQSSQCPNLVTSYQSFYDNGAISLILEYMDGGSLADFLKSVKAIPDSYLSAIFRQVLQGLIYLHHDRHIIHRDLKPSNLLINHRGEVKITDFGVSTVMTNTAGLANTFVGTYNYMSPERIVGNKYGNKSDIWSLGLVVLECATGKFPYAPPNQEETWTSVFELMEAIVDQPPPALPSGNFSPELSSFISTCLQKEPNSRSSAKELMEHPFLNKYDYSGINLASYFTDAGSPLATLGNLSGTFSV

SEQ ID NO: 39365 - protein, 333 aa, Neptuniibacter caesariensis
MKFLVTGAAGFIGFYTAARLCEAGHEVVGLDNLNDYYDVNLKHARLKEITPYKNFRFVELDIADRAGMEKLFKTEKFNRVIHLAAQAGVRYSLENPFAYVDSNLVGMMTILEGCRQNNVEHLVYASSSSVYGMNTKMPFSTVDGVDHPVSLYAATKKSNELMAHSYSHLYDIPTTGLRFFTVYGPWGRPDMAPFLFTDAIINERPIKVFNHGKMRRDFTYVDDIVEGVVRIQDVIPSRDNNRTMDNPSISKAPYRVYNIGNNEPIELMEFIQAIESAAGKEAVKEFMPMQPGDVPATFANVEDLEKTVGFKPNTSIQGGMSQFVDWYKSYYLK

SEQ ID NO: 39366 - protein, 385 aa, Lactobacillus reuteri
MEDKEILSMHAKNQGVLNIAPQFEVKNRKELGEAYTPGVAIISKLIERYPELKDKYTLSGKLVALVTDGSAVLGLGNIGPAGGLPVVEGKALLYKDLANVNALPLTVEQVPVNEFVATLKNMQESFAGFHLEDIKAPRCFEIEEKLSKVVNIPVYHDDQEGTAIVVLAGLINAARVVKKNLKDLKVIINGVGASGVATARLLFAAGIKNITFVDIDGPVHVDSQNYNHYQTDLVKQSADQTPYKNLSEAVKDRDVFIGLSDADVLTSEQVKTMAKNPIIFALANPKPEIDPQIAKDADAAVMATGSSQYPNQVNNILVFPGLYKGLLSADLNKVDFGLEKAIASALANMISNPTAEKIVPGVFDDGVVNTVAKAVQHYASQKNND

SEQ ID NO: 39367 - protein, 308 aa, Mycobacterium tuberculosis H37Rv
MSVVFADVDTGIDDALAVIYLLASPDADLVGIASTGGNIAVGQVCANNLSLLELCGAADIPVSKGADEPLGGRWPDHPKFHGPKGIGYAELPASNRRLTDYDATTAWIAAAHSHAGDLIGLVTGPLTNLALALRAEPALPRLLRRLVIMGGMFDGQPITEWNIRVDPEAASEVFTAWAGQRQLPIVCGLDLTRRVAMTPDILARLASVCGSSPVMRVIEDALRFYFESHEARGHGYLAYMHDPLAAAVAMDPELLTTRTATVDVDPTGATVTDWSGKRNPNARIGMSVDPAVFFDRFVERIGRFARRT

SEQ ID NO: 39368 - protein, 445 aa, Neptuniibacter caesariensis
MKVTVFGIGYVGLVQAAVLADVGHDVVCVDVDQNKVDNLKKGLIPIYEPGLTPIVESNFAEGRLRFTTDAAEGIAHAEIQFIAVGTPPDEDGSADLKYVLAVAETIATHMNSPKIIVDKSTVPVGTADKVSAKVGSVLSTRNERIDYHIVSNPEFLKEGAAVSDCMRPDRIVIGTDSQHVEEQMRELYAPFNRNHDRMIFMDVRSAELTKYAANCMLATKISFMNEMSQLAERLGADIENVRRGIGSDERIGYHFIYPGCGYGGSCFPKDVQALVRTADEIEYDAQLLKSVESVNYKQKEVLFDRVFNYFNGDLAGKTIALWGLSFKPNTDDMREASSRVLMEKLWEQGAKVRAYDPEAMEETQRVYGVRNDLDLVGTKESAMQGADILVICTEWKVFRAPDFDQIKRSLTYPVVIDGRNMYEPEIVERHGLEYFGIGRGRSITA

SEQ ID NO: 39369 - protein, 333 aa, Pinus taeda
MGMCSLVKTWWRWGWDVALSVPLLLMLPSAISFCKLFRMFIITRPERVRGKVVLITGASSGIGQHMAWEYAKRGANLVVVARRRNRLEEVAKECKAYGAQYAVVCPADLTKPQDCKRIVEFTVSTFGRLDVLVNNAGTAGGSLFEEYENAAEYKRIVDIDFWGHVNTTHFALEHLQRRRGQIVVISSMIAFLPFPFTTVYSAAKGALLNFFETLRIELISKSVTVTIASPGFIQSELTSREGPGKLPWWFPMARTEDAAREIVEAALRKERDVITPRWYSSLLWFRILCPEILEWVPRVFILGQAPTRGVEIVCNSVFGKFNTHTLFRTLKLA

SEQ ID NO: 39370 - protein, 647 aa, Neptuniibacter caesariensis
MSIITITVPDLSGSTDVDVVEVLVKDGDTISEGDSLIVLETDKASMEVPATHSGVVVSMKVNVDDQVNEGDLLLELDTGASASAPAAEEAPAPAAAPEAAPAPAAAPAAASAVENVLIPDLSGATDVDVVEVLVKDGDTVSEGDSLIVLETDKASMEVPAPKDGVVVSMKINVDDQVNEGDLLMELSVGGAAAPAAAAPAVAPAQEAAPAAAPAPVAGGKENVLIPDLSGASDVDVVEVLVKDGDSVEEGDSLIVLETDKASMEVPAPKAGTVVSMKINEGDTVNEGDLLLELEVSGGAAPAPAAPAAAPAAPAPAAPAPSAPAKAAPAAGNVDKAALEKKNKTVHAGPAVRAIAREFGVDLSLVTGTGRRGRIVKEDVQAYVKGALKQLAEAPKGGAVTGGSGIPAIPEVDFSKFGEIEVEKLSKIAKVTRDNMSRCWLNIPHVTQFDKADITDLEAFRKEMKDEAAKSGVKLTPLPFMLKAIAIALKEHPKFNASLHADGEHIVYKKYVNIGMAVDTPNGLMVPVIKDADKKSIYELSKEAIELAGKAKDRKLKPDEMQGACFTISSLGGIGGTGFTPIVNAPEVAILGVSKADIEPRWNGKEFEPRKMLPLCLSYDHRAINGGDAGKFLTYLNGLLSDIRRLVL

SEQ ID NO: 39371 - protein, 235 aa, Glycine max
  misc_feature (66)..(66): Xaa can be any naturally occurring amino acid
  misc_feature (114)..(114): Xaa can be any naturally occurring amino acid
MAGDGELKLLGVWTSPFVIRVRVVLNLKSLPYEYVEENLGSKSALLLGSNPVHQSVPVLLHGGRPXVNESQVIVQYIDEVWAGAGPSVLPADPYERATARFWAAYVDDKVGSAXGTGMLFSCKTEEERAEAVSRAVAALETLEGAFAECSKGKAFFGGDAIGFVDVVLGGYLGWFGAIDKIIGRRLIDPARTPLLARWEERFRAADAAKGVVPDDADKMLEFLPTVLAWIAGKAK

SEQ ID NO: 39372 - protein, 509 aa, Nepeta racemosa
MVSLSYFLIALLCTLPFLLFLNKWRRSYSGKTPPPSPPKLPVIGNLHQLGLYPHRYLQSLSRRYGPLMQLHFGSVPVLVASSPEAAREIMKNQDIVFSNRPKMSIANRLFFNNRDVAFTQYGEYWRQIRSICVLQLLSNKRVQSFRRVREEETSIMVEKIMQLGSSSSTPVNLSELLLSLTNDVVCRVTLGKKYGGGNGSEEVDKLKEMLTEIQNLMGISPVWEFIPWLNWTRRFDGVDQRVDRIVKAFDGFLESVIQEHKERDGDKDGDGDGALDFVDILLQFQRENKNRSPVEDDTVKALILDMFVAGTDTTATALEWAVAELIKNPRAMKRLQNEVREVAGSKAEIEEEDLEKMPYLKASIKESLRLHVPVVLLVPRESTRDTNVLGYDIASGTRVLINAWAIARDPSVWENPEEFLPERFLDSSIDYKGLHFELLPFGAGRRGCPGATFAVAIDELALAKLVHKFDFGLPNGARMEELDMSETSGMTVHKKSPLLLLPIPHHAAP

SEQ ID NO: 39373 - protein, 122 aa, Xylella fastidiosa 9a5c
MSLTNEKIVEAIAEKSIMEVMELVKAIEDKFGVSAAAPVMVSGSAAAAAPVEEQTEFTVTLKEAGAKKVEVIKAVRAVTGLGLKEAKDLTEAGGILKEAVSKEEAEKVKKELEAAGATVEVK

SEQ ID NO: 39374 - protein, 190 aa, Nostoc punctiforme PCC 73102
MFSPPFPEENDNAHAGSITLTDEKGRSLECYVEHSLEVDGQEYVLLLPVDSPVEIFSWEGDDEEEEAVLVEDDNIIEQIFATAQAVLSEQNLILKNTAYALTVAGDLPPVEESELFTLEIEDEEADLDPEQLQLLASFYDEDQEYAIYTPLDPLLFFARITKTGEPELLSPEEFRKVQPLLEEHLFNEVE

SEQ ID NO: 39375 - protein, 488 aa, Bdellovibrio bacteriovorus HD100
MKLPHVKIVPAVIAFFVTCLFWFVISPPEGVDLNAWRLLGIFVGTITAIIGKALPIGGAAMIGILLVGITQVTSPGNPGKAMGDALSGYSNTLIWLIGISFFISRAFIKTGLGSRVAYYFVRAIGKKTLGISYGLSFAELVLSPVMPSNTARGGGVLYPINRSISESMGSRPDEATRLKVGAFLTLVAYQINVITSAMFITATAPNPLVTAGIRDIAKIDVSWAQWAMAAFVPGLLAILIIPWVLFKLYPPQIKETPDAAGYANKKLQELGPLRLDEKILIGVFFLLLFIWAGGPELLSSDPLFKVDATAGAFVGLGVLLFSGVLTWDDLLKEKGAWDTVTWFSSLVMLATFLNKLGVVAWFSKTVESSIAHWGLGWMEAAAILVLLYVFIHYFFASNTAHISALFASFFGVGVALGAPPLMFGLFLGFASSLCASLTHYGTGSAPVLFGSGYVTMGEWWKWGFVVTLLNLLIFAGGCAVWWKVLGYW

SEQ ID NO: 39376 - protein, 502 aa, Salmonella enterica subsp. enterica serovar Paratyphi B str.
MQTKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGVRFGADSVLKPEIVRGFEYSDCWVDDARLVLANAQMVVRKGGEVLTRTRATAARRENGLWIVEAEDIDTGKKYVWQARGLVNATGPWVKQFFDEGMHLPSPYGIRLIKGSHIVVPRVHNQKQAYILQNEDKRIVFVIPWMEEFSIIGTTDVEYKGDPKAVKIEESEINYLLKVYNAHFQKQLGRDDIVWTYSGVRPLCDDESDSPQAITRDYTLDIHDENGKAPLLSVFGGKLTTYRKLAEHAMEKLASYYPGIGPAWTKTCVLPGGDIDGSREDYAAKLRRRYPFLTESLARHYSRTYGSNTEWILGEATSLLDLGEDFGHEFYEAELKYLVDHEWVRRTEDAIWRRTKEGMWLTAEQQSRITQWLAAYVEKHQLSLAS

SEQ ID NO: 39377 - protein, 319 aa, Chlamydomonas reinhardtii
SLLPGYTVGKVIGEGGFCQVRIAVHHLSQRKVAVKVIDRAKLTDPNEAKRMQREIRVMKHLSHQCVIKLFEVIESPRHLFLVMEHAPAGSLLDYVRARKRLPEADACVFFQQIVASLEYCHSREVVHRDIKLENILLDADQRMKLIDFGLSAFYVPGKRLRVHCGSPSYAAPEIVARKAYEGPPVDVWSLGVVLFAMVAGYLPFHASGGNKQLCNKIMAGTYTAPEWLSAPMKDLLARMLTVDPDKRISFQQVRRRPGGRARARAVTPDPGALGGLRCDEQVVAELESAGYPRSSLVQYLIAGEANHLTASYFLLCESK

SEQ ID NO: 39378 - protein, 736 aa, Nocardioides sp. JS614
MTETQTQSAVRYEKDADGIVTLTLDDPTSSANTMNELYLESMAAAVQRLYDEVETVTGVVVASAKKTFFAGGNLKNMVRATKADADSVFAMGEAVKAGLRRLEQFPRPVVAAINGAALGGGFEICLATNHRIVVDDDSVKLGLPESTLGLLPGGGGVTRIVRLLGLQSGLMDVLLTGTQFKPSAAKEKGLVDELVATREELVPAAKAWIKANPEESQNPWDKPGYKMPGGSPTSPALAGFLPAFPALLRKQTKGAVYPAPRAILSAAVEGALVDFDTASRIESRYLTNLIVNQGSKNMIQAFFFDLQAINSGSLRPQGIPPYRAVKVGVLGAGMMGAGIAYSCARSGMEVVLKDVAVESAEKGKAYSEKLLDKAIAKGRSTEEKKAELLGRITATADAADLAGCDLVIEAVFEDPSLKQQVFAEIAPYVDQDALLCSNTSTLPITELASGVDRPADFIGLHFFSPVDKMPLVEIIRGAKTSDVALAKAYDVVQQIRKTPIVVNDSRGFYTSRVIGTQVMEGLAMVAEGLHPVSIERAGTQAGYPVGPLQLTDELNMELMAKIQKANADAAEREGRTWESSAGEQVVAKMIELGRPSRLKGAGFYEYDEAGRRQGVWAGLAEAFPRSEQPIPLQDMKDRMLFIEALETAKCFEEGVLASSAAANIGSIMGIGFPAMTGGAAQFMQGYEAPSDSGAAGQIGLGAFVARADELAEKYGERFRPTAYLRDLAASNGSFPA

SEQ ID NO: 39379 - protein, 431 aa, Yarrowia lipolytica CLIB122
MSYFASVPAAPADALFGLMAKYKADTFDKKVDLGVGAYRDNTGKPWVLPVVSKVDSLIVADPTANHEYLPITGLPDFTKSAAKLILGPDSPAIKENRVASCQTISGTGANHLGSLFLSRFPSSAAPPKSVFLSRSPPSPGATGDTPPRAAGGRIWISNPTWANHKQIFENVGLTVKQYPYWDPKTLGLDLKGMLNALENETRPGDIVLLHACAHNPTGVDPAREEWEKIAAVCKSKKLFPFFDSAYQGFASGDLERDAWAVQYFVSQGLELLICQSFAKNFGLYGQRAGCLHFITQTAKASENVKSQLAFLQRSEISNPPIYGARIVARVLNNPELFNEWKENLLEMANRIKSMRDALKSELIKLDTPGNWDHITNQIGMFSFTGLSPQQVDRLVNEFHVYLTKNGRISMAGLNTHNVAYVAKAFDAVVRG

SEQ ID NO: 39380 - protein, 311 aa, Staphylococcus aureus subsp. aureus MRSA252
MKRKIIMDCDPGHDDAIALILAGAIDSPLEILAVTTVAGNQSVDKNTTNALNVLDIMGRQDIVVAKGADRPLIKLVAFASEIHGESGLDGPKLPSTPSRQAVAMPASDVIINKVMTSDTPVTIVATGPLTNVATALIREPRIAEHIESITLMGGGTFGNWTPTAEFNIWVDAEAAKRVFESGITINVFGLDVTHQVLADEHVIERFESINNPVAQFVVELLQFFKKTYKTHFNMDGGPIHDACTILYLLQPELFTMVPVNIDIEHQSPLTYGTMAVDLNHVTGKPANAYFATAVDVEEVWNLIDHKLRTYE

SEQ ID NO: 39381 - protein, 572 aa, Burkholderia thailandensis E264
MTPAIDPNFKRLRRFIEFPLPVGVWARTGADARRTGYARHVPDACRRACARPSAGLSAMRRGACDARVRASHGPSRCSTVHAHAAWLCIASRVLTLSRRISIDAALARRPRQRASRHLPDIVRSISEELSMTEHVSQTPDLSAFWMPFTANRQFKEAPRLLVAAKGMYYTSHDGRRILDGTAGLWCVNAGHGRDEIVAAVQAQAREMDFAPTFQMGHPKAFEAATKIARHTPGDLKHIFFTNSGSEAVDTALKIALAYHRARGEGQRTRFIGRERGYHGVGFGGISVGGIAPNRKAYSGALLPSVDHLPHTLNLKEAAFSKGQPAWGAHLADELERLVALHDASTIAAVIVEPVAGSTGVLIPPQGYLERLRELCDKHGILLIFDEVITGWGRLGAPFASQFFGVTPDLLTMAKGTNNAAVPMGAVAASGAIHDAIVDGAPAGIELFHGYTYSGHPLAAAAAVATIDLYEREGLLTRAAQIAPIFEREIHKLKDARHVIDVRNLGLVGGVELKPRDGKPGARAYEVFVKCFANGAMIRYTGDILAFSPPLIVEEAQIVELFSIVAQALKETE

SEQ ID NO: 39382 - protein, 408 aa, Methylobacillus glycogenes
MALIVQKYGGTSVANPERIGNVARRVARHKALGQQVVVVVSAMSGETNRLIGLAKEVMPNPHPRELDVLVSTGEQVTIALLSMALMELGVKAKSYTGSQVSIVTDNAHTKARILKIDEERIRKDLDDGYVVVVTGFQGVDEHGNITTLGRGGSDTTGVALATALKADECQIYTDVDGVYTTDPRVVPEARRLKSVTFEEMLEMASLGSKVLQIRSVEFAGKYKVKLRVLSSFEEEGEGTLITFEDDNNMEQPIISGIAFNRDEAKITVLGVPDRPGIAYQILGPVADANIDVDIIIQNVAADGTTDFTFTVHKNDLQKALDILRDKVQGHIGAREIIGDDKTAKVSVVGVGMRSHVGIVSQMFRTLAEEGINIQMISTSEIQISVVIDEKYMELAVRVLHKAFGLEEV

SEQ ID NO: 39383 - protein, 525 aa, Mycobacterium tuberculosis H37Rv
MVQPADIDVPETPARPVLVVDFGAQYAQLIARRVREARVFSEVIPHTASIEEIRARQPVALVLSGGPASVYADGAPKLDPALLDLGVPVLGICYGFQAMAQALGGIVAHTGTREYGRTELKVLGGKLHSDLPEVQPVWMSHGDAVTAAPDGFDVVASSAGAPVAAFEAFDRRLAGVQYHPEVMHTPHGQQVLSRFLHDFAGLGAQWTPANIANALIEQVRTQIGDGHAICGLSGGVDSAVAAALVQRAIGDRLTCVFVDHGLLRAGERAQVQRDFVAATGANLVTVDAAETFLEALSGVSAPEGKRKIIGRQFIRAFEGAVRDVLDGKTAEFLVQGTLYPDVVESGGGSGTANIKSHHNVGGLPDDLKFTLVEPLRLLFKDEVRAVGRELGLPEEIVARQPFPGPGLGIRIVGEVTAKRLDTLRHADSIVREELTAAGLDNQIWQCPVVLLADVRSVGVQGDGRTYGHPIVLRPVSSEDAMTADWTRVPYEVLERISTRITNEVAEVNRVVLDITSKPPATIEWE

SEQ ID NO: 39384 - protein, 219 aa, Desulfovibrio desulfuricans G20
MSAKESLLTGTFEERVEAALDALRRGHGVLVTDDEDRENEGDLIFAAETLSDSQMAMLIRECSGIVCLCLTDEKVRALGLPMMVENNSSQYQTAFTVSIEASCGVSTGVSAADRVCTIQAAIADDACPSDLCRPGHVFPLRARPGGVLERRGHTEATVDLMRLAGLKPCGVLCEVTNPDGTMARLPQIVDFGRKHDMVVLTVDDLVRYREMKENKSAAA

SEQ ID NO: 39385 - protein, 87 aa, Alteromonadales bacterium TW-7
LKLQTYFTAGVKEVRAWTIPVGATAPQAAGKIHTDFERGFIRAQTIAYDDYINCKGESGAKEAGKMRQEGKEYIVKDGDVMNFLFNV

SEQ ID NO: 39386 - protein, 339 aa, Clostridium perfringens ATCC 13124
MKKVLVLGEMLMRLTPPNNNKIGQANSFNVCFGGAEVNVAVGLSNLGIETRVLTALPDNEIGNFAKSFLKSQYVDCDFIISKGDRLGLYYYEEGCSARKAKVVYDRKHSSITELQYEDIDVESLFKDVELLHISGITFGLSEEVSEVALKLVNEAKKRGIKISVDLNYRSKLFESYEEFVRIMKPVVQDAYLCFGWLNREDEPFKVLDASTTELSDEDFIERFRYTIEDLKVKNIVTTLRSGTPYNYHTLQGVFYDGERVYKSSKYDFSMISRIGGGDAFAAGVIRTLIENKGEDLSHVIEFGTAAAVLKQTQLGDVSISSKEEVLDLINNKNLGSVNR

SEQ ID NO: 39387 - protein, 383 aa, Triticum aestivum
MGFQDAPTGSGGGGNLSLASVGFAGAGVGVGVGAKGAASSGGGYKELLVMALPKDDGLDAAKVIGAGLPDVGEAVRAFFRSREIREFASGALAGAMSKAVLAPLETIRTRMVVGVGSRHIAGSFVEIMEHNGWRGLWVGNTINMIRIIPTQAIELGTFEYVKRGMKSAQEKWKEDGCPKIQLGNMKIDIPLHLLSPVAIAGAAAGIAGTLMCHPLEVIKDRLTVDRVTYPSISIAFSKIYRTEGIRGLYSGLFPTLIGMLPYSTCYYFMYDTIKTSYCRLHKKKSLSRPELLIIGALTGLTASTISFPLEVARKRLMVGALQGKCPPNMVAALSEVIREEGLLGIYRGWGASCLKVMPNSGITWMFYEAWKDILLAEKDKHLD

SEQ ID NO: 39388 - protein, 461 aa, Arabidopsis thaliana
MASKSDVNIIETSSKVHFSGFHQMDGLASNRPEQMAEEEEHGQPFVIGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDADADVRLARRIKRDTVEKGRDIATVLDQYSKFVKPAFEDFILPTKKYADIIIPRGGDNHVAIDLIVQHIHTKLGQHDLCKIYPNLYVIQSTFQIRGMHTLIRDSKTTKHDFIFYSDRLIRLVVEHGLGHLPFTEKQVVTPTGSVYSGVDFCKKLCGVSVIRSGESMENALRACCKGIKIGKILIHREGDNGQQLPSDISERHVLLLDPILGTGNSAVQAIRLLISKGVPESNIIFLNLISAPEGVNVVCKKFPRIKIVTSEIELGLNDEFRVVPGMGEFGDRYFGTDDE

SEQ ID NO: 39389 - protein, 361 aa, Lentisphaera araneosa HTCC2155
MLSEEEKLRYSRHLLLDGFGEEAQNKLKKSSVLLIGAGGLGCPVGLYLAAAGVGKITLLDFDLVENSNLQRQVAFESDDLGLPKSEVLAAKMRQLNPYIRVQSISERFDASNAEQLMKEHDVLVDGSDNFSTRYLCNDASFLYKKPLIFAAVSRYSGQLSVFNQDDKSPCYRCLFPQEPEEGITANCSEAGVLGALVGVLGTLQAVECLKVLTGVGESLSGKFMTYDMLTAQFNSFKLAKSPNCQLCGDQAKITELIKQDETCSLEEKSALSLEEFKQVYESQKLALLDIRENAEKALFPIPYENLHIPLSELRNRLDELDSEKVYCTLCQYGERSRKAYLTLKKNKIKAYYLDEGMDKLL

SEQ ID NO: 39390 - protein, 735 aa, Arabidopsis thaliana
MVKQHSVRLKHCVFTVKSSVPVYSEGVNDGIKLHSFGNLVKKKVFLDTSKRFYFQGRWSESSGRRVETYAGVDVASAVDVINDLGFDTLTFLMVTVIIVPAFRILKASPVQQKATRSWFVFSILGFFFAGVVLNQFGLIRNLTDVKVLSEWGILFLLFEMGLELSLARLKALAKFAFGMGLTQVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGSPIYARAQDLPHLLELKKAGATDAILENAETSLQLGSKLLTGFGVMSDDVSFLSKVFRDSMEIQAQEEITASETNAGLKPMQMKASDINVVSAATQKQVQLMKPMQMKASDSNSDSAAEILQETAGLSQPPEIDDSSVNIDNGFVGKADKAQD

SEQ ID NO: 39391 - protein, 474 aa, Myxococcus xanthus DK 1622
MSESAGAQFGVAGMGVMGASLALNIADHGFRVAVWDRHAERIDEMHRKHGHPEVWGTESLEAFVQRLERPRKVLLMVTAGAAVDSMLERLLPLMAEGDVIMDAGNSWFLDTRRREEQCKAKGIHFLGVGVSGGEEGARNGPSIMPGGAPSAYELVRPVFEAIAANTDMGPCVTYVGADGAGHFVKMVHNGIEYADMQLLAETYDVLRRGLGLDADALADLLSQWDHGIAGSFLLETTIKVLRQKDPETGKPLVDLVLDKAGQKGTGKWTVQVALDLGVPIPSIAASLDARILSSMKDERVAAAPKLNGPVGQLSKEERAQLAAWTHDALYAARVVTYAQGMRLIQAASQEYQWNISLAELARIWRGGCIIRAKLLTPLREAFQQQPTLPNLMVSDAFAPVLERMAPAWRQVVGVATRVGIPVPVFSSSLAYLDSYRTAELPQNLTQAQRDAFGAHTYQRKDRPEAGFVHTEWGK

SEQ ID NO: 39392 - protein, 498 aa, Novosphingobium aromaticivorans DSM 12444
MSYFSDLGLAEPILRALETKGYNDPTPIQRQAIPALLEGRDLLGIAQTGTGKTAAFALPSLHRLAANPQPRKPASCRMLVLSPTRELAAQIADNMKGYARNLNLIVDCVFGGVPIGKQARRLVPGVDILVATPGRLLDLIDNRALTLGRTEIFVLDEADQMMDLGFIHALKRVANLLPKTRQSLFFSATMPKAIEDLGKQFIVNPVRVEVAPNSTTAERVEQYVTFINQAEKQALLTLRIRDLLKTKELDRALVFTRTKHGADRVVRHLSSAGIDARAIHGNKSQAQRTAALEAFRQGSCPVLVATDIAARGIDVSGVSHVFNFELPNVPEQYVHRIGRTARAGADGIAISFCAPDEKPYLKDIERLTRVKVDALPLPENFTAEAAKLPAPSRKPAEQEQDARRDARDARGNGGRGGQGRGQAHGGRAQGRDGRPRDASPRQDRREGDRGPVRNPLHTDRTDRPERIEGERDGNKPRRFRPRGAPGVGAHRNKVRRAS

SEQ ID NO: 39393 - protein, 363 aa, Xylella fastidiosa 9a5c
MGIKCGIVGLPNVGKSTLFNALTKAGIAAANFPFCTIEPNVGVVPVPDPRLNQLAEIVKPQKLLPTVIEFVDIAGLVAGAASGEGLGNKFLAHIREVDAIAHVVRCFEHGQIIHVAGKVDPLADIEIIDTELILADLDTVEKACNRMMRAAKGGDKEAIACKSVLERLQVALNEGKSARSAGLDEDERALVRDLFLLTLKPVMYIANVLENGFQDNVYLEALRVRAASDNAQLVPISAVIEEELAQLEDVDRDAFLVDLGLEEPGLNRVVRAAYALLGLQTYFTAGVKEVRAWTVKSGATAPQAAAVIHTDFEKGFIRAETIAFDDFIKYKGEAGARDAGRMRLEGKEYRVQEGDVLHFRINV

SEQ ID NO: 39394 - protein, 498 aa, Sesamum indicum
  misc_feature (1)..(7): Xaa can be any naturally occurring amino acid
  misc_feature (19)..(19): Xaa can be any naturally occurring amino acid
XXXXXXXSGSGVSTLEKKXPGRIVQIIGPVLDVAFPPGKMPNIYNALVVKGRDTVGQPINVTCEVQQLLGNNRVRAVAMSATDGLMRGMEVIDTGAPLSVPVGGATLGRIFNVLGEPVDNLGPVDTRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 39395 - protein, 312 aa, Xylella fastidiosa 9a5c
MVFSGNANKPLTQSICKELGVRMGKSLVSRFSDGEEQVEIEESVRRQEVFVVQPTCAPSAENLMELLVIIDALKRASVSSVTAVIPYFGYSRQDRRMRSLRVPITAKVAAKMISAIGADRVLTIDLHADQIQGFFDVPVDNVYASPLLLADIWRAYGTDNLIVVSPDVGGVVRARAMAKRLGDTDLAIIDKRRPRANVATVMNIIGEVNGKTCVLVDDLVDTAGTLCAAAVALKQNGATKVVAYITHPVLSGPAVDNINNSELDELVVTDTIPLSDAARECRKIRQLSVAELLAETIRRIAFGESVSSLYVD

SEQ ID NO: 39396 - protein, 314 aa, Rhodopirellula baltica SH 1
MSRKIIIDCDPGIDDAIAITMALFDPRLDVVAITPTAGTVDAAQASINAMGIVDLLDPARYPQLGTAVAPTDPPMLDDSHLNGPDGLAGLNFPSATRQNDHSSDKLMADLIRRHPDEITIVCLGPLTNLARVCRMDPAVLPLIDKVVISGGAVSHSGNATAVSEMNFFFDPSSAKQVIASATTKSLVPLDVTDAVTFGVDLLEKLPPETTRAGALLHKILPYKFRISHQKLGREVIPLQDATALISVIEPEMFQWDEMAGDVEVNGALTRGMTVFDRRLRPEWSVNMEVARRASITDVRDAIVRSIRYAGQQTR

SEQ ID NO: 39397 - protein, 535 aa, Legionella pneumophila str. Paris
MNKNLSALSLLWISITSMVGSGWLFGSLYSAHFAGPAAIIAWPLAGFLLLFVALSYAELGTMFPQSDSLACLPLYTHGRLTGIIINVMTWFSLAILPVIETQGVIQYASNYIPDLVSHDALHYRNTPAGYMLSLVVLMSFVLFNYFGIGLFARINAAFTIWKIIIPILTIASLATMSYHPGNFFQHGGFMPYGWQGVMAAMSSGGVLFSLLGFRQVVIMMGEFEKPGQYIPLILGGSLVFVTLLYTGLQWSFIGSISEQALEKGWVNLSFTGDAGPFAALAALVGMFWLSILLYTDAFISPYSTGLVYSTTAAHMLSTMGSVVPTPVILTQKNRYQAPWVSLSVNFLLAATMSLVLHGWQEMSAFLVAILMISYSIGPVALVCLRQQLPHYKRPFRLQGSSLIGFTGFYVCTVGVYWTGFHSVRKLLVITILGVVCSFLYCLIKNTHREIDSKQGLWFIFYLFGLGIFSFLGNYGGKHILPQYWDLLYLLVFSLLVFGFALLSRKSSAYTQNMVAQNTHTTITASAFSVERHDIA

SEQ ID NO: 39398 - protein, 432 aa, Xylella fastidiosa 9a5c
MTLWVLGLNHQTAPMELRERASFVGDALPRALDSLRNLPNVNEAALLSTCNRTELYAETTNAQILLNWLEQHRPGLQNHLYQYRDAAAVRHLFRVATGLDSMVLGESQILGQVKDSWSMARTHGTLGNTLDRLFQHGFSVAKHARTNTRIGANPVSIASTAVRLAQDAFSPLNESTVLLIGTGETIQLAAKHLSEGRVQRLLIANRTHAKAQMLASQHGGYALPLTELNLHLAEADIIFSATAAPTPIVTQSNVESALHIRKRKPMLLFDLAIPRDIETEVGTLTDAYLYTIDDLERAVEENRRSRREAAETAEAIIELQVKRYMDTLQAHAHQAPLRRLRTFGTTTRDELLTRARQQLANGRPAEEVLEQLAHGLTNRLLHPPTAALREAALANNTELVRAAEQLFPEKPGYHHPTLQTTIVKTDETDPAS

SEQ ID NO: 39399 - protein, 482 aa, Burkholderia thailandensis E264
MSDAGDAAPDEPTFASLGLSPEIVSALQAAGYVKPTPVQQRAIPAGIAGRDLLVSSPTGSGKTAAFMLPAIERFAQLQKAQAQQPRAPREAQPGERRGRRPQPVARPGLLVLTPTRELAMQVTTAASTYGKHLRRLRTVSILGGVAYGQQLMLLAKNPEILVATPGRLLDHLERGRIDLSELKMLVLDEADRMLDMGFIDDIDTIVAATPASRQTMLFSATLDGKIGSLTNRLLKDPERIEITQKIESRSNIAQTVHYVDDRDHKDRLLDHLLRDTALDQAIIFTATKIDADQLAGRLADAGFQSAALHGDLPQGARNRTIRALRERRVRVLVATDVAARGIDIPGITHVFNYDLPKFAEDYVHRIGRTGRAGRSGTAVSLVHHAEQGALKRIERFVRAPLPVNVVEGFEPRKAPPPRNDRGNGRGRPGGNGGRRFGGKPGGGHGGGRSGGWSGKPGGNREGYGARRSDGQRGGPRRGNSAA

SEQ ID NO: 39400 - protein, 416 aa, Campylobacter upsaliensis RM3195
MITYEKKVLKNKLEVYALPVNKNSGVISVDIFYKVGSRNETMGKSGIAHMLEHLNFKSTKNLNAGEFDTIVKGFGGVDNASTGFDYTHYYIKCSKQNLEQSLGLFAELMQNLSLKDEEFQPERQVVLEERRWRTDNNPLGYLYFRLYNHAFLYHPYHWTPIGFYKDIENWSIEDIKSFHKSFYQPQNAILLVSGDVEPKDLFQKASKHFEKIKNTGKIPKIHTKEPKQDGARRAELTKETQTEFLALAFKIPNFKHKDIPALSALAELLGNGKSAIINEILVDKLSLVNEFYAFVNDSVDENLFMFILNCNPGVKAEEVEKKLLAILHSIKQGKISKRSLQRVKNNTRSDFIFSLNNASALSNIYGSYLARGDLEPLLNYEKNIAALELEDLVEVATKYFIRENSTTLILRKENNG

SEQ ID NO: 39401 - protein, 347 aa, Staphylococcus aureus subsp. aureus MRSA252
MKALKLYGVEDLRYEDNEKPVIESANDVIVKVRATGICGSDTSRYKKMGPYIQGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDIAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 39402 - protein, 428 aa, Mycobacterium tuberculosis H37Rv
MAGEFRLLSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLIYLTVTG

SEQ ID NO: 39403 - protein, 440 aa, Nocardioides sp. JS614
MPGQRVTVIGCGYLGATHAACMAELGYEVLGVEIDAAKRESLAAGKVPFYEPELEELLAKHVTSGRLRFTDSYEEAGAFGAIHFVCVGTPQRHDALGADVRYVDAAVESLAPYLVESALVVGKSTVPVGTAERLAARLAALAPAGAEARLAWNPEFLREGFAVKDTLEPDRLVFGVASERDEQELRSFYSSVIEAGTPVVVTDFATAELVKVSANAFLATKISFINAVAEVCEAAGGDVVDLADAIGHDARIGRKFLNAGVGFGGGCLPKDIRAFLHRAGELGVEDTMSFLRQVDDINLRQRTRVVQIATTMLGGSVARARIAVWGAAFKPHSDDVRDSPALSIAGQLHLRGAQVSVYDPKANDTARATFPTLDYAESALAAARDADLLLHLTEWPEFRSVDPAELGAVVRRKQLVDGRNVLDLAAWRAAGWTARGLGRR

SEQ ID NO: 39404 - protein, 537 aa, Clostridium cellulovorans
MKTGIAASKGYAIGNVFVKEEKEIKIVEQHIEDVEAEVARLNDATSLARTQLEKIKDKAEKEVGADKAAVFESHIMMLDDPEFTGAIENTIRDKQINAEKALTEVLDMFIAIFDSMDDEYMRERVADVKDVGTRILKNLAGIVEDLSEVENNTVIVAHDLTPSDTAQLDKSKVIAFVTNIGGRTSHSAIMARTLEIPAVVGLNDIVQTAKSGDKIIVDGNEGIIILNPDEATIAEYEAKKAQFEKEKEELKKLISVKTVTKAGKKVKVMGNIGKPEDINGVFENGGDGVGLFRTEFLYMDRDSMPTEEEQFQAYKYVAEKAGEREVVVRTLDIGGDKKLPYLPLPEEMNPFLGYRAIRLCLDRTDIFKTQLRAILRGSAFGNLMIMFPMISSLEEFNKSKEILAECMAELKAEGKAYNENISTGIMVEIPAAAVNADELAKHVDFFSIGTNDLIQYTLAADRMNEKISYLYNPMHPAVLKLIKMTIEAAHAQGKWCGMCGEMAGDETAIPTLVKYGLDEFSMSASSILTAKQIIMNN

SEQ ID NO: 39405 - protein, 378 aa, Ralstonia eutropha JMP134
MLPSFPSAILALADGTVFRGYSIGASGHTIGEVVFNTAITGYQEILTDPSYSRQIVTLTYPHIGNYGVNREDVEATKVHAAGLIIKDLPILASNFRKEHTLGHYLKQEKVVAIAGIDTRKLTRILREKGAQNGCILAGEDNVQKAIDLARSFPGLAGMDLAKVVSVKEPYDWTQSEWELGQGYGKQDKPQFHVVAYDYGVKFNILRMLAERGCKVTVLPAQATAADALALNPDGVFLSNGPGDPEPCDYAIKATREFIERGIPTFGICLGHQIMALAIGAKTLKMKAGHHGANHPVKDLDDGRVMITSQNHGFAVDAETLPANARATHVSLFDGTLQGFALTDKPAFCFQGHPEASPGPHDVAYLFDRFTKMMADARK

SEQ ID NO: 39406 - protein, 516 aa, Gibberella zeae PH-1
MEGNPEPEPVRGEPPHETEAKAPADINLPSEPLGTQGQLETGETPVEDPAQEQVKSWIESQTETEPQQPPIESSTVDAEGDDTAGELPRVEADAPSTETEVPGMTGTAAESASTTASAPPQGTDATAPPAGVGVVTGPALITPRRRAASASTGPSSSTSAAGHGHVPHFVAPSSYLRRRTSIRSPMAPTEPKPLSPLDRDQLQGLNAIRDFLRVRTSYDVLPLSFRLIVLDNELLIKKAINILTQNSIVSAPLWNSKTSRFAGILTSTDFINVIQYYCQYPDEFHKLDQFRLSSLRDIEKSIGAIPIETVSVHPSKPLYEACRRMLKTRARRIPLVDVDSETNKEMVVSVITQYRILKFIAVNNEHNTVLLKKTVREIGLGTYSGIATAKMNSSVLDVVHLMVKYNISCVPIIDSHGRVLNVFEAVDVIPCIKGGAYEDLDGSVGEALCKRSDESPGIYTCSEGDRLDSIFDTVRKSRVHRLIVVDDDNKLKGIISLSDILKYVLLYGVEDTSNWA

SEQ ID NO: 39407 - protein, 402 aa, Cyanidioschyzon merolae
MFATTGRLYQTLRVHPSHRALQSVRKRVRSRGQCPLRSARLQHVRGHGRSSNDGVSEARDSAIEHITDTRSETSRSAAVGARVVWPLGSPPQIGGGFGPVISVDDMVRTLTYSSDPVWELVRREAEIGAANEPQLASSLYATVLNHRCLEDTLAFHLANELASPFFQATQYVKLFRDALYQDKSYREAIRADLLAVVRRDPAMKHCVAVLMYSKGYAALQAYRLAHLLWRQDRKVLALFLQSEISKCFAVDIHPAARIGSGVMIDHATGIVIGETAVVGNDVSMLHNVTLGGTGKEAGDRHPKVGRGVLLGAGATVLGNIRIGDGAQITASSVVLKDVPPYTIVSGVPAREVGKLSYPKGVYPAFEMDQRAATAARVHSTNRARQHAEDSNSSTDWYLGDAI

SEQ ID NO: 39408 - protein, 378 aa, Aspergillus nidulans FGSC A4
MPSSQPASSHITTAPPKAVKPLASKSKPLEPKAPESKPSDSNVPEPVEPEAKAPETKSFKEALVNGAGDGDKQTDSSNSTSPSSFQSDSIRDSSPNTSRSNSSSSSQPTKEETDKDTEKNIKERNKQEQEKDTTTIPIVSKHCAVTSKRLPATNVSIEKSGVARCNVVDGATSDTSIKDFHEYTPMQQHILFWDRDRDGQIYPYDTYRGFRDLGFNILFSFLAVLIINLNFSYPTRLAHSFLPDPRFRVYVDSIYKAKHGSDSGSFDAEGRFIPQHFEDMFAKYDGDQDGALTFGELFNMMHGNRCAADPFGWGAAFFEWVTTWLLIQKDGKVYKDDLLGVYDGSLFWKIAKARKSPQGWSQGFGLGGDGFLGGVKVI

SEQ ID NO: 39409 - protein, 880 aa, Burkholderia vietnamiensis G4
MTYQVLARKWRPKDFASLVGQEHVVRALTHALDGGRLHHAYLFTGTRGVGKTTLSRIFAKALNCETGVTSQPCGVCRACREIDEGRFVDYVEMDAASNRGVDEMAALLERAVYAPVDARFKVYMIDEVHMLTNHAFNAMLKTLEEPPPHVKFILATTDPQKIPVTVLSRCLQFNLKQMPAGHIVSHLERILGEEQISFEQQALRLLARAAQGSMRDALSLTDQAIAYSANEVTESAVSGMLGALDQTYMVRLLDALAAGDGPEILAIADEMSLRSLSFSTALQDLASLLHRIAWAQFAPGSVLDEWPEAADLRRFAQTLSPEKVQLFYQIATVGRAELGLAPDEYAGFTMTLLRMLAFEPAVGSGSAPGGEPAVPRGVPAAAPRAAAAAAAAAATPRAAVSGGAGEAARPQAAAPVVPAARSASAQSTAPAKSSAPNQSSAPSQSSGSSQSTASDQSTASDQSTASDQSTASNRSAASAQSAASAQSAAPAQSVTPDQSTAPAQSAAPTQSQAPAETPAPAQSADAAATPAANPAAAQAPVVATPEAPVAASAQAASAARAAPANDARPSAPSEPDAPAVASRSAAPAPSTAPAEPAPAESAPRASARGGAAAALDVLRNAGMRVSSERSRPGAAPKAAAAQPAAEKPAPSRPAVVVPSPRAAARAPQPADARQAPPPWEDIPPDEYVPLSADEMFGAAADDGFVPVFDSGPDDLRIAPKPAEARPSAPVDARPLPPAIALDAIGFDGEWPALAARLPLKGVAYQLAFNSELTAVDATTLKLSVPVPQYADAAQVTKLKAALADALGKPVEVLVEVGPARRTAAALDAAARAARQREAEQEIHGDPFVQQLMREFGARIVDGSVRPLADAAPDGASPTLH

SEQ ID NO: 39410 - protein, 98 aa, Pringlea antiscorbutica
VYTVFSATDAKRSARDSHVPILAPLPIGFAVFLVHLATIPITGTGINPARSLGAAIIYNKDHSWDDHWIFWVGPFIGAALAALYHQIVIRAIPFKSKS

SEQ ID NO: 39411 - protein, 453 aa, Enterococcus faecalis V583
MKEKKTEKMLNYANGPSLEEINNTVEVPKNASFWRTLLAYSGPGALVAVGYMDPGNWITSIAGGAEYKYTLLSVILLSSLVAMLLQSMAARLGIVTGMDLAQATREHTSKRTGVALWVVTELAIMATDIAEVIGGAVALQLLFGFPLLIGVLITTFDVLLLLLLTKLGFRKIEAIVSCLIAVIFFVFAYEVALADPNVGEVLRGFIPDTKIATDKSMLFLALGIVGATVMPHNLYLHSSIAQARKFDRNDDVEKAKAIRFTTWDSNIQLTVAFVVNCLLLILGGALFYGTNSELGKFVDLFDALKNPDIVGNIASPVLSILFAIALLASGQNSTITGTLSGQIVMEGFIHLKMPLWARRVLTRLLAIVPVIICVIIYGGSETAVEDLLLYTQVFLSIALPVSIIPLTMYTSDKKLMGQFANPAWVKFLAWIIAIALTLLNLFLIYGTLTGLTN

SEQ ID NO: 39412 - protein, 599 aa, Oryza sativa
MAISGALFLPGIFQSLSILAVLGVLVTKSGAADFQEQPACVPFSCGHLEGIRYPFRLQGDPLGCGDEAYELVCRDGRAIIHINTGKYFVKDISYNESRFWVVDANLDNSSCPLPLWNNLPYFNDMGTKLYTSAVRWATFLNCSRAINNGMYMPVACLSGNTSFVYVLTTSSSYYVQNIEPSCGYLAVIPVDDRTKNVPDYASYADVVKFMRNGFPVSFPRVESPSHSPVIKACARDTFQFILAPLTVLTFLGYKYRKTRISIDAVEKFLRMQQAHGPKRYAYTEITAITGHFREKLGQGGYGSVYKGFLPGDGHVAIKMLSNSMCNGEEFISEVSTISRIHHVNVVRLVGFCSEELRRALVYEYMPCGSLDKYIFSPEKSLSWDKLNEIALGIARGIDYLHHGCDMQIMHFDIKPHNILLDSNFTPKVADFGLAKLYPRDDSLVPVSAARGTIGYIAPEMISRSFGTISCKADVYSFGMLLLDIAGGRRNREQHTSNSAHLYYPALVYDCLTQQEVSEISEDIGIHWVERKLCIVGFWCIQMKPAERPSMSEVVEMLESDDPDNLQVPPRPFFGVDDHISEMDDCCNSSSKSSAISEDD

SEQ ID NO: 39413 - protein, 453 aa, Sulfolobus solfataricus P2
MEDLVIIGYGAAGFAALIRANELGIKPVVVGYGEIGGTCVNVGCVPSKRMLRIGELYNYSSKVIGKKLFPEFFQAFQDKAEIVNSLRKEKYEDVINSYDIKLKIGKAYFTSPNAVKVNGEIIEAKKFIIATGSSPNIPNIKGLTEVGFWTNVEALSPDKTISSLAIIGGRALALEFAQMYKRLGVDTTILQRSGRILPDWEPEISLSVKNYLEENDSIPIFTNVRVKEVRKGNGGKIIVTDKGEVEADEILLATGRKPNVDLNLDAAGIELNDKGGIKVNEELRTSNPNVFAAGDVIGGPMLEALAGRQGSIAAENAIMNVHRKIDMLSVPQVVFIEPNVAKVGLTALEAVKEGYDIDQRVVKMDNIAKARILRENYGLIKMVIDKKFRNILGVQMFGKYAAEVINEAALALRFRATIDDLIDTIHVFPTMGESLRIAALAFTGDVSKMSCCV

SEQ ID NO: 39414 - protein, 514 aa, Chlamydomonas reinhardtii
MEYEPAEYQKLQVRQYAPRELRETAEGKYWRQFKAPIIAKQFGGVTHIDFCQQYPYNLAVTASTRVIIYNGLAPAVVGRTISRFKDIAYSGCFRSDGRLVCAGGQDGVVQVFDANSRSVLRQFKLHKRATRVARFGADKLHVLSGSDDVTVRWWDVSAGSQVLRLDGHRDYVRAAAASPASHDTWLTGSYDHTVKLWDVRAGGSAVLSLEHGAPVEDVAFFPSGSMAVTAGGNYLCVWDLLGGGGGRLLKRLDNFQKTVTCVRLSPLAGPDSAAAPRMLAGSLDGHVKIFELDSFRVTHASKYPAPVMSLGLSPDCRLMAVGMADGNLSVRKHARPKRAGRQRRAPRLTAANYRYFIRGQNSRAAASDYRVVRQRQVRLQAYDRMLRQFRYRESLDAALSTRQPEVVASVLEELAARGGLAGALGGRDAEGLLPLLRHLVKYIAEPRYTRLLAGVAHRLLDTYSGVVGTAPAVDKALGVLRDRLAEELGVQDQLSGLAGALEPLLAASLAGAVF

SEQ ID NO: 39415 - protein, 191 aa, Glycine max
AAATYCTSLVLPRVRPSVGFTGILVLLVFLSACCSSTHGSLETEKTFAIIKPDGLLGNYTDDIKRTIVEYGFRILKEKIVQLDEGTVKSFYAEHSSKSFFSSLIKYMTSGPVLIMVLEKDNAIADWRALMGPTDASKAKITHPHSIRAKCGLDMEKNCVHGSDSPKSAQREISFFFKELSAEFLLKLIVVF

SEQ ID NO: 39416 - protein, 497 aa, Rhodococcus sp. RHA1
MNHQDLPGLFVGGRYRDGRAAERYEVLDPATGEVISSRTEASVDDVDEAVATAKTAYADWSTTSPGERSAVLTRWAAELTEMSDDIARTETRQTGKPLKLSTAFDVPGSIDNVSFFAGAARNLEGKASGEYSPDHTSSIRREPIGVIGSIAPWNYPLQMAAWKVLPAVAAGNTIVLKPAEITPLTSLLFAEAASRAGMPDGVVNVITGRGVTTGSSLVSHRDVSMVSFTGSTPVGRQIAAAAAGKRLHLELGGKAPFVVFDDADLEAAINGAVAGALINSGQDCTAATRAYVQRPLYDDFVAGVASLMGTVRLGDPSDPGTDMGPLVSRRQQQHVAGFIDRARDTGAKIVRGGSVPGGDLASGFYYEPTLVVGADQSSEIVQREIFGPVLVVLPFENDSDGIALANDTDFGLAASAWTRDLYRAQTASRDIAAGCVWINDHIPIISEMPHGGYKASGYGKDMSTYSLDEYTNVKHVMSDITGTARKDWHRTVFGDRR

SEQ ID NO: 39417 - protein, 354 aa, Glycine max
MDSQMTKLGTSLLVPSVHELAKQPMTKVPERYVRLNQDPVVSDTISLPQVPVIDLNKLFSEDGTEVEKLNQACKEWGFFQLINHGVNPLLVQNVKIGVQEFFGLQMEEKRKLWQKQGELEGYGQMFVVSEEQKLEWADIFYINTLPSCARNPHIFASIPQPFRNDLESYSLELGKLSIAIIKLISKALEINTNELLELFEDLSQSMRMNCYPPCPQPEHVIGLNPHSDAGALTILLQVNEMEGLQIRKDGMWIPIKPLSNAFVINVGDILEILTNGIYRSVEHRATINAEKERISIATFHRPQMNRIVGPTPSLVTPERPALFKRIGVADYYRGYFSRELRGKSYIDVIKIKNT

SEQ ID NO: 39418 - protein, 461 aa, Rhodococcus sp. RHA1
MTTVTNSSPTTAHLEAAARRHLWGHFSRHGQNITPPIITRGEGARIWDTAGKSYLDGLSGLFVVQAGHGRTELAEAAAKQAEQLAFFPLWSYATEPAIELAERLAGYAPGDLNRVFFTTGGGEAVESAWKLAKQYFKKVGKPGKHKVISRSIAYHGTPQGALAITGIPALKAPFEPLTPGAFRVPNTNIYRAPEPLGSDPKAFGIWAADRIAEAIEFEGPDTVAAVFLEPVQNAGGCFPPPPGYFERVRQICDEYDVLLVSDEVICAFGRIGSMFACDDFGYVPDIITCAKGLTSGYSPIGAMIASDRLFEPFSDGTSMFAHGYTFGGHPVSAAVALANLDIFEREGLNAHVAEQAPAFRATLDKLTDLPMVGDVRGEGFFYGIELVKDKTTKESFTDDEAERILHGFLSTALFDAGLYCRADDRGDPVIQLAPPLICGQAEFDEIEHILRSVLTEAWTLL

SEQ ID NO: 39419 - protein, 544 aa, Bacteroides fragilis YCH46
MISVDGLAVEFGGTTLFSDISFVINEKDRIALMGKNGAGKSTLLKILAGVRQPTRGRISAPKECVIAYLPQHLMTEDGRTVFEETAQAFAHLHEMEAEIERMNKELETRTDYESDSYMELIENVSTLSEKFYAIDATNYEEDVEKALLGLGFMREDFHRQTSDFSGGWRMRIELAKLLLQKPDVLLLDEPTNHLDIESIQWLEDFLINNGKAVIVISHDRKFVDNITTRTIEVTMGRIYDYKVNYSKYLELRKERREQQQKAYEEQQKFIAETKDFIERFKGTYSKTLQVQSRVKMLEKLEILEVDEEDTSALRLKFPPSPRSGNYPVIMDGVGKSYGDKVVFRNATLTVERGDKVAFVGKNGEGKSTLVKCIMNEIEHDGTLTLGHNVQIGYFAQNQASLLDENLTVFQTIDDVAKGEIRNKIRDLLGAFMFGGPEESMKKVKVLSGGERTRLAMIKLLLEPVNLLILDEPTNHLDLKTKDILKQALKDFDGTLIVVSHDRDFLDGLVTKVYEFGNQKVTEHLCGIYEFLDKKKMDSLRELEK

SEQ ID NO: 39420 - protein, 391 aa, Ostreococcus tauri
  misc_feature (1)..(1): Xaa can be any naturally occurring amino acid
XHGLIALRAVTRGHFAFAAKWPAACRLLVRAIAQFIHLTFILCTIQRPKRMVVQNPPCVPTFLACGVVCWMRGIELVIDWHNLAFTLFGMKYGSETRVAKMCERHERKQGKRWASKHMCVTDAMREFLETEWGMTNVSVVRDRAAEQFRIAARTRADANNPMWFWKQTRVQEELEKSRVARSGDVLDRYVRGHHENLHRNKPRIVVSSTSWTPDENFGILLDAAIAYDARKRTSGGVSSYESPDLVIIITGKGPEREMYEQKINTLALKHVAFRTVWLDIADYPLALASAHLGVCLHTSSSGLDLPMKVLDMFGASLPVAAVRYEVVKELIEDGVNGVLFSDAEELCKLLQKLLSRKNKYILTALRAGAEKAGELTWNDHWNEHAKPLFSD

SEQ ID NO: 39421 - protein, 311 aa, Rhodococcus sp. RHA1
MKAWRFTAVNEKLRHEEVGELVPGPEDIVIDTGAVGLCHSDIGFMNGTITHLLGHVPITLGHEIVGTVSAVGSNVSEFVLGDRVGIPATTDGPGTAMDGGYAEKVRVPSHLPVALPDGLSFLDAASATCSGRTAYRAVHTAGQIESGMKVGIVGFGGLGYFGVQIAKAAGASVFVADVNEARWPLACHLGVESCSKDIRVFESEDLDVIIDFAGADGTLDSAIGAIRHGGRIVEVGLGVEATSVSIPSITMKEVHIVGASNGTKAEASAILALIAKGAVQPKTEQISFGEIPDGLHRLERGAPDGRLIAVL

SEQ ID NO: 39422 - protein, 766 aa, Nicotiana tabacum
MGAPILSDLGTEILIPVCAVVGIAFSLFQWFLVSKVTLSADKSSGAADDKNGYAAESLIEEEEGINDHNVVQKCAEIQNAISEGATSFLFTEYQYVGVFMVAFAILIFLFLGSVEGFSTKNQPCTYDSTKTCKPALATAVFSTVSFLLGAVTSVVSGFLGMKIATYANARTTLEARKGVGKAFIVAFRSGAVMGFLLAANGLLVLYITILLFKLYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGVNHEFTAMLYPLLVSSVGILVCLLTTLFATDFFEVKAVKEIEPALKQQLVISTALMTVGIAVVTWIALPSIFTIFNFGAQKEVKSWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIAPGALVMLTPLIVGILFGVETLSGVLAGSLVSGVQIAISASNTGGAWDNAKKYIEAGVSEHARTLGPKGSDAHKAAVIGDTVGDPLKDTSGPSLNILIKLMAVESLVFAPFFATHGGLLFKLF

SEQ ID NO: 39423 - protein, 302 aa, Burkholderia thailandensis E264
MRPAAHCVQALVERAAHDRRIWVLDGDLADSYGADRFAATHPDRFLMAGIAEQSMVSTAAGMAACGLRPWVFSFAAFLCYRAYDQIRVGLAQAGMPVTLVGSHSGGCGGPNGKSHLALNDIAVMASLPNVDVWAPASDRDTRFVVDAVMTADRPAYIRYPREPWGELPGEPAECRWIGGRRRFALVSCGLFSHVANDAAGMLRARGIDAGAVHVARLAPFPADAFAALVDGVDGIWVVDDHTRFGGLADLLRANGHAVREPAFSWPANWSGDVGPAAELLRRHGLSAADVAGRIAAELARGR

SEQ ID NO: 39424 - protein, 248 aa, Bacillus cereus E33L
MITIKTKNEIDLMHESGKLLASCHREIAKIMKPGITTKEINTFVEAYLEKHGATSEQKGYNGYPYAICASVNDEMCHAFPADVSLNEGDIVTIDMVVNLNGGLSDSAWTYRIGKVSDEAEKLLLVAENALYKGIDQAVIGNRVGDIGYAIESYVANEGFSVVRDFTGHGIGKEIHEEPVIFHFGKQGQGPELQEGMVITIEPIVNVGMRYSKVDLNGWTARTMDGKLSAQYEHTIAITKDGPIILTKL

SEQ ID NO: 39425 - protein, 562 aa, Shewanella sp. ANA-3
MDDNKRPLYLPFAGPAILEAPLINKGSAFSEEERIFFNLEGLVPYAIETIEEQASRAYDQFRSFNNDLDKHIYLRNIQDTNETLFYRLVQNHISEMMPIIYTPTVGLACERFSKNYRRNRGLFISYPNKDRIDDILNNSTRQKVKIIVVTDGERILGLGDQGIGGMGIPIGKLSLYTSCGGISPAYTLPITLDVGTDNPQLLEDPMYMGWRHPRIGGEEYAEFIEAFMQAVHVRWPDTLIQFEDFAQKNAMPILERYKDRYCCFNDDIQGTAAVTVGSLLAACKAAGTELNKQRIAFLGAGSAGCGIAEAIVAQMVSEGISDEQARSQVCMVDRWGLLLDNMPNLLPFQQKLAQKCADICNWNNFSDNISLLDVVNNAKPTVLIGVSGAPGLFTEEIVRAMHSHCERPIIFPLSNPTSRVEATPKDILHWTSGQALVATGSPFEPVVVDGETYEIAQCNNSFIFPGIGLGVLASGARHVSDAMLMASSRALAECSPLAINGSGPLLPKLEDIHSVSKHIAFAVGKVAIEQGLSLPASDELLMQSIEDNFWKPEYRRYKRTSF

SEQ ID NO: 39426 - protein, 323 aa, Yarrowia lipolytica CLIB122
MTRSKFTEYKQVLRNSCVGKPQYTEKDYPDLDGKNFLVTGATGGVGLEATKLLLEKKSHVIMVGRSKTKSQSTLDELQKTYSHGTFDFVEADLSDLTTVERAGEYIRSKYTTLDGAILNAGVMAPPYSLTPQGHESQWGINVVAHFLLSKYISPALISAAQTAPKDTVRLVWVSSSVVAMSPYEGGIKFDDINHSKVKNPSPWTLYSQSKIGDAYLAYLWSKHHPDSGVLSVSLDPGNLASDLSRHTSWLSSIKNYVLYPPKYGAYTELSALLNPSVKNNEHLIPWGIEGHLRQDVDDGRRGKDGEELWQGLNKDVEGFFKEE

SEQ ID NO: 39427 - protein, 275 aa, marine gamma proteobacterium HTCC2080
MGEVKDYKAAFQLHGKVALVTGAGGNLGAEICRALVSAGAAVLATDVNDEGAKAVSDALNAAGGHSAWMKHDVTNELEWESAVAVAVSTFGGIDIMVNNAGIVPMNFLADLDIDEFRRVQDVNVAGPTLGCKHALRAMRPDGVSGRGGSIINMSSVMGLSGTIALASYNASKGAVRLLSKSVAAECALLKTNIRCNSIHPGIIDSDMGSLFHEQLVALGVAPSMEASEAGFLAAVPMGEAGQPSDIAAGVVYLASDASRYVTGSELVIDGGFYAT

SEQ ID NO: 39428 - protein, 210 aa, Oryza sativa Indica Group
MARFGAVIHRVFLPLLLLLVVLGACHVTPAAAAAGARLSALAKALVVEASPRAGQVLHAGEDAITVTWSLNATAAAAAAGADAGYKAVKVTLCYAPASQVGRGWRKAHDDLSKDKACQFKIAQQPYDGAGKFEYTVARDVPTASYYVRAYALDASGARVAYGETAPSASFAVAGITGVTASIEVAAGVLSAFSVAALAVFLALENKKKNK

SEQ ID NO: 39429 - protein, 399 aa, Marinobacter sp. ELB17
MSDNRGVVYIGPGKVEVQSIPFPKLENPQGRRIGHGVLLKVITTNICGSDQHMVRGRTSALAGLVLGHEITGEVIETGSDVENFKVGDLASVPFNVACGRCRTCKEQDTGVCLTVNPSRAGGAYGYVDMGGWVGGQADYVMVPYADFNLLKLPHRDLAMEKIRDLTCLSDILPTGYHGAVTAGVGPGSTVYIAGAGPVGLAAAASSRLLGAAVVIVGDVNPTRLTHAKSQGFEVVDLSQDASLGDQIAELLGIPEVDCAVDAVGFEARGHGHEGVREEAPAIVLNSLMEITRAAGKLGIPGLYVTEDPGSADTAAQKGNLSLRFGLGWAKSHSFHTGQTPVMKYNRQLMQAIMWDRIKIADVVGVEVISLNDAPLGYGEFDAGVPKKFVIDPHNSLKLA

SEQ ID NO: 39430 - protein, 305 aa, Thermoplasma acidophilum
MSKRDILSVLDMEKDLSEIIDLSIELKKNRYRSYESLRNKVLGLIFEKPSTRTRTSLEVAIDQLGGHAVYLNPSEMQLGRGETISDTGHVLSRFLDAIAYRAYDHRNVVELARSTSIPVINALDDVEHPLQIVADFMTIKEKKGRFTNLKFSYIGDGNNMANSLMLGAAILGTDMYVASPKGFEPKQEFVEKARSIAKQHGSSITITNDPVEAARDADVIYTDVWISMGEESKKGEKEKAFKDFQINEKLVSNAKRDYIFMHCLPAHRGLEVTDGVADSINSVIFDEAENRLHSEKGVLYKLLSY

SEQ ID NO: 39431 - protein, 2135 aa, Chlamydomonas reinhardtii
MNPLYLLRIANEGAGALGQHHEAIVRRLQRVCSLLNAILQSDRSRYLEARNWLLNTIASQTPPAHVRLACWEPLIVEALAAPNDQTEGGQPEAGGGARGSASDRSRGRDVRQENTETAAEAGATTAGLRGVSSDWAPGGGAGVQSREAPGPLELLTQLLMLVSEVWPDRVASVLLDQPQVFVDFFTGPSAARRILLWFSHFSMDGMRAFKFGARALAHYTLEHREEVWDLLRWEGKHAQAPVAVAQKTHYFCELAVVPSVMALLGGRGRDGRGGGGREGGVSSTAAGFLSSSQWRECCADGAFLELDRRHFCRLLLSQLRGGGARAARLTALLRNFLAAQSSQSPWQLLCQRLLHQLTERQLLDLINTLAEGQALEPPPAAAAAAVAAMPPWAVASSKDGGNAAKAGAAAGGGMVAAYVVPACVSVCGGGGWQDLGALVLAGGAQWGRLGEVVLAHALAAARGPLQRLLAEEAEEPGVAVKLAELARLAAELHGAAVLAAQPCSGAGAGAHGKAEGCSAEEQAALLHGQPQQRHGRQPLLLPLRGRRSGPQRLLLLAELWTLREALRGAATPPASPKSSAHSSASDWPAAAQVLERVVAQVGGVSCQRLDLLAAQEVPVAAAAAAGGGGQGTAVASGKVGTVKLQAPAAGTGADAGAKGTGLGATGVGAGSYELLASDDELGERSRRRQRKKNKGSAYYGSAAVAAAPPPVPSNAADGSRQEPEARQPPAVAAAQEDHPGRRAVRERSGSSAPDPGPQQQQQQAPQPDLVPLGSNRGGGKDRTKREERSRRESHSRSRSRSRSRSRSGSRDSKRQRRRRSSARSTTLYVKASDSDAASGEDSEDAELRQLDPLTALQGGRFHVAVAAARATPGAVGALAQTGRATFVLPGPEVPGGRAGAGHRQENGVWRVRLGFAPGGGAGMQGGANGAAAAAAGAGVEVVGGCDDVADLLAAVACKHWATALLATDPPAQGSGHSHQKLPFIPSDPTPGFTPTQWTQQQFVSYAKGPLLAATSVNLAFLCVVLALIALFLLCRCCGNHRLARRKSLLTYEVMHDAWMRGYKVMYVFFAVGSIALAAAGMAMLPRATDRVSDLAVRLDAAGDYVGDLLTASDSLISGGAGLRPLMSGAAVLLTNGLPTTNLAADMTCTGGVLDTALAAPSQPSDLRAALLAADTALRTAVGPALAAATALLDATAGSSTATSGLIAATPALAAVAAAPALVSNISSGLAGYDSALGALPATRSPTTSSDPRVSDLQAAQAALVLSAWIDNIDYLYDSVRVAAAAARQVPYTRLAAALSALRAAANATSASPLTPVMAGLGRLDVAYLGTAPQQAAGVVTAGRACLARLRTQLAAFDDAIFSFNSGTLERAAMDAVPAIQAALESVYGNSNASAVVAGGNATAGSPAAVVAPSLAWPQAALSALSPFVGMDDIAIAAACGNVQAVLSNVTNGGANGTSRLPDEMPTLSYLTSLRAALVALQTPAGNVSTALSTYVGARTDANYDSLRTTANSTRTGAVASARSAAGAPAPSGYSSIVTSAANATNIIASSSLQATLATLDANATSAIAWLTASTSTAPATSGIVHLNVTTAALARLQSIFTANSARLAAVNWTSTTSSSASANATSGYLPSVFLQPLGRSLALIGSVISNGLSAIGEQLDNALGKALLSPPPPSTPGAFPSPSSSNASSTGYHRRAMLASSSTGTATTSALNATAQVRQQLVNRLQNITDKLTGADSKQYTNGAYWGPIAIYAAVIATCLLLGLAVFLNWPGGLVVLFMIHLFVSGVVLAAAWGGAASLVVAHDTCGSADAIVLSEVSPNSALFPLVRYYLQGVGGSLPAVLRASGLGDTSRLSAAAALLQTQVLDPLLLPADPSAAANATNTSSSATTQWPGSLGSVQYGLGGLLADLSMAAADMSAHLSDLLTLGERAAVLNVYYGVTSWACCGLASDVMIQWVTATGSGVLAWAAALVALLILKNLDDMPGGGGVCGCTCYRMKDFPRPVKGRRAGASSGGGATATAAPAAVAYGADVERGKGAPYMAPAPMMTTPQTKGKEVTVENGLFHGPPPPSEPPMTIVLGDGTAATGGHRPSINVCVMDPETAAAFGLNATSDGGASSAPSAPSAPLLPPPNGSGR

SEQ ID NO: 39432 - protein, 178 aa, Myxococcus xanthus DK 1622
MIGSLVTDALELAKAANGNSDAKSIAKVVLTSDSYRITALNRAREAALAYRIPLVNHVLRVAQTAVMGIEIGKDVTLGKGVYFVHSLGVVIGGDARIGDRVRFYGNNTVGTAKDNGYPVIEDDVWIGAGARILGPVRIGARSRIGANAVVLQDVPPDSVAVGIPARIFPRKDTDEVAL

SEQ ID NO: 39433 - protein, 412 aa, Bdellovibrio bacteriovorus HD100
MLVFYATGMILGAGVYSVIGKAAGVAQEGLWLSFILAALAAVLTALSYAELATLFPKAGAEYVYMKEIFPQRKILSFLCGCLMIFAAIITASTVSLSFAAYTQDFFKAPEMLVAIVLLGFFTLVNIWGVRESGWVNIVFTLVELSGLVIFIFVGLRQPDFGKVLSVPVSWGVVTGASLIFFAYLGFESMVNLAEEAKKPDKNIPRAILLSLSLTTVVYVAVSLAALAMMSPGDLQKSDAVLSAALQKHSPEAARALAGIALFATANTVMIALLGASRISLGMARGRDLPKVFSKILPQRQSPWLSSLLVFLLALLFLPLKKIEVLASVSSFVTIVVFIIINGAVVYLRRKEPQRKRPFRVPGAVAGWPVLPILAAGMALFFLFNFEEQVYYVGVGIVIFVLVVYQALHFRRA

SEQ ID NO: 39434 - protein, 1060 aa, Rhodococcus sp. RHA1
MTSILIANRGEVALRIIRTATARGIKTIAVYSEDEHDAPHVAAADHARPLRETGPAAYLDVAAIRDAALASGASTVHPGYGFLSESAELAEACAEAGLTFVGPDAHTLRTLGDKSATRALATGCGVPVLAATAGPTSKTDARQFAQSLPAGAVIVKATAGGGGRGMRIVEDLTELDRAIDRCRSEAERSFGLSDVYVEAYLPRARHIEVQVVGDGVSTPMHLFDRDCTAQRRHQKVVEIAPAQNLPDSTRKELHSAALTLASSVGLRGLATFEFLVESDHLDRWYFIEANPRLQVEHGITEAITGLDLVGLQLDVAQGRTLEDVQLSPATLGEPNGVAIEARVTGSPRPDGSDVLTDVRFPSGSSIRVDSHAHVGMRVGIGYDPLLAKVIVHRDDGHFGSAAAELIHALSDLTLDDMDTDVTTSAWLLGSHEFRSGTVTTRTIDDHLATLSIPDSPAEPVTQLDLRAPSPGTVVATAAVPGQVVRNGDALITLEAMKMETDVSATTAGRVADVWIAVGDTVTAGQLLVTLRLDVSQDDASTDPIGVNVTAERTDLAEIEARQRRTLDESRPAAIERRHERGKRTARENVDHLVDEGSFHEHGSLVVAAQRRRRSLDELESETPADGLVAGFGRVAGRPVAVLAYDYTVLAGTQGLQSHKKAERMFELAGRRGTPVVLFAEGGGGRPGDTDDMSRATRMDLGTFVALGRLNGSVPTVGIASGRCFAGNAALLGSCDVIVATRDSSIGLGGPAMIEGGGLGVFAADDIGPVSVQEANGVIDIVVADESEAVDVARRYLGYFAGPKIEWTAADQRILRHIVPERRNRPFDIRTLIDTIADEGSVLELRRGFAVGLITALVRIEGHPIGLVANDGSRAGGTIGSAEADKMTRFLQLCEAYGLAVLSLCDTAGFLVGPDAERTASVRHVSRLFVTAPALTVPFCTVIVRKAFGLGGQAMAGGSFRVPDTIVAWPSAELGAMGPEGAVSLGYRRELAAIEDAEERERIYQQHLEDYVAQGKAVNAASVFEIDDVIDPASTRSRIVDVLAAPRPDRPTQVRRRIDAW

SEQ ID NO: 39435 - protein, 918 aa, Arabidopsis thaliana
MAPKKDKVPPPSSKPAKSGGGKQKKKKWSKGKQKEKVNNMVLFDQGTYDKLLTEAPKFKLITPSILSDRMRINGSLARRAIRELMAKAKKMDSSYSFALGTSSSILPKLSFRNVENRFYGEKNNNNGLCKRFGSDLGSKKFRNQKFKHGVVYAVATSDNPKKAMTVKTSMFERRKVDPQNVAAIILGGGNGAKLFPLTMRAATPAVPVGGCYRLIDIPMSNCINSCINKIFVLTQFNSASLNRHLARTYFGNGINFGGGFVEVLAATQTPGEAGKKWFQGTADAVRKFLWVFEDAKNRNIENILILSGDHLYRMNYMDFVQSHVDSNADITLSCAPVSESRASNFGLVKIDRGGRVIHFSEKPTGVDLKSMQTDTTMLGLSHQEATDSPYIASMGVYCFKTEALLNLLTRQYPSSNDFGSEVIPAAIRDHDVQGYIFRDYWEDIGTIKTFYEANLALVEERPKFEFYDPETPFYTSPRFLPPTKAEKCRMVDSIISHGCFLRECSVQRSIIGERSRLDYGVELQDTLMLGADYYQTESEIASLLAEGKVPIGIGKDTKIRKCIIDKNAKIGKNVIIMNKGDVQEADRPEEGFYIRSGITVIVEKATIQDVHLQLEELKFRDIDLENNKKHSQPKPDLLLFRCVVERSLFEEANSFFFFTIHSLLALLLVVLMLLSMNLGITCELFSSDCSDSRSNFRDLLKSISPMRNSLFLGFLDSLVSRITMEGSGGDSGSMATPVQKKVHEAWRVYQYYLDKTTPHSTNRWIGTLVFFLIYCLRVYSIHGFYIISYGLGIYLLNLLIGFLSPLVDPELEVSDGATLPTRGSDEFKPFIRRLPEFKFWYSMTKAFCIAFLMTFFSVFDVPVFWPILLCYWVVLFVLTMRRQIAHMIKHKYIPFSIGKQKYSGRKSSANSGGGSRAD

SEQ ID NO: 39436 - protein, 186 aa, Bdellovibrio bacteriovorus HD100
MAVTEFQKNLPTRITLSRVFFVPVIVALMWPNTLGWNVAAACFFILASITDYYDGYYARKYNAVSNFGKFMDPIADKILVTSVLAMLLAQGKIDAWMVIIILARDNFIGGIRSVAAADQIIIAAKPAGKWKTAMQMVAIPIVIIGNLEPHIPYLDKIGYGVLWVSVILSITSGVEYYLGYLKSRKD

SEQ ID NO: 39437 - protein, 580 aa, Salmonella enterica subsp. enterica serovar Paratyphi B str.
MKPTFMRWVAIAALLAGGTFSAVANPPVAPPVSYGVEEDVFHPVRATQGMVASVDAMATQVGVDILKQGGNAVDAAVAVGYALAVTHPQAGNLGGGGFMLLRTKDGATTAIDFREMAPAGATRDMFLDDQGNADAKKSLTSHLASGTPGTVAGFSLALEKYGTMPLNKVVRPAMKLAEEGFVVNDALADDLKTYGSEVIPNHENSKVIFWKDGEPLKKGDKLVQKNLAKSLEMIAENGPDAFYKGAIADQIAGEMQKNGGLMTKEDLANYKAVERTPISGDYRGYQVFSMPPPSSGGIHIVQILNILENFDMKKYGFGSADAMQIMAEAEKYAYADRSEYLGDPDFVKVPWQALTHKAYAKTLADQIDINKAKPSSQIKPGKLAPYESNQTTHFSVVDKDGNAVAVTYTLNTTFGTGIVAGNTGILLNNQMDDFSAKPGVPNVYGLVGGDANAAEPKKRPLSSMSPTIVVKEGKTWLVTGSPGGSRIITTVLQMVVNSIDFGMNVAEATNAPRFHHQWLPDELRVEKGFSPDTLKLLEQKGQKVALKEAMGSTQSIMVGPDGELYGASDPRSVDDLTAGY

SEQ ID NO: 39438 - protein, 324 aa, Burkholderia thailandensis E264
MPKAIRYDRPGGPEVMKWVDVDVGAPQPGEVRIKQHAVGLNYIDVYFRTGLYPQPLPGGLGMEAAGEVTEIGDGVTTLKPGDRVAYVAQPPGAYAQERVLAAAKLVKLPDAIGYEDAASVMLQGLTAQYLLRRTYAVKPGDTILIHAAAGGVGLLVCQWAKALGATVIGTVGSDEKAALAKAHGCDHPIVYTRENFTERVKEITNGAGVPVVYDSIGKDTYIGSLDCLAPLGLFVSFGNASGPLPPIDSKEFSSRGSLFFTRPTLFSYIAKREDLDRNAAELFDVLASGRVKTSIQQRHPLENVAQAHRDLEARRTTGSTILLP

SEQ ID NO: 39439 - protein, 258 aa, Rhodococcus sp. RHA1
MQLDGKKIIVTGGSMGIGESVVRAYTSEGADVASLDLADELGVAVAQEASRCGPGKATFHSCDVRDRDQVEKVFETAADQLGGLDVVVNVAGVHKHCDPAGISAEIYRFIFDVNVLGTINTNGAAHRLMKSNRVGNIINFGSESGLTGEINNALYAASKGAVHTWSRNVARQWGPDGIRVNYVLPYMWTKMYDEFRAALSPEELKAHDDQTAADIPLGGAFGRADRDLAPVMVFLASDASHFITGQMFPVDGGLISGR

SEQ ID NO: 39440 - protein, 266 aa, Triticum aestivum
  misc_feature (240)..(240): Xaa can be any naturally occurring amino acid
  misc_feature (250)..(250): Xaa can be any naturally occurring amino acid
LLEQVCTKKQARTGPEFPGYRRPTRPVILGDGIYNLIKIIYATIKEIMNARSKQGRLPFVRAQDDDESSELSSKEKLLNDVFVKDSIPPWLAGSGYVGLAAISTATVPMMFPQLKWYLVLSAYVVAPLLAFCNSYGTGLTDWNLASTYGKIGLFIFASWVGQHGGVIAGLAACGVMMSIVSTAADLMQDFKTGYLTLSSPRSMFVSQLIGTALGCVIAPLTFWLYWTAFDIGNPDGMFKXSYAVIFREMXILGVEGISGLPQHWLA

SEQ ID NO: 39441 - protein, 195 aa, Brassica napus
LPEMQARAIFEAAASMQKQGVTVLPELMVPLVGTPQELGHQVNVIREVAKKVFAETGHTVSYKVGTMIEIPRAALIADEIAEEAEFFSFGTNDLTQMTFGYSRDDVAKFLPIYLAKGILQNDPFEVLDQRGVGQLVKMATEKGRAARPNLKVGVCGEHGGEPSSVAFFAEVGLDYVSCSPFRVPIARLAAAQVVA

SEQ ID NO: 39442 - protein, 535 aa, Oryza sativa Japonica Group
MARALRWPDLVGLGLGGMVGAGVFVTTGRATRLYAGPAVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLVAVGVILLITVCICYSTKESSSVNMVLTAVHVLFIMFVIVMGFWRGDTRNLTRPADPEHNPGGFFPHGAAGVFNGAAMVYLSYIGYDAVSTMAEEVERPSRDIPIGVSGSVVLVTLLYCLMAASMSMLLPYDAIDTEAPFSGAFKGSSGWGWVSNVIGAGASLGILTSLMVAMLGQARYLCVIGRSGVMPAWLARVNPRTATPVNASAFLGVFTAALALFTELDILLNLVCIGTLFVFYMVANAVVYRRYVAAAEDDEEGRRRGAVPTLAFLLAFSLVALCFTLVWKLAPRGGARTGLLVACGAAAAAAVAAFRALVPQARRPELWGVPAMPWVPAASVFLNVFLLGSLDRPSYVRFGFFTAAAALVYVLYSVHASYDADEAAAALDGAKVLDEGCKV

SEQ ID NO: 39443 - protein, 901 aa, Bdellovibrio bacteriovorus HD100
MSMGLFCTCRTHLYGAILFFISFWLMGCTLSASLTSEGVFSSPQDIQIVEQAGTQSFSKLDSFKKFKLISQKPIEASTLDASDLIQSGTAKGLVIVVEPSDSPLEYDVFVSVSSQEGTVVLELQEGAVDFQDGTQNTATQSEVSVSTFASKQSRLALGEEYLCYVDKDKKIRCQGSYYGGQTGIGDSSYGEMYTGQLVNTSLITGSGNFVKASGASYSSCALSQEGLLYCWGDNYADELGVGTGTIEVLQPTPALMTNVTGEAKFVDFAMGYESVCAISAAGDLYCSGAVSPAFLGLLTKVDLAGLGASLGKVVQVAVGEGFVCGLSEYGKVFCWGKNDLGQLGNGTLVDSALPVSPDYSGLSGVPKFIHLASGGSHVCAVAVEGQMYCWGANAHGQLGDGTKTDRSTPVLVANGALPVNEKFQAVTASHEGSCGTSAQGQIYCFGQNWHFLSGNGSSAEILTPTLVDNSNLPGGVNFREVFMHEGRTCASSSENKLYCWGSPYNEASFRDHEAFAPVEISTEVLPSGQYWADVSSAELELGLVLRSSDGTAYVWGRGRPGTTDTDFVPKPLDTSTMSGSTKFKKLAMGNWAICGISNDDILHCMGNGTSVGQGGTATSQATLDPVDTTGMTGATTFADVDMGKYTACGVATDGVGYCWGGAGFSPSLYNSILGNGSSTIRYRPHPVNVTAIPGSKLFTKIVAGEYHACGLMTDQKVYCWGNSVYSRSGHSSAFSVYTPQALDTSGMTGSTLFADIHGDDESFCGISTDGITYCWGDSSGGQLGNNSLVTSNTPVPVSVAGLASAPAPLMVKSFARFSCGILDSAINIYCWGESVPAGLSPATSAVPVLINKGSMAGTPVSITGGKNLYVKTSANKIYCIGRDCNQGVERIIPTRQYFENY

SEQ ID NO: 39444 - protein, 189 aa, marine gamma proteobacterium HTCC2080
MPLNLPNILTLLRIAAIPILVLFAHLGSPWGNWGAAALFGAAALTDLLDGWLARRSGQTTVFGAFLDPVADKLIVATALVLLTARFDDVLITLCACVVIGREVVVSALREWMARLGKEASVAVNQIAKVKTTLQMIAISFLLLLLPEYTNTGWFILGKTVLIVAVLLTLWSMVVYLRSFFSVIRESEGL

SEQ ID NO: 39445 - protein, 508 aa, Bradyrhizobium sp. BTAi1
MNMEIDATVSQRCTLVIFGITGDLTRRLLMPALYNLARWKRLPKDFRIIGVGRSEIPVDTLLDDLTRSLQEFVSEQAGEASVDSVDWKVWDEVVRRLAYVSGHIEDAGTYAKLLQLVKGSQAGPGAGNVLFYLAVAAQFFGPVVEHLGEAGFAREEAGDWRRIIIEKPFGRDLQSARALNRDLLAVFREDQIFRIDHFLGKETVQNIMAFRFGNGLFEPIWNRDRIDHVQITVAETVGVERRGIFYDAIGALRDMVPNHLFQLFTMLAMEPPISFEADAVRDKKQDVLMAARPLSEEAVLQEAVRAQYTEGTVRGRAVRNYREEPNIAAASRTETYVALRLMIDNWRWAGVPFYLRTGKALTQRNTEIAIQFKQAPLALFRNTAVADCIPNWLVLQIQPNEGISLQFGAKVPGPDVRLDAVNMGFLYKDYFRTPPSTGYETLIYDAMIGDATLFQRADNIEAGWRIVQPVLDTWSGGHGSIWTYPAGSAGPKEADDLLAREGRAWRPL

SEQ ID NO: 39446 - protein, 384 aa, Magnaporthe grisea 70-15
MSAQPIPVWLDCDPGHDDAFAILLAAHHPMINLLGISTVFGNASLEKTTYNATSLLAAIGKHDQVTVYPGAAKARSRPPVHSPTDIHGESGIDGTDLLPKPLRAPDRSISAVDAMAKAVLAQPAGTPWIVATGCLTNVAEAVEKYPQLAEHVAGLSFMGGAVGGGFTTAVSGQVDGLERIGNRTPWAEFNIFIDPESADFILSNEVLAQKSTMIPLDVTHLVLATKEVQQRLLHGDGGPVEAGAKGRTTLRVMLVELLNFFAETYRTAFGITEGPPLHDPVAAAIVLQTLPEEYRIPFYDFDIARDGGKRHERFSVKVVTEGTYEDAYAGAQTGRTIATLLPEGAQGVAIPRGLDIPKFWTVIEECIQRADNLNAKSSAGGPGA

SEQ ID NO: 39447 - protein, 328 aa, Campylobacter upsaliensis RM3195
MKILITGGAGYIGSHTLRQFLNTKHEICVLDNLSKGSKIALEDLKSIREFDFFEQDLNDFKGVKDLFKREKFDAVVHFAASIEVFESMQDPLKYYMNNTANTSNLIQTCLENNVNKFIFSSTAATYGEPKSPVVSETSPLEPINPYGRSKLMSEEVLRDASRAKPEFKHCILRYFNVAGACMDFKLGQRYPKATLLIKVAAEVAAGKREKLYIFGDDYETKDGTCIRDFIHVDDISSAHLAALEYLDNNESNVFNVGYGHGFSVKEVIEAMKEVSGVDFKVELAPRRAGDPSVLISNAEKIRKLTSWKPKYDDLKLICKSSYEWEKQC

SEQ ID NO: 39448 - protein, 156 aa, Zea mays
  misc_feature (64)..(64): Xaa can be any naturally occurring amino acid
  misc_feature (83)..(83): Xaa can be any naturally occurring amino acid
  misc_feature (107)..(107): Xaa can be any naturally occurring amino acid
  misc_feature (110)..(110): Xaa can be any naturally occurring amino acid
  misc_feature (120)..(120): Xaa can be any naturally occurring amino acid
  misc_feature (127)..(127): Xaa can be any naturally occurring amino acid
  misc_feature (135)..(135): Xaa can be any naturally occurring amino acid
MSHGGGGGRAKVTPNLAVDGEGTRTLNLTVLQRLDHAVEDILITAAHVTLYDFDTDINQWSRKXDVEGSLFVVKRNGSPQIQXIVMNRRNTDNLGEDLLGDFDNHYXLLXIMYRHAAQEXIRIWFYXSQEWQQVXNLFSRILMLSQRCTKAKFSVK

SEQ ID NO: 39449 - protein, 728 aa, Oryza sativa Indica Group
MARLERGSLVVGGRELLERAPPSVALRRPAVVASPGGAAFLGATAPAPSSRHVFSLGTLASGWKWLSLFRFKIWWMIPTVGEDAAGVPAETQMLLLESRSEAGAALYALMLPVLDGGFRASLQGSPENELQFCFESGRFILDLLDSEVFELKRTANFGISVGISEEYSGGLFLGDPEVQTLEAVDAVFINSGDNPFKLMRNQSSNIPANLDWFGWCTWDAFYKSVNPVGIEEGLKRFAERLIDLTENDKFRGETCKNIGDHVKKIKEHYGVKYVYIWHALHGYWGGVLTTPDAMKKYNPQLVYPVQSPGNVANLRDIAMDSLEKFGVGIIDPAMIYDFYNDQHSYLSSVGVDGVKVDVQNVMETLGKGFGGRVALTQKYQQALEESIARNFKGNNLICCMSHNTDSIFSSLKSAVARASEDFMPREPTMQTLHIATVAFNSLLLGEIFIPDWDMFHSKHESAEFHGAARALSGGGVYVSDKPGMHDFSVLKKLVLPDGLILRAKHAGRPTRDCLFNDPVMDGKSLLKIWNLNKFSGVIGVFNCQGAGNWTYPVKENAHVPTTVCITGDLSPSDVELLEEIAGDDWNGETAVFAFNSSTPSGSLSRLQKHQIMEVSLSTMTCEIYTIALIKVFGGFVQFAPLGLVNMYNSGGALENVTSTGDCSEITIQIQCRGPGRFGAYSATRPEICSVDEHEVEFKHTDDGFLAFDLSHGSSQDNLRNIEILYRAS

SEQ ID NO: 39450 - protein, 382 aa, Escherichia coli
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPEAKKEDELPFHVVAYDFGAKRNILRMLVDRGCRLTIVPAQTSAEDVLKMNPDGIFLSNGPGDPAPDDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIELIEQYRKTAK

SEQ ID NO: 39451 - protein, 193 aa, Enterococcus faecalis V583
MNVHNAEIVISAVSPKQYPESQLPEIALAGRSNVGKSSFINTLINRKNLARTSGKPGKTQTLNFYLIEDALHFVDVPGYGYAKVSKTERAKWGKMIETYITQREQLRAVVSLIDLRHPPTQDDIQMYEFLKYYDLPVIIVATKADKIPRGKWNKHESVIKKALNFDKQDDFIIFSSETKEGKEAAWTAIEKFL

SEQ ID NO: 39452 - protein, 460 aa, Mycobacterium tuberculosis H37Rv
MSRSHPSVPAHSIAPAYTGRMFTAPVPALRMPDESMDPEAAYRFIHDELMLDGSSRLNLATFVTTWMDPEAEKLMAETFDKNMIDKDEYPATAAIEARCVSMVADLFHAEGLRDHDPTSATGVSTIGSSEAVMLGGLALKWRWRQRVGSWKGRMPNLVMGSNVQVVWEKFCRYFDVEPRYLPMERGRYVITPEQVLAAVDENTIGVVAILGTTYTGELEPIAEICAALDKLAAGGGVDVPVHVDAASGGFVVPFLHPDLVWDFRLPRVVSINVSGHKYGLTYPGVGFVVWRGPEHLPEDLVFRVNYLGGDMPTFTLNFSRPGNQVVGQYYNFLRLGRDGYTKVMQALSHTARWLGDQLREVDHCEVISDGSAIPVVSFRLAGDRGYTEFDVSHELRTFGWQVPAYTMPDNATDVAVLRIVVREGLSADLARALHDDAVTALAALDKVKPGGHFDAQHFAH

SEQ ID NO: 39453 - protein, 334 aa, Avibacterium paragallinarum
MLFNLKNRHLLSLVHHTPQEIQFLLQLAKELKQAKYTGTEQPRLKGKNIALIFEKTSTRTRCSFEVAAYDQGANVTYIDPNSSQIGHKESMKDTARVLGRMYDAIEYRGFKQAVVNELAEYAGVPVFNGLTDEFHPTQMLADVLTMMEHSDKPLSDIIYVYIGDARNNMGNSLLLIGAKLGMDVRICAPKALQPEAELVAMCQEFAQQTGARITITEDVELAVKGVDFVHTDVWVSMGEPLESWGERINLLLPYQVTPALMQRSGNPKVKFMHCLPAFHNCETEVGKKIAEKYPHLANGIEVTEEVFESPMNIAFDQAENRMHTIKAVMVASLA

SEQ ID NO: 39454 - protein, 306 aa, Enterococcus faecalis V583
MDTKKRPIIIDTDPGIDDAVALAIALNHPNLEVRLITTVAGNVDVEKTTNNALKLVDFFGKKVPVAKGCNCPLLIQLEDSAEIHGETGMDGFEFPQPISTCLDIHAVEAMRKEILSSDVPLTIVPIAALTNIALLLTLYPEVKENIAEIVMMGGSLARGNTNTSAEFNTYVDPHAAQIVFQSGVPLTMVGLDVTSQAVLTNHEVTAIRALGRVGEMFYGLFRHYRGGSLTTGLKMHDVCAIAYLTSPELFETTETFIEVALEGPAAGATVADLKMKYHKNTNAVACIDVNVEAFQKWVVEKMKAVN

SEQ ID NO: 39455 - protein, 2260 aa, Streptomyces halstedii
MENEKKLLDYLKRATTDLREARRRLREMEEKDQEPIAIVGIGCRFPRGVESAEQLWDLVADGGEALTPFPEDRGWDTDSLYHPDPEHLGTSYTNVGAFLHDAAEFDPGFFGISPREALAMDPQQRLLLETSWEAMERAGIDPAGLRGSRTGVFTGLMYFDYGSRVHSAPEDIEGYLGNGSAGSIASGRVAYTFGFEGPAVTLDTACSSSLVAIHLAAQSLRKGECTLALAGGASVMSTPDIFVDFSRQRGLSADGRCKAFSSDADGTGWGEGVGVLLLERLSDARKNGHRILGLVRGSAVNQDGASSGLTAPNGPSQQRVIRQALANAGLSAAEVDAVEAHGTGTKLGDPIEAQALLATYGQEREEGRPLWLGSIKSNVGHTQAAAGVAGVIKMVLAMRAGVLPKTLHVSEPSPHVDWSAGAVELLTETRDWPETGRPRRAGVSSFGISGTNAHVIVEQAPMDEAMDEVAGERETPAAGSDRTVPWVISAKSADALRAQAGRLSTFLAGTEGTLTTGISSETSVAAVSADASAVGWSLVRGRSVFAHRAVVVGGEWDALLASIGELADGAEDGSGAASGSVVSGVADVSGRRVFVFPGQGSQWVGMAQGLLDSSVMFTERMTECAAALDPLVEWSLLDVVRGVEGAASLERVDVVQPVLWAVMVSLASVWRSVGVVPDAVVGHSQGEIAAAVVGGWLSLVDGARVVALRSLAIREVLAGGGGMVAVQAAEDEVAGWLEGVEGVGIAAVNGPRSVVISGTRAGLDACVELWSGRGTWVKRVPVDYASHSAEVERVRERVLADLASVTGLSGSVPMLSTMTGDWIVEGQVGAGYWVENLRRPVLFADATRRLASEGFGAFVEVSAHPVLVMGIEETIEALRSGAADGAKSGAGEESSSAVVAVGTLRRGEGGWDQFLRSLAGLFVRGAVTPDWESLLGGVRPRVDLPTYAFQRERLWLDAGVVAGDVSGLGQVVVGHPLLGAGVGVAGEGGGVLFTGRLGLGSHPWLGDHAVSGVVLLPGAAFVELVVRAGDEVGCGRLEELTLAAPLVVPERGSVRIQVVVGAGDGSGARSVGVWSSVGDEGVGGEWVCHASGLLTADVGVAPVLGGVWPPVGGVAVDVSGVYEGLALEGYEYGSVFRGLRSVWRRGDEVFAEVALGEGVGVEGFGLHPALLDAALQAAGFGSFVPESEAGSEAGSGGVRLPFSWSGVSLFASGASVGRVRLWPVGGDGFGVELFDGVGMPVARVDALVTREISAGQLGAAAGAGSLVGGESLFRVEWAPVSGVAPASAGVGGCVVVGAGSVLSGFGEVVPDLAAVSAGSAAVPGWVLVDVDAWLGADLAVGVVSGEGVPVVARGVVARVLGLVREWLGDERWVSSRLVWVTRGAVGARVLDEVSGVVSSGLWGLVRAAQSEHPDRFALLDLDSATAVDAVRDGVLGLLAAGEPQLVVREGEVLAARLTPAHTTDALIPLADHAPWRLAKDPGGSLDALTVVPAPDVLEPLTEGQVRIAVRAAGVNFRDVLMALGMVPARGTQLGGEAAGVVTAVGPGVTGIAVGDRVMGVFDGPFGPVAVADRRMVSRIPDAWSYTEAATIPLVYLTAYYGLVDLAALQQGQRILVHAATGGVGMAAVQLARHFGAEVYGTASPGKWDTLRAMGFDEAHMASSRSLDFEDHFWQTTGGEGFDVVLNSLAQEYVDASLRLQPRGGRFLEMGKTDIRDADEVAAAHEGVRYEAYDLTVFTSVDGPGAIPERIQEMLSELLALFDKGVLTPLPVTTWDVRRASAALRHMSQARHTGKIALTVPRPLDQDGTVLVTGGTGVLGSLLARHLVTEHGVRNLLLVSRRGGDAPGAAELVAELTAAGAEVSVVACDTADRAALEKLLASVPGDAPLTGVFHTAGVLDDGIVEAMTPERVDAVMRPKVDAAWHLHELTEGLDLAAFVLYSSAAGVSGDAGQSNYAAANVFLDALAQRRRAAGLPGQSLAWGLWDDRSEMTGHLGDAEIARMTEAGVLGFTAADGLAALDRAAMYDDAVLVPMKLDTATLGAGSSPVPHLFRGLVRTPVVRRAVAGNTGGDSGGGLEQRLAALTAAERTETVLELVRERVAAVLGHASADAIDPARAFKEIGFDSLTAVELRNRLNAATGLRLPATLVFDYPTPTVLSQYLLAELAPGLPAEDPVGTRLLEQIARIEAVLSEVSEVTDETSSLSDMDADARSGITARLNDILTAWNRAQRAPGHDAVAAELDDASDDEIFDFIDSTFGKS

SEQ ID NO: 39456 - protein, 596 aa, Oryza sativa Japonica Group
MEGSGQSDKGGHVTWTSSMSTYMLEYLEGIVASGNKTSSGFKQVHLKACAKALNDHFNINLTSDQITNHIRTWKRKYSKIADLRKLSAALWDDENFIISLDHKHYADHIKDHKADAEYLNKPIHNYGKMLVIFGNSLATGKYAKGSGDPLATESIPIDDDEEEEIGIGSAAATGSASRVHALNEENGASSSAPKPKKAKTDAAIEEEGLIGAFKSVGDKLAGAIVEAGKEAAKSNKELPDNLYESVHSIPGFEDTHLAHYHAHLVDNPPTARVFVTLEFAHKVDNKYVMQLIICTCNYPIFPSIPGRSVGLGAAAASEAMDASSVALYGQLKAAQPFFLLAGPNVIESEEHVLKMAKHIKGITTKLGLPLVFKSSFDKANRTSSKSFRGPGLEEGLKACPSRFCQFEYHQKNKTDLLVAAAKTGKIINIKKGQFCAPSVMANSAEKIRLAGNQNVMVYDLIVDPRNFEWLREANCPVTFELAINYGIVRGPLMDITFQVADVTHALQQPAGKKLDGGGVASGGLRELIPCIARTSVAVGVDGIFMEVHDDPLNAPCDGPTQWPLRNLEELLEELIAIARVTKGKKPLKIDLTPFKE

SEQ ID NO: 39457 - protein, 824 aa, Myxococcus xanthus DK 1622
MMKFGGTSVGSPTRLRQVVELIGKHARQGPLAVVVSAMGDTTDWLLDAAHLATEGDLEGALAVATRIADLAKANAAALAPGQATALAERVDGLLAPLRQLLHGVSLTRECSAPTRDRVLSFGELVSATLLAELLTAHRTPATFRDARQLLVTDDRFGAARVDLVRTRERLQAARETWGVEVPVLPGFIAATPDGRTTTLGRNGSDYTAALVAQGLGASEVTVWTDVLGLHTADPELVTDAYPVAHLTHGEGLELAAVGARMLHPRTMIPLIESGISLRIRNTMEPEHPGTLIDAIGSRDGQRPACIATREDLALLGIEVRKLSDQFQLGERVLAALREARVTVWMTAQSANGQSLAVVVPRPDAEHARSVLVTELAQELSRREVEPLEVRQPVTLLTLVAETMGHGVNVAGRFFSALGAVGVNVRASAQGASSRSLSCVVDAADTAVAARTTHAAFNLAHQQVSLFVLGRGTVGGQLLAQLRAQQALLRDRHGIALRVVGLADSKRALFDAAGLTLDGVEARLEGVTPEAPQARTLVPLLDALRRLPVPILVDCTAAGGLEALYTEAFQRGIHVVAANKKPLALPWEAREALVDTARRNHVAYHYETTVASSLPVIDTLANLVRTGDTVRLITASLSGSLGFICNELTAGVPLSRAVRTARERGFTEPDPREDLSGTDVARKALILARELGLPLSLSDVALEPFVATDECASVDSFFQVLATQDAAYAERVARCRHAGTVLRYLARIDPSKAGTGSPVIRVGPVGVEAGHPAADLRGSESFVSFTTTRHSDFPLTVRGAGAGGAVTASGVLADILRISQTLRGR

SEQ ID NO: 39458 - protein, 481 aa, Rhodococcus sp. RHA1
MDGPTTRVQRALSDMSAGRPVVLTGSSPTSDAHILIPAEKATVESIAFLVRHSSGLVCAAMVGADCDRLGLPNMVGADRDHAGTEFTVSIDAIGPGTGISASDRADTLRLLADSASTPDAFTRPGHVLPARSVPGGVLEFRGPAEAAVDLMSVAGLHRTCAYSALVSELDPTAIADSAEAETFARAHELGHLSIDDVATYRRMAEPHMLTQFTFERDSVHGPVRCVGYRSDVTGSEYLTYSIGPAVAGTTPLVCFQQESDPAPHLCQDGPIGVALAQVAEHGYGAVVVARYAPNNYISADTHGDLAEVVRECGYHSPSLSNFPPESRTMMWHIGLSISAGGSASLARGNAPAPFGFENPSIVGTVVHGDQRGRELGFRTANLELEDSNSVADGVWAGRCTLPDGSTAIAAISIGRRPTFYGRSGVRLLEAHLLDFDGDLYDATLEVSLHQWMRGQVTFASKEELVAALAADVVRTRSLIAG

SEQ ID NO: 39459 - protein, 444 aa, Sulfolobus solfataricus P2
MGEIEDKKIIRDHTFKTWSKQKGWDPIIVSSAKGVYFYDVEGKKYLDFSSQFVNVNLGYGNERVINSIKEQLDRLQYINPSFGADIRVKATKALLKVMPRNISKFFYSTSGTEANEAAIKISRFYKKPRYKILARYRSYHGSTEGSISLTGDYRRWFVEPNTMNGVVRIPEPYCFRCPLKLKYPDCGIACATYVDYVIRQEKNVAAMIIEPITGTNGVIVPPKEYMPLIRKIAKENDVLFIADEVMTGWGRVGEWFAVNLWDIHPDILTTAKGASASYVPIGITGVSKEIGEFFEDEVFAHGHTFEAHPVSLSAIPAVIEEYERLNILSHVKVMGDYLGKRLQELKERHRSIGDVRGVGLFWAIELVKDKNNTPFGGYDDKYEGYTTFVDVLARRLLIEKNTYVYNGPSWFIISPPLIINKEEIDEGVDAIDDILKEADKEFNN

SEQ ID NO: 39460 - protein, 105 aa, Myxococcus xanthus DK 1622
MAAKKAAAKKAPAAKKAPAAKKRTPNASFMKEMTPSAALAEIVGAKPLPRTEVVKKLWAYIKKQGLQDAKNKRQINADDKLKPIFGGKKSVTMFEMTALVNKQLS

SEQ ID NO: 39461 - protein, 249 aa, Rhodococcus sp. RHA1
MTKRLEGKVALITGASRGMGESHAKAFVEHGAKVVLADITDDAGELLAKELGENAVFVHHDVTQLDSWTNVVERSVNAFGEINVLVNNAGVLGPLATTAELTEGDYRKVCSINQDGVFFGMKAVLPSMERAGIGSIVNISSIAGMAANYGFPSLAYVASKFAVRGMTKATAVEYGPKNIRVNSVHPGFIQTPMMVEATNEEGGDALAQIPLGRIADPQEVSNLVLFLASDESSYITGSEHLVDAGMLAQ

SEQ ID NO: 39462 - protein, 416 aa, Shewanella sp. ANA-3
MSLVAIGINHKTATVDLREKVAFSPDKIHDAMKSLASRTRSGEAVIVSTCNRTELYCNNGDEADIIEWLEEYHGLDHQDVAPCLYNYHGQAAVRHLMRVASGLDSLILGEPQILGQVKQAFVKAKEAGTVALTIDRLFQNTFSVAKKVRTETEIGAAAVSVAFAAVSMAKHIFSSLSTTKVLLIGAGETIELVAKHLKDNGVASMVVANRTLERAQSMCEEFNATAITLAQIPDFLPKADIVISSTASPLPILGKGMVEKALKQRRHQPMLLVDIAVPRDIEPEVADLDDAFLYTVDDLHSIIEQNKASRKEAAEQAELITEEQSYLFMDWVRSLESVDSIREYRSQSMAIKDELVERALNKLAQGGDTEQVLIELANRLTNRLIHAPTQALTVASRQGDLNTLGQLRTALGLDKN

SEQ ID NO: 39463 - protein, 651 aa, Glycine max
MAGEELAGDHTPELLCLVHDIAGMCSALSSSAGSAGAMFRKDCTDLVRRISLLTHLFEEIKELSNNVVGGSSSSPSPSSSASSKWSSDLVLALHSARRLLSVARNFRSNCSSDGAAKTIVFQFQCVTWKLEKLLSNLPYDDLDISEEVKEQVDLVRTQLRRATDKYGFMISKMPSHELSQPLAEEISQVLGKSVSRLHKQQSCPENLSELDSIPINDEGKCCSTNPARSRLERTRSIPTEVEVSLNAIEPESQEISETKSLPEVKKTEGIVIPEDFLCPISLELMRDPVIVATGQTYERSYIQRWIDCGNTTCPKTQQKLQHLTLTPNYVLRSLISQWCIEHNIEQPTGLTNGKLKKSDGSFRDVTGDIAAIEALVWKLSSRSVEERRSAVTEIRLLSKRSTDNRILIAEAGAIPVLVNLLTSEDVLTQDNAVTSILNLSIYENNKGLIMLAGAIPSIVQVLRAGTMEARENAAATLFSLSLADENKIIIGASGAIPALVELLQNGSPRGKKDAATALFNLCIYQGNKGRAIRAGIITALLKMLTDSSKSMVDEALTIMSVLASHQEAKVAIVKASTIPVLIDLLRTGLPRNKENAAAILLALCKRDADNLACISRLGALIPLSELARNGTERAKRKATSLLEHIHKLQQL

SEQ ID NO: 39464 - protein, 444 aa, Arabidopsis thaliana
MMVFVVFVMCRYKILEELGDGTCGSVYKAVNLETYEVVAVKKMKRKFYYWEECVNLREVKALRKLNHPHIIKLKEIVREHNELFFIFECMDHNLYHIMKERERPFSEGEIRSFMSQMLQGLAHMHKNGYFHRDLKPENLLVTNNILKIADFGLAREVASMPPYTEYVSTRWYRAPEVLLQSSLYTPAVDMWAVGAILAELYALTPLFPGESEIDQLYKICCVLGKPDWTTFPEAKSISRIMSISHTEFPQTRIADLLPNAAPEAIDLINRLCSWDPLKRPTADEALNHPFFSMATQASYPIHDLELRLDNMAALPNLELNLWDFNREPEECFLGLTLAVKPSAPKLEMLRNVSQDMSENFLFCPGVNNDREPSVFWSLLSPDENGLHAPVESSPLSLSFSSPMQQHTVGPPQSSGFTMTSSMQPNMLDRPWMAVSAPFQQSHYL

SEQ ID NO: 39465 - protein, 163 aa, Geobacter metallireducens GS-15
MRHTITVLVENEFGVLSRVAGLFSGRGFNIDSLSVAPTNDETISRMTIVTRGDDQILEQISKQLNKLIDVIKVIDFTDGEVVEREMALIKVTAEDSARAEVLRIADIFRAKIIDVTPKSFTIEATGAPAKIDAILELLRPLGLKELVRTGPVAIGRGAKALKG

SEQ ID NO: 39466 - protein, 324 aa, Bacteroides fragilis YCH46
MYTAFQLLDKINSHISDIRFTRTPAGLYDPIKYVLSMGGKRIRPVLMLMAYNLYKEDVSSIYDPATAIEVYHNYTLLHDDLMDRADMRRGKTTVHKVWNDNTAILSGDAMLVLAYQYMAASSSEHLKEVMDLFSLTALEICEGQQMDMNFESREDVKEEEYLEMIRLKTAVLLAASLKIGAILGGASPEDAENLYDFGMQIGVAFQLQDDLLDVYGDPAVFGKNIGGDILCNKKTYMLIKALERADRDQLEGLNHWLSATSFCPEEKISAVTELYTQIGIKAVCENKMREYYTRAMTSLGAVSVIEDKKSELKKLMKHLMYREM

SEQ ID NO: 39467 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSEDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSAFPKWPSKDLATIVPNLDGAGLDLLDKMLRLDPSKRITARNALEHEYFKDIGYVP

SEQ ID NO: 39468 - protein, 410 aa, Aspergillus nidulans FGSC A4
MFITSAAAFVWANLNPTNYIGSVSFCPERDIPDLAGKVVLVTGETIRQIIKHNPEQVFLAARSEEKAQNAIRELESTAPNIKITWLPLDLASTKSIHDAAETFRAHASRLDILILNAGVMSLPPGETDLGHEIQLGTNHTGHFLLTKLLLPVLLETAQKPDSDVRVISLSSIGHNLAPDFETILHQDELKKCNTNARYGASKAANIIFAAELARRYPSLTAVSVHPGIIVTELYAATSASNPIAALAVKLLGLIATKVEQGAWNQLWAAVGAKKGELVNGAYYTPVGIVKQRNRYVVDQKMGRRLWEWTETELKRDHKEGFIERMLQPHPHHQRRRSSVGEGEIEKPDLAIGLERQSSTERNEQGQNQAESGGQNVLRPQRRNSRLQRLKEFMHSEEELDDAGKTYAKLM

SEQ ID NO: 39469 - protein, 701 aa, Oryza sativa
MAEHLASIFGTEKDKVNCPFYFKIGACRHGDRCSCLHNRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQYEENSCNRESHNEAGAAAQAQAHAIGGSDMIVMTIEDVTITLVVVEGGVEAADMKGMMMEEGVGTVVALQGVRGVQSGRAARSAGPRSNSGIVKGTKSRGDRLCPSLARACDRTAMRRLTKRLLPSFRGAGRACHRRMARYRQAGTGTPGGGGGFLLICSTGDALFDETEFTFGKVEIFNTMHSCFKFSNDLGNQLKTIFFKKENKGGMQGKSKSMYNPCMSTTSMNQYVSHTQSFGLPSNQVVLGSMDEESAQHGNYAFPTSHISQCFQPTSNTWISQSANGIADGIPQWEYVNGMNNAPGMTETVNGSFREYQNGPSTLCRGPLPYFHQHAGMHAHNLLDHTQVQAPYQQCHNNPVLHGVNHSGNRFHLGPRIPVLFSNSERTFGPPHHPLLANPVNHRNIRILPPEHATIMDFSRLYEVSNVVDEHRDMRLDIDSMTYEELLALEEQIGDVNTGLAKSYIVEKLKTSLFVPGSSCMSNKSSESSMENDACIICQEEYQVKECIGTLDCGHRYHEDCIKQWLMVKNLCPICKTTALSTGRRSG

SEQ ID NO: 39470 - protein, 636 aa, Enterococcus faecalis V583
MNIKDIAKLAGVSASTVSKIINNKDQTISKETRERVLKIVRDYNYTPYSANLVTNSTTKTFVLLLNSHETFEAWVTSFIDKAQENGYNCLILNSHGSLEQELKNITSPTLKQASGIIWDPINENSKQYAKFIEELTIPYYFVNHSTNELPSLAGLYEEASYVLTQELLQNNHKKISYFVTNPKYKEAIIAGYKKALFDVNLPFSKENILTTIPADFSNQLITDGITGILTDDYTQAVFLEQLLKQSGLRTPDNYSLLAIKRKIDRSFLPDHISSVLLDTETFGSKLALLLLNKRKEKTALINEAEKLVLDHKNTLGMSSVNPHSKMIVVGSLNVDNYLYSTNLPHNGKTNFLSSYAKFPGGKGLNQAVGLTKLGHQATLIGCLGSDTDANYLYKELEKYHVTTDGITRIQDTETGQAYIYVETSGDSMISILPGANTALTPKKIAQQKHLFMDASFCLIQTEIPLSAVEKACEIAQHSGVPIILKPAAIHHIPVNILEKVDFFIPNEDELLELQPDTGTLEEKAAYFLEMGVKNVIVTLGKKGVLLKTPQVCHYFPATENIAVDSTGASDSFISALASYLSKGYPTEAAIQIAIQAAGFSVSKEGVIDSLVDHVTLENYLIKKEPALFAHRNTCID

SEQ ID NO: 39471 - protein, 526 aa, Oryza sativa Japonica Group
MDLTITSLVAACLSMAVLFVATKMIQQRPRTLCLYEKENKEEELLLPPVMSVVSVLTAYLPTLIAKGLPAVIHDLHSRLVTLLVTAHFFQASESEIRQSNIYKVTVPVFGRGVLYDVDLATRSRQISFCTDSIKPINLRGHVDSMVHEVEGYFAQWGEDGVVDIKYEMGNLILLIANRCLLGKQFGESKLEQVSTLLHELFDNGFHLISLFFPYLPTPQHRRRDKARAMLGEMIHEAVRSRRNSGVAEDDVLQKFLDSKYINGRCMTENEIAGLLICMMFAAQHTSSSTSTWTGACLLSHGHRSYLAAAIQEQKRIIQQHGDRINWGILLQMTTLTHCIKEALRLHPPANLLIRHASKSFSVQTRQGHRYQIPKGHTLATCTTVGNRLPYIYKDPNVYDPSRFGPGREEDKVGGKFSYTPFSAGRHVCLGEDFAYMQIKVIWSHLLRNFDLELISPFPEEEWEKFIPGPKGGGGDGRGKGWRKRRTGGRPAAGGRGCGAHAAAPRVGGRGGAGGESTREAMAQRQR

SEQ ID NO: 39472 - protein, 256 aa, Guillardia theta
MKAASMRLKNLLLLLSLPLVLSSSPSPTDLVRLSSSRLRGALRRAVQEEETCIQRLIPLRGGANPTGESTKRIFQDTRKLQMSSFKVIVTNGKTMREFSVLFHGPKDTAYESGVWKVNVELPVEYPYKSPSIGFANKIFHPNIDLQSGSVCLDVINQTWKPMFDLVNIFEVFLPQLLTYPNPSDPLNADAAALSMKDPQTYHSKIRMFIDKYCQGVEEEFMKALPSEQQSTNRHVAANPESLWKESSSEESSSGDE

SEQ ID NO: 39473 - protein, 609 aa, Enterococcus faecalis V583
MTFSIETRRQSIDALKTQHLDVLIIGGGITGAGVALQASAAKMKTGLIEMQDFAEGTSSRSTKLVHGGIRYLKTFDVEVVADTVKERAVVQSIAPHIPKADPMLLPIYDEPNATFNLFSVKIAMDLYDQLADVTGTKYANYLLTKDEVLAREPQLKSEGLQGGGVYLDYRNNDARLVIENIKQAVADGAHAVSRVQAVGFLYNDEGKITGIQAKDLLTDEQFEIHADVVINTTGPWSDKLRGLDKNDSFTPQMRPTKGVHLVVDKSRLNVPQPTYFDTGKQDGRMVFVVPREEKTYFGTTDTDYHGDFQHPTVEQSDVDYLLEVVNNRYPEVQLTIDDIEASWAGLRPLISANGGSDYNGGNNGKLSDKSIDEVIDVVDRYQKNQTDKREIEEVLNHLEDSLVENKVNPSAVSRGSSLERSADGLLTLAGGKLTDYRKMAEGAMKMIQTILAEEYQKEFTLIDSKNYPVSGGKLNPATVDEELEALAKHGVSKGLSEKDALYLAHLYGSNVPTVFEMIDDAKVIPGLTLTETVSLNYAMEEEMALTPVDFLLRRTNHLLFMRDRLDQVKAGVIEEMAQHYQWTAEERARHIETLEKVIEESDLKNLKVG

SEQ ID NO: 39474 - protein, 223 aa, Thermobifida fusca YX
MPTLDRHGDVYVLDLGDTENRFHPDWIASVNAALDEVEHTQGPCALVTAATGKFFSNGLDLEWLAAHPEQRHDYVVSVHRLFARVLTLPMVTVAALQGHTFAAGAMLSLSHDFRVMRADRGFWCLPEADIKIPFTPGMSALIQARLSPQTAHEAMVTARRYGGHDAFAAGIVDSAVAEDEVRATALDIAAAHTTKAGPTLATIKTRMYRQALDALAETPIPLS

SEQ ID NO: 39475 - protein, 485 aa, Cryptococcus neoformans var. neoformans B-3501A
MMHASKHKMGFSDFRDAILIQPPSFKKKKEYVLEELLGRGGFGKVVKALWTPPEREPKEVALKIINKKLVKGNEQAVLDEISVLKHLDHPNIVHVWDDFESRDKYYIAFELAVGGELFDRISERGKFTERDAVECIRQVLQATAYLHEHNVAHRDLKPENILYKTRDADSPLVIADFGIAKHLETPDQECSEAAGSFGYAAPEVLLGKPHGMKVDCWSIGIIAYTLLCGYPPFRSDDRNGLLQEMTRGRIMFHDRYWSKVSRTAKDFVKDMLETDPKKRSTAADALNHPWLTSGQATETDLSAAIRDNFDAKRKWKSALRIIQASNRIRSASRSRSPSLSTSPPSTANTANPSPNSALFVPEVPHVLTPLSMTDEDPMSDEHYYFSADDQGHTEEEEEAKVMTRGGKKKAGSMPVGSGSGVTTGTVTPYTTGNEGSNTPKPTIKVIDGNGELRPEETDMQTPPATAPVGAGMMGSIRGMMGKLSL

SEQ ID NO: 39476 - protein, 440 aa, Sulfolobus solfataricus P2
MEENLDSSVLEAPIINVTPPGSKSLKLLKDQEEYETSAINYPKYFKIAIDKAQGSTVTDVDGNVYIDLVTGISVVNLGHNNPFVRKRVQEQLEKVWHTLEVPTEIRVNFSKKLLSTLGMRAKLLFTTTGADAVEAAVKIARFITGKKTIIAFEGSYHGITAGTLGLTGANRFKEFQPFFDDRVVKFPYPYPYRCPFKDCLNETLSLLDYAMSNPGYLGGDVAGILVEPIQGEGGYVVPPKGFLKGLKELAEKYSVPLIVDEVQTGVGRTGKMWAYQWENIEPDIVTISKAIGEGIPVSMVAYREDFDKLPTGFHLGTYRGNPLGLAAGLASLEFIESHNILSRVERLGRKALELLKEVQNPHVGDIRGLGFMIGIELVKDSKEPWSEGTKVVIERALKRGLLVYKAGRWDNVIRLMPPLTIPESLLDRAIEILKIILNTL

SEQ ID NO: 39477 - protein, 357 aa, Saccharomyces cerevisiae
MRLAVVVTLLVHCFLVTCSPGDNLDEFIDCTYACEYNRRCPNSQINYIDPETNMFHDIEFFDTPPLYSKLLFWDCISDCDYQCQHIITRWRIDEEEEIYQFHGKWPFLRVLGTQEFFSTIFSIGNFIPHYKGFVKFSRIIREEGDRRRKNSRSILIWNYLYVTVAGMLAWTASSVFHCRDLIITEKLDYFFAGLTVLTGFHAIFARMTSMFLYPKIAQAFTASVAAIFALHILRLYVDWSYTYNMRFNIFFGVLQYILLIMLSCQNYHALQKQKLMGEFKKTAYSSFKRQIFKLCVIPILLVIVTTMAMSLELFDFFSYEWQIDAHALWHLCTIWPSWVLYDFFLEDYAYWGNRQLY

SEQ ID NO: 39478 - protein, 275 aa, Saccharomyces cerevisiae
MSRPEELAPPEIFYNDSEAHKYTGSTRVQHIQAKMTLRALELLNLQPCSFILDIGCGSGLSGEILTQEGDHVWCGLDISPSMLATGLSRELEGDLMLQDMGTGIPFRAGSFDAAISISAIQWLCNADTSYNDPKQRLMRFFNTLYAALKKGGKFVAQFYPKNDDQVDDILQSAKVAGFSGGLVVDDPESKKNKKYYLVLSSGAPPQGEEQVNLDGVTMDEENVNLKKQLRQRLKGGKDKESAKSFILRKKELMKRRGRKVAKDSKFTGRKRRHRF

SEQ ID NO: 39479 - protein, 866 aa, Burkholderia thailandensis E264
MRRAEESQLKQQASHDQIVLVAPLTGPVVPLADVPDPVFSGGMFGDGIGIDPLEGRLLAPCGGVVSHVARTGHAVTIAADGGAEILLHIGIDTVELNGLGFSAKIAEGARVAPGDLLIEFDQDTIARAAHSLVSVIAIANSDAFEVVERAGAGVAKAGETPLLTLRARGAAAGAAASAGSAAGRADAGAEARKSITLTQPGGLHARPAARAREAARGLDAHVDVHFGGRKAALQSVVGLLGLGAGEHATIEIVATGRDAAKAVELVAHELLREAHGEAEEKPARVVSPAPVAAAVGRAPLDPNTLAGVCAAPGIAVGALVRWDETDIAPPELASGTPAAESRLLDRALAAVDAELETTVREASQRGAIGEAGIFAVHRVLLEDPSLVDAARDLISLGKSAGYAWRETIRAQTAVLAGVDDALLAERAADLRDIDKRVLRALGYASATARELPAEAVLAAEEFTPSDLASLDRERVTALVMARGGATSHAAIIARQLGIPSLVAVGDALYAIPQRTQVVVDASAGRLEYAPTALDVERARHERQRLAGVREANRRMSGEAAVTRDGHKIEVAANIATLDDARVAVDNGADAVGLLRTELMFIHRQAAPTTSEHQQSYQSIVDALQGRTAIIRTLDVGADKEVDYLTLPPEPNPALGLRGIRLAQVRPDLLDDQLQGLLSVKPYGSVRILLPMVTDVGELVRIRERIDAFARALGRADPIEVGVMIEVPSAALLADQLAKHADFLSIGTNDLTQYTLAMDRCQADLAAQADGLHPAVLRLVDATVRGAEKHGKWVGVCGALGGDPVAVPVLVGLGVTELSVDPVSVPGIKAQVRRLDYQLCRQRAQDLLALESAQAVRAASREIWPAD

SEQ ID NO: 39480 - protein, 497 aa, Vitis labrusca x Vitis vinifera
MKKSSAGAPSKPTKPAWVLPYKTQDLRTLYTIGQKLGQGQFGTTFLCTDKATGHNYACKSIPKRKLFCKEDYDDVWREIQIMHHLSEHPNVVRIRGTYEDPVFVHLVMELCEGGELFDRIVQRGHYSEREAAKLIKTIVGVVEGCHSLGVMHRDLKPENFLFDTTAEDAALKATDFGLSVFYKPGETFSDVVGSPYYVAPEVLCKHYGPEADVWSAGVILYILLSGVPPFWAETETGIFRQILQGKLDFESEPWPCISETAKELLRKMLDRNPKKRLTAHEVLSHPWVVDDRMAPDKPLDSAVLSRLKQFSAMNKLKKMALRVIAEGLSEEEIGGLRELFKMIDTDNSGTITFDELKDGLKRVGSELMESEIRDLMNAADIDNSGTIDYGEFLAATVHLNKLEREENLVSAFSFFDKDKSGYITIDELQQACKEFGLSEAHLDDMIKEIDQDNDGQIDYGEFAAMMRKGNGGIGRRTMRNNLNLGDVLGIPDMRLTN

SEQ ID NO: 39481 - protein, 275 aa, Burkholderia thailandensis E264
MARSRHVPIRTQAEIAMARRAGTMAARVLGMIAPHVKAGVTTNELDRLCREYIVDILRARPANIGYHGYPKTICASVNHVVCHGIPSDHALKDGDIINIDVALDSDGWYGDTSRMYFVGEPAEPARRLVDATYEAMMAGVAAVRPGATLGDVGHAIQSVAHREGFSVVREYCGHGIGRIYHDEPQVLHYGRPGTGLRLAPGMIFTIEPMLNAGRAETRQLADGWTVVTQDRSWSAQWEHMVVVTEDGFDILTPWPDAAPERSPVTARAAGAPERG

SEQ ID NO: 39482 - protein, 290 aa, Bacteroides fragilis YCH46
MMERKLAVITGADGGMGTEITRAVACAGYDVIMACYSSSKAETKCRELVKETGNEKIEVWQIDLASLASVRAFADRMLRQKTPVALLMNNAGTMETGLHITEDGLERTVSVNYVGPYLLTRLLLPLMGEGTRIVNMVSCTYAIGKLDFPDFFLRGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 39483 - protein, 216 aa, Glycine max
WNRQEDSLSRARNGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 39484 - protein, 483 aa, Nicotiana tabacum
MATTQNRRSSVSSATTKRQAMTSNSSLENNNHGKLVAKKRPALTNISNHTTASARNSLSHSSKLAPCTSKAVSIKKSNSNAASSVLPTSSFVKPISKTVSIPRSDAAIPKITAIPLPATCSMDISPSHSDGSLVSMDETMSTSDSLRSPDVEYIDDNQTAAFDSIEKKAFSTLYISEDVKAADICKRDVLVDIESGDKIANIDNNFVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVVALHSLCCNNNNSSLPAIREKYSQHKYKFVAKKYCPPTIPVEFFQNISC

SEQ ID NO: 39485 - protein, 175 aa, Brassica napus
KSMFVSQLVGTAMGCIIAPVTFYLFWSAFDIGDPNGPYKAPYAVIFREMAILGIEGFAELPKHCLALCYGFFVAALIVNLLRDITPPKISQFIPIPMAMAVPFYIGAYFAIDMFVGTVILFVWERINRKDADDYAGAVASGLICGDGIWTIPSAILSILRINPPICMYFKPALAS

SEQ ID NO: 39486 - protein, 306 aa, Zea mays
  misc_feature (62)..(62): Xaa can be any naturally occurring amino acid
  misc_feature (111)..(111): Xaa can be any naturally occurring amino acid
  misc_feature (189)..(189): Xaa can be any naturally occurring amino acid
  misc_feature (270)..(270): Xaa can be any naturally occurring amino acid
  misc_feature (277)..(277): Xaa can be any naturally occurring amino acid
MAEHLASIFGTEKDRVNCPFYFKIGACRHGDRCSRLHNRPTISPTLVLANMYQRPDMITPGXVDAQGQPIDPEKMQEHFEDFYEDIYEELGKFGEIENLNVCDNLADHMIXGNVYVQFREEEQAAAAYNALQGRFYSGRPIIVEYSPVTDFREATCRQFEENSCNRGGYCNFMHVKQIGRDLRRKLYGXRSASRRYHGRSRSRSPPPQRRGHRDRDRDDYHHRDRDDYRGGGGGGRGRGSRYDRYDDGAGRGGRHARGGRHDRYDDGGRXRRHGSPXRRARSPVRESSEERRAKIEQWNREREGKQ

SEQ ID NO: 39487 - protein, 253 aa, Bacteroides fragilis YCH46
MSIESFNLLLLVMGLVALVVFIALYFVRAGYGMFRSRSWGISVNNKIAWILMEAPVFLVMGWLWWHSDRRFLPVELTFFLFFQLHYFQRAFVFPFLMKGKSKMPVLILLMGVIFNILNGLMQGEWIFYLAPSDYYTPGWLLTPCFWIGTLLFFAGMGINWHSDSVIRHLRAPGDTRHYLPQRGMYRYVTSANYLGEIVEWVGWAILTWSLSGCIFAWWTVANLVPRADAIWHRYREEFGTQVGLKKRIFPFLY

SEQ ID NO: 39488 - protein, 336 aa, Burkholderia thailandensis E264
MSFNLHNRNLLSLIHHSARELRYLLDLARDLKRAKYSGTEQPRLLRKNIALIFEKTSTRTRCAFEVAAYDQGANVTYIDPASSQIGHKESMKDTARVLGRMYDAIEYRGFSQEIVEELAHHAGVPVFNGLTDEYHPTQMLADVMTMREHSDKPLHDISYAYLGDARNNMGNSLLLIGAKLGMDVRIGAPKSLWPAADFIAQCEAFAAESGARLTLTEDPYEAVKGVDFIHTDVWVSMGEPVEAWDERINALLPYQVNRKLIESTGNPRTRFMHCLPSFHNCDTKVGKQIAERYPHLKDGIEVTDEVFESPRCIAFEQAENRMHTIKAVLVSTLGGI

SEQ ID NO: 39489 - protein, 493 aa, Nicotiana tabacum
MRHANIKHGSFHLEEHNMRITRARARVSGSSGRLPPLHPSTKQDKKQALGAESKRSKRSASDENRPGTSSIATGVQPKRRAVLKDMKNVLHENSHMNCINGSKIQVKKGSDKRNNKAKPAVSLKLSQLQEKGKEDIADKVKKVKVEGSQEISSGANCKEDMLPQLSRDVTPAQCGLVHLVPVNRSSCKAFPLQNVMKKDESKVCQKQEGFANLGIADIDSRHKDPLMCSLYAPDIYNNLHAIEFDRSPSVDYLEKLQLDINKGMRGILIDWLVEVSEEYRLVPDTLYLTVNLIDRFLSENYIEKQKLQLLGVTCMLIASKFEEICAPRVEEFCFITDNTYSKEEVIKMESRVLNLLSFQLASPTTKKFLRRFIQAAQASYKVPSVELEFMANYLAELTLVDYGFLKFLPSLTAASAVFLARWTLDQSNHPWNPTLEHYTRYKVSELRTTVFALQELQMNTSGCTLNAIREKYRQPKFKSVATLAASKPVQSLF

SEQ ID NO: 39490 - protein, 396 aa, Bacteroides fragilis YCH46
MSKITKQQNGVLSVPDVPTIPFITGDGVGAEITPAMQAIVDAAVDMSYGGVRRIEWKEVLAGERAFRATGSWLPDETMEVFKEYLIGIKGPLTTPVGGGIRSLNVALRQTLDLYVCLRPVRWFRGVVSPVKEPEKVNMYIFRENTEDIYAGIEWEAGTPEAKKFYRFLHEEMGVSKVRFPETSSFGVKPVSREGTERLVRAACRYALQHELPSVTLVHKGNIMKFTEGGFKKWGYELAEREFAEALASGKLVIKDCIADAFLQNTLLIPEEYSVIATLNLNGDYISDQLAAMVGGIGIAPGANINYDSGHAIFEATHGTAPNIAGKNVVNPCSLILSAVMMLEYIGWQEPADLIVEALEASFAEGKATNDLARFMHKGQPLSTSEFTREIINRIKN

SEQ ID NO: 39491 - protein, 341 aa, Bradyrhizobium sp. BTAi1
MQTMKAAVVKAFGKPLVIEDVPVPVPGPGELLVKLKACGVCHTDLHAASGDWPVKPVPPFIPGHEAAGVVAALGPGVTDFKIGDAVGVAWLHDACLRCEYCETGWETLCEHQHNTGYSVNGGFAEYVIASAAFAARLPANVNFAKIAPILCAGVTTYKGLKETDTRPGEWVVISGVGGLGHVAIQYAKAMGLKAIGLDIAEDKLKLALEAGADHAVNALDKDAVERVIAFTGGGAHGVLVTAVSTPAFAQALKMVRRKGTVSLVGLPPGEFPTPIFDVVLKRITVRGSIVGTRRDLDEAVAFAAEGKVKAEITTAPLSEINTIFDRMKAGKIDGRVVLDFT

SEQ ID NO: 39492 - protein, 473 aa, Nicotiana tabacum
MASRIVLQQQNRGEAVPGAVKQKKNMAPEGRNRKALGDIGNVATGRGLEGKKPLPQKPVAVKVKGANVAKVPAARKPAQKKATVKPNPEDIIEISPDTQEKLKEKMQRKKADKDSLKQKATLTSTLTARSKAACGLSKKPKEQVVDIDAADVNNELAVVEYVEDIYSFYKLAENETRVHDYMDSQPEINDRMRAVLIDWLVEVHQKFELNPETLYLTINIVDRYLAVKTTSRRELQLLGISAMLIASKYEEIWAPEVNDFVCISDKSYTHDQVLAMEKEILGQLEWYLTVPTPYVFLARFIKASLPDSEIENMVYFLAELGLMNYATIIYCPSMIAASAVYAARHTLNRTPFWNETLKLHTGFSESQLIECARLLVSYQSAAATHKLKVIYKKYSSPERGVVSLLTPAKSLLAASSSSVLSEQADLRKSTEAAATSSSKMVVVGCQRCHMYVMVTEADPRCPQCKSTTTRKMT

SEQ ID NO: 39493 - protein, 526 aa, Gibberella zeae PH-1
MSSSVPVANALSDIYPQDALAEQGPRWNNLLTKFESTYGHAASFVARSPGRVNIIGEHIDYSLYSVLPMAITADTLLAVSATPAASDAKSFRIRIANVEDDKFEAADFEVPFDGEVSIDATKLEWTNYFKSGLRGVMDLLRKKHGKDFKPCNMELLMDGTVPVGGGLSSSAAVVSTSSLAIMLANGEKTVDKTELTELAIVNERAVGVNSGGMDQAASVFSEKGAATFVSFNPSLKAQPVHFPPTNPEITFVIVQSFVTSNKQVTGPIHYNLRVVECSIAASCLNAVLNPPGTLLPEDAGPLGVSLGGFHDTFFYHLNGSDYSAAKTLTKEEELEKLIEITEKTLTQEEGYTREEVAKVLNVTVEDLEKRFMSKLPVRAERFKLRQRALHVFREAHRVIRFMKLLENPVHTGASDTTKFNAELGSLLNETQASCRDLYECSSPELDEICAISLREGSYGARVTGAGWGGCSVHMVPADKVAAVTRALEKEYFAKRDLTEDQKKGSVVVSRPATGSAIYYIQNGVKP

SEQ ID NO: 39494 - protein, 429 aa, Escherichia vulneris
MTQDDLAFDRRHIWHPYTSMTSPLPVYPVQSAQGCELQLASGEQLVDGMSSWWAAIHGYNHPHLNAAMKTQIEAMSHVMFGGITHAPAVSLCRKLVAMTPEALECVFLADSGSVAVEVSMKMALQYWQAKGESRRRFLTFRRGYHGDTFGAMSACDPDNSMHSLWAGYLPDNLFAPAPESRFDGEWDERDIVGFARLMAAHRHEIAAVILEPIVQGAGGMRLYHPEVLKRIRRMCDREGILLIADEIATGFGRTGKLFACEHADITPDILCLGKALTGGTMTLSATLTTRAVAETIRNGEAGCFMHGPTFMGNPLACAVANASLELLARGEWQVQVAAIEAQLKRELAPARAAETVADVRVLGAIGVIETHQPVNMAALQRFFVEQGVWIRPFGKLIYLMPPYVISPEQLSKLTDAVLAAVAHPAHFAP

SEQ ID NO: 39495 - protein, 497 aa, Arabidopsis thaliana
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSSQIIAQYYQLIRLGFEGYRNIMQNCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 39496 - protein, 199 aa, Guillardia theta
MNTISWSSLVLLVVASLGSLEEVNSDRACRSISSPLRLRGGFRGDDNQYDQGYGRDYGDRGGYRGRARGRGRGRGAPRGPPDGPIDPLKLFVGGLSWEVDDQQLMEAFQEFGNCEAKVMVDRYSGRSRGFGFVTFSEEHSAAKAIEEMNGRELLGRQITVTHARQKIYEQNSQSFDGQGGQGNADGLAGEEEPMENEES

SEQ ID NO: 39497 - protein, 238 aa, Zea mays
MSAASKKLFQAARSLVLSASHRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 39498 - protein, 490 aa, Lentisphaera araneosa HTCC2155
MGKKTGFKEFDRQVEAKRPPAERIEHYNEFTEPMKKEELETQGARCMDCGIPFCHSGCPLGNLIPDFNDLVYTGQWKDALARLHSTNNFPEFTGRLCPAPCEEACVMTINQPAITIENIEKNIVEKGFSEGWIKAEPPTERTGKKIAVIGSGPSGLAAAQQLNRAGHLVSVFERDDRIGGLLRYGIPDFKMEKWVIDRRVKIMEEEGVDFNINTEVGVNFPTEDLKRYDAVIICAGATVRRALPIEGADLEGVHQAMDFLPQQNRRNAGDSEDKLGTNLTAKDKNVIVIGGGDTGSDCIGTSIRHGAESVSNFELMGKATTDRPAGQPWPFWPMRLRTSTSHEEGVERFWSISTKKFVGDENGKLKGLVTTEVTVNRENGGFKIEEVPNTEKEWPCELALLALGFTGPETNTMVSDLKLDLDPRGNVKADEKTYMTSVPGVFAAGDVRRGQSLIVWAISEGREAAHQVDRFLMGHSELPQKDAEWDLPRV

SEQ ID NO: 39499 - protein, 402 aa, Streptococcus pyogenes str. Manfredo
MKIAVAGSGYVGLSLGVLLSLQNEVTIVDILPSKVDKINNGLSPIQDEYIEYYLKSKQLSIKATLDSKAAYKEAELVIIATPTNYNSRINYFDTQHVETVIKEVLSVNSHATLIIKSTIPIGFITEMRQKFQTDRIIFSPEFLRESKALYDNLYPSRIIVSCEENDSPKVKADAEKFALLLKSAAKKNNVPVLIMGASEAEAVKLFANTYLALRVAYFNELDTYAESRKLNSHMIIQGISYDERIGMHYNNPSFGYGGYCLPKDTKQLLANYNNIPQTLIEAIVSSNNVRKSYIAKQIINVLKEQESPVKVVGVYRLIMKSNSDNFRESAIKDVIDILKSKDIKIIIYEPMLNKLESEDQSVLVNDLENFKKQANIIVTNRYDNELQDVKNKVYSRDIFGRD

SEQ ID NO: 39500 - protein, 304 aa, Streptococcus pyogenes str. Manfredo
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKMHASTIAVMKVPHEDVSSYGVIAPQGKAVKGLYSVDTFVEKPQPEDAPSDLAIIGRYLLTPEIFDILERQVPGAGNEVQLTDAIDTLNKTQRVFAREFKGNRYDVGDKFGFMKTSIDYALEHPQVKEDLKNYIIKLGKALEKSKVPTHSK

SEQ ID NO: 39501 - protein, 202 aa, Shewanella oneidensis MR-1
MHNASDIQSALVPMVIEQTAKGERSFDIYSRLLKERIIFLVGQVEEHMANLIVAQLLFLESESPDKDIFLYINSPGGSVTAGMAIYDTMQFIKPNVSTVCIGQAASMGAFLLAGGEKGKRFCLPNSRVMIHQPLGGFQGQASDIAIHAQEILGIKNKLNQMLADHTGQPLEVIERDTDRDNFMSATQAVEYGLVDAVMTKRG

SEQ ID NO: 39502 - protein, 133 aa, Zea mays
  misc_feature (114)..(114): Xaa can be any naturally occurring amino acid
AGDLVQNPPCAAASSPSGRGPRALRAAPQRHHEVNLANPSPGWQKKLEIDDDQKLRAFYDRRISQEVSGDALGEEFQGYDFQILGGCDKLGFPMKQGVLTSGRVRLLLHRGTPXAFRGYGRRNGERTRKSVRG

SEQ ID NO: 39503 - protein, 627 aa, Arabidopsis thaliana
MEFNCLPPTFITLRLMRRKLPFSMCCGYCLQASYSCLYFRKFLEVTPVLGYLAAGILIGPYGLSIIRNVHGTKAIAEFGVVFLLFNIGLELSVERLSSMKKYVFGLGSAQVLVTAAVIGLITHYVAGQAGPAAIVIGNGLALSSTAVVLQVLQERGESTSRHGRATFSVLLFQDLAVVVLLILIPLISPNSSKGGIGFQAIAEALGLAAIKAAVAITGIIAGGRLLLRPIYKQIAENRNAEIFSANTLLVILGTSLLTARAGLSMALGAFLAGLLLAETEFSLQVESDIAPYRGLLLGLFFMTVGMSIDPKLLLANFPLIMGTLGLLLVGKTILVVIIGKLFGISIISAVRVGLLLAPGGEFAFVAFGEAVNQGIMTPQLSSLLFLVVGISMALTPWLAAGGQLIASRFELQDVRSLLPVESETDDLQGHIIICGFGRIGQIIAQLLSERLIPFVALDVSSDRVAIGRSLDLPVYFGDAGSREVLHKIGADRACAAAIALDTPGANYRCVWALSKYFPNVKTFVRAHDVDHGLNLEKAGATAVVPETLEPSLQLAAAVLAQAKLPTSEIATTINEFRSRHLSELAELCEASGSSLGYGFSRSTSKPKPPSPSETSDDNQIIEGTLAI

SEQ ID NO: 39504 - protein, 540 aa, Ralstonia metallidurans CH34
MSFSELGLSDKLVRAVAEQGYTTPTPIQAQAIPAILKGGDLLAGAQTGTGKTAGFTLPMLQLLSETAARANGGNAPRGARPNVRALVLTPTRELAAQVEESVRNYGKYLKLRSMVMFGGVGINPQIEALRRGVDIVVATPGRLLDHVAQRTIDLSHVELLVLDEADRMLDMGFIHDIRKVLNVLPPKRQNLLFSATFSDDIRALADRLLDNPASIEVARRNTTAETVAQRVFPVDRERKRELLAHLVRQHDWHQVLVFTRTKHGANRLAEQLTKDGLSALAIHGNKSQSARTRALTEFKAGTLRLLVATDIAARGIDIDQLPHVVNFDLPNVPEDYVHRIGRTGRAGAEGEAISLVCVDEHGLLRDIERLIKRQIEQVLLPGFEVDPSIKAEPIQKGRQQQRGGQPRGNGQGNAGNGGERRQPRAAQGERQEAPRQPRPAQPARGEARNGNAGGSGNAPRTGQGGGRGNGHANSTAKGTAKGTAKGNAQGNAQGNANARGANPRPQQARPAQDNTAAPPARNRRPAPQAALLGGGRKPAH

SEQ ID NO: 39505 - protein, 442 aa, Ostreococcus tauri
  misc_feature (442)..(442): Xaa can be any naturally occurring amino acid
MTRVAVFALALSSALLARADAGEETAVDHIIEVYDEDANGLIDASELSELFERFAARVGDGAGGSAHAGHAGHAEEHAGHDDEETLTEVTSAGVIAAYAGLDKMLNETELTQALTLVARCAAETGCALVASEATEAVTKKEKYFSLKVGLVFAIFAEGLVGGMLPMMVTMTLPKVQHALEFMNSLSGGVFLASGFVHLIPHALEAATEAKIGTKDEYPFAMAMVVLGFLIAFFIERVLFHAHSHVVETETTGHGHGHGHGHGHDKDVEKVPEVDPLACNDCHHEHGTSIFIQTRKALVFMTGVALHATLAGVSLGLQTSKSSIYAIFIAISAHKAAAAFSIGCAFLRCGVTRISTLLAFMTFFACITPIGIAIGIAAGTKDNASVRAVLEGIAAGTFVYIGTVEVIGDEFETTTESCTDEHGHDHKVPTHTHVVHEAPRRSX

SEQ ID NO: 39506 - protein, 552 aa, Ralstonia metallidurans CH34
MKARKAGRSDNAREATGNDAEMGEGCPLHWFDADLGAFDDLERRVAEHPADFFAGQDFDPVGACATREASFASVQIPEDPTAPQQHADHLLNDVFRHVMPVASPTFVGHMTSSLPSFMPSLAKIVAALNQNVVKLETSGALTGLERQVIGMLHHLVFARDDAFYAQWLHNAEHSLGAFCSGGTTANLTALWASRNNTLRARDGFAGINQAGLVAALRHYGYAGLAIVVSERGHYSLRKAADILGIGRENLVPVGVDEDGRMRVDLLRDTLRDLQQRNIRTVAIVGIAGTTETGAVDPLDAIADVAQEIGCHFHVDAAWGGATLLSARERARFAGIERADSVVIDAHKQFYVPMGAGMVLFRDPAWTQDIIQHANYIVRKGSVDLGRHTLEGSRGSAAVMLYANLHLLGRKGLAKLIDTGIDNAKYFASLIEQQPDFELDSRPQLCILTYRYVPAPVRAALLSASPEQREQLLEALDALTINIQEMQRDAGRSFVSRTQLTSSQWGGRPIAVFRVVLANPDTTHEILQSLLEEQRGLAKQSPMLPALMAMVGG

SEQ ID NO: 39507 - protein, 799 aa, Oryza sativa
MMEADMENGRLYPERPRTFSTVRTKSSLPPIFRVLMRINPRAFIVLLLLVFSGVLYVGASTSPIVLFVFCICTLSLFFSLYLTKWVLAKDEGPPEMSEISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTNLPLLLVGYGFGASFVALFAQLGGGIYTKAADVGADLVGKVEQGIPEDDPRNPAVIADLVGDNVGDCAARGADLFESIAAEIISAMILGGTMAQRCKIEDPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGRPLLGAKVVAAMLMFATVSGILMALFLNTAGGAWDNAKKYIETGALGGKGSESHKAAVTGDTVGDPFKDTAGPSIHVLIKMLATITLVMAPIFL

SEQ ID NO: 39508 - protein, 439 aa, Debaryomyces hansenii CBS767
MSLYSSIDEKEFWLKSKSLLPYGGVFTPAIITKAKGVYIYTHDGKRILDFTSGQMSCLLGHGHPEISKTITEHAFNLDHLFSGMICPPVVNLAHMLTGILPDGLDKAMFLSTGGEANEAAIKLAKICTGNFEVVGLSLSWHGMTGASNATTYQSGRSGQGPMIPGNLVLPAPNGYRSIFRKPDGSYDWETELDYGWSLIDSASVGSLAAVIVEPILSSGGMLVLPDGYLRAMKKHCEKRGMLLIVDEAQTALGRCGSMFAFGDSGVIPDILSLSKTLGNGIPLSAIVTSEQLSERGNKKGFLFYTTHVNDPLPAAVGLKVLEVIIRDNLVDKARIMGNIFKSELDKFKQEYNFIGDIRGKGLMVGIEIVKNRQTKESDPDLAKVLADKMMELGLSANLIAVASFGGIFRIAPPITITEEELRHGLSIMNDAFRAIRNQL

SEQ ID NO: 39509 - protein, 150 aa, Zea mays
  misc_feature (26)..(26): Xaa can be any naturally occurring amino acid
  misc_feature (53)..(53): Xaa can be any naturally occurring amino acid
  misc_feature (65)..(65): Xaa can be any naturally occurring amino acid
  misc_feature (96)..(96): Xaa can be any naturally occurring amino acid
  misc_feature (110)..(110): Xaa can be any naturally occurring amino acid
  misc_feature (128)..(128): Xaa can be any naturally occurring amino acid
DQCTLRLTSVLEPIDSSVRDLPRLPXPRSLCQDITTMVINTKAIRDSIDLFVXERKHWRITASSXEQHTGVILGHDIPLPLVSTLVPLGTPTDTAXDAISQEDSVEYRTXDILLLHARRVPPKMSVMXVHDLIATGGTVCAARELIGRDG

SEQ ID NO: 39510 - protein, 533 aa, Arabidopsis thaliana
MVFSRDIPSPASMFSTYASMMGYVMIIKPMINTIIPRPVQNFVFSYLKSFAGSRSSTLTLTIDQMSSMYIPDELYAAAQAYLSTKISPNSVRLIMARDPAEKKVKLYLSDGEVVSDVYNGIKLKWRFLARNKNNTMVEEYGQSYQGNIQRESLELSFDKKHRDLVVNSYIPYVESKAKEVNNKRRILKMHCYSHMAQTWQSVNFKHPSTFDTMAMNDDLKRSMIEDLDRFVGRKDFYKRVGKAWKRGYLLYGPPGTGKSSLVAAMANYLKFDIYDLQLASVQGDAHLRSLLLATNNSSILLIEDIDCSVDLPTRLQPPTETSQPLGAVQVSKPLTLSGLLNCIDGLWSSCGNERIIIFTTNNKEKLDPALLRPGRMDMHIYMGHCSFQGFKTLASNYLGLSDENDDTHPLCPDIKHLIDGHVLTPAQVAEELMKDEDADAALEGLVKVLKRKRLEPKKCDDESKMKKLKEGEEAIADAELAVLTPAQVEDKEELVASEYANVMPEWLPRSRLVMVLPGFHRARGIRRGLGDEM

SEQ ID NO: 39511 - protein, 287 aa, Streptomyces sp. C5
MTVPTPRHGTPHGGLPGRTVLITGATSGIGRAAALAIARQGARVVLVGRDPERLRTVTNEVARTAGPAPDAFRADFAELRQVRELGERLRDRYPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 39512 - protein, 242 aa, Yarrowia lipolytica CLIB122
MASWDDEDFEVPAAATPAVPANWDDDEEEDVMDSWDAEEPTKAPGPKTTVAAPKKAQRQQIAKIEREMAAMKLKPEDASTKRDRQRQAELDSDMMNASELFGGTGGIADSAAKAEAAPAPAAPAAPMKLSDLAIFHPKEKKDFTNLKETLAPILTDLNKTSPLAYPDFAITFTKALAEPLKVEQLRKLISTLNAYQNEKIREEKAARGKKKKPGLAAASAKINDDKDTSTFNDNFDDFDDFM

SEQ ID NO: 39513 - protein, 319 aa, Haloarcula marismortui ATCC 43049
MTELVTFGETMLRLSPPGDERLETADQYAVRAAGAESNVAVAAQRLGVDAMWASKLPDSPVGRRVTGELKHHGVSVDVAWDDSDSARQGTYYLEQGSPPRGNDVIYDRQNASVTTATPAELPTEAIADAAGFHTSGITPALSETLESTTADLLSLAQDAGTTTSFDLNYRSKLWTPAEARSVLTELFPSVDLLVVAERDANVVLDRTGDAETIARDLAAEYGFEATVITRGSDGALALADGTVTEQPTFESTDAHPVGTGDSFVGGFLSQYLSGGTVADGLAWGAATAALKRTIPGDIAVVSPDEIRSILSGDTEAISR

SEQ ID NO: 39514 - protein, 305 aa, Symbiobacterium thermophilum IAM 14863
MRHLFTFGDLVLDVVATASSALEADTDTPGDVRSAPGGSAANFAVWTRRLGSPVCFATRVGDDLLGRALVDDMRREGVEVHAAVDPVYPTAVLVLFSDGVQRHMMVPRGANHFFGPGDLPEERIRTAGWLHATGYAFFWDSTREALQRALAVAREAGVPVSFDPSSAGFIRRHGLDLPEGIRVLMPNRDEARALTGCADVKDAARELARRADLVAVKLGPEGALLARAGQLTYVPPVAPSAPAVDGTGAGDAWGAALIDGLRRGLDPYRAALRANRLGAEVVTRVGARPALSPEIMRQLEVERDA

SEQ ID NO: 39515 - protein, 443 aa, Zea mays
MENSYPISMYPNPAFCYFVTLSSITGGLDSKLAAWDFSKGRTLFSIDYVAVSEEGILGGLYKVCAVARGDGAVDVVDLEYELAPAKSKGPPRAAILTTRSKGAELGDGSCNQSRAKRIHLDYTMGGHTAAVSCVAFSAFGEKGKFLISGGNDASVKLWDWSKGFYSETNSKVDLVLDIDVKKKSETLSGCKLLLYPLEQEEEEGSSKLASLPAIAKKVLSYEEGIYAKLSRKWIEAGLRTVSIGRQEPGGFAAVLWRRREMGGLLLPHHRTFPNSLQASIPGPLSLHKGDRKNLHYFAPDVHLFCSLRQGFPRSSWSAVIRSEASGDAVASPGTVIKRSKEELITFFRDIQTSIAECSRKASKRTRKQPPDLFQEVRRREEQSHGTGGGDSGTDDVSEGPRKVKSLEDMNVAGLRELARARRMRGYSKLKKGELIDRLRGATT

SEQ ID NO: 39516 - protein, 350 aa, Oryza sativa Indica Group
MENGGGDVPENANDHCPGTQSEAAGKADACAGCPNQQICATAPKGPDPGAITHLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 39517 - protein, 646 aa, Escherichia coli O157:H7 EDL933
MMSYVDWPPLILRHTYYMAEFETTFADLGLKAPILEALNDLGYEKPSPIQAECIPHLLNGRDVLGMAQTGSGKTAAFSLPLLQNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLSKIQPTAEGEELDLETLAAALLKMAQGERTLIVPPDAPMRPKREFRDRDDRGPRDRNDRGPRGDREDRPRRERRDVGDMQLYRIEVGRDDGVEVRHIVGAIANEGDISSRYIGNIKLFASHSTIELPKGMPGEVLQHFTRTRILNKPMNMQLLGDAQPHTGGERRGGGRGFSGERREGGRNFSGERREGGRGDGRRFSGERREGRAPRRDDSTGRRRFGGDA

SEQ ID NO: 39518 - protein, 287 aa, Nicotiana tabacum
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAIFYIVMQCLGAICGAGVVKGFMVGPYQRLGGGANVVNHGYTKGDGLGAEIIGTFVLVYTVFSATDAKRNARDSHVPILAPLPIGFAVFLVHLATIPITGTGINPARSLGAAIIYNTDQAWDDHWIFWVGPFIGAALAAVYHQIIIRAIPFHKSS

SEQ ID NO: 39519 - protein, 177 aa, Symbiobacterium thermophilum IAM 14863
MKRILAVLVENHPGVLARVAGLIRRRGFNIESLAVGVTDDPAISRMTLVVEGDEATLNQVSKQLDKLIEVIQVADLDAEHSVAREMALIKVSVDPQRRPQVLQLASVFRASVVDVGHEAVILEVTGTHDKVEALISLAQEFGVQEVARTGIIALARGAQSMTAPREERYDDAAVLRV

SEQ ID NO: 39520 - protein, 283 aa, Physcomitrella patens subsp. patens
IDAFTDQPFSGNPAVVCYIPYERDDRWLQTIAREFNLPATAFLVKRQNEFDLRVFTPTYEVVFCGHGTLASAHLLFTSGIVEGDIAVFHTKSGILKAKKVSGYEEYEQSSAAEESGAQRKPSSKGVIELDLPLAPPSVCNDMSFLSEALGGVEVKWVGRSNLGDYLLELESSEDVVNLTPRFERMLDFPGRGGVIVTASAAGSSEYDFVSRFFCAKMGLNEDSATGSAHCTLGPYWASKLGKTELNAYQASVRGGKFKVRVDEDAGRCYLLGDAVFIMGGVLL

SEQ ID NO: 39521 - protein, 213 aa, Brassica napus
MAMANWARRKAYLLTRNISTAPLRSSFSLSRGFASSGSDENDVVIIGGGPGGYVAAIKAAQLGLKTTCIEKRGALGGTCLNVGCIPSKALLHSSHMYHEAKHVFANHGVKVSSVEVDLPAMLAQKDTAVKNLTRGIEGLFKKNKVNYVKGYGKFLSPSEVSVETTDGETTVVKGKHIIVATGSDVKSLPGITIDEKKIVSSTGALSLSEIPKK

SEQ ID NO: 39522 - protein, 271 aa, Brassica napus
MGVIEEAHNVKVLGSGNKGTIVLGHGFGTDQSVWKHLVPHLVDDYRIVLYDNMGAGTTNPEYFDFDRYSTLEGFAFDLIAILEDLQIESCIFVGHSLSAMVGVLASLNRPDLFYKIVMISASPRFVNDVDYEGGFEQEDLNQLFEAMRSNYKAWCLGFAPLVVGGDLDSVAVQEFSRTLFNMRPDIALSMAQTIFHSDMRQILPFVSVPCHIVQSVKDLAVPVAVSEYLHNNLGSESVVEVMSSDGHLPQLSSPDSVIPVLLRHIRNDIAV

SEQ ID NO: 39523 - protein, 362 aa, Zea mays
  misc_feature (114)..(114): Xaa can be any naturally occurring amino acid
MPEAEWNDEHTRIVCELFEEQVRAGNRPNTHLNNIGYRQVAAKFQQRTELLYTKLQLKNKWDKFKNDYITWRKLLVVGKGLPWDTAKGTFVADEEWWKKINKELPGARKFRHGXLHHEDKLNVMFDYITSNGVDPSPPAPESPKNGVNHSPPAATGLPSAPDCTLNGVDHSPVTAHGLPSGPYSPMNGMDQLPLPTHDLRSVQEIPMNGVNLDGLDNNTEDNDDIYQEPVFQYTSNRKKRPISFSATKKNKKNKAETALLMQAHLYRITELAQKAQDTFKKFSSQADLVPWPSIQDVMTLVWGCGARCGSNEHFIATELFVSREQREMFLTMETAEERFQWLRRKYIVKYLSGTTSTNLGTR

SEQ ID NO: 39524 - protein, 159 aa, Streptococcus pyogenes str. Manfredo
MKVKLICVGKLKERYLKDGISEYQKRLSRFCQFEMIELTDERTPDKASFADNQLIMSKEAQRIHKKIGERDFVIALAIEGKQFPSETFSELISGVTVKGYSTITFIIGGSLGLDSIIKKRADMLMSFGLLTLPHQLMRLVLTEQIYRAFMITKGSPYHK

SEQ ID NO: 39525 - protein, 297 aa, Triticum turgidum subsp. dicoccon
GFLGLSGAILVQVQRTLHIDPGSFILMLAILPTAIVLLLMYFVDVHSAHQRYNKKFLDAFSLMAVTVAGFLMVVIICDQVFMISSAGQSVCFAILLLLIMSPVAIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 39526 - protein, 1292 aa, Oryza sativa
MSGLDLREMLSSAARRHTWRRSGWGAEWGGGDDARSAALPARCPPPPPPRRPAAAGGRGDEGSGGVRGRGEEGTSRGGSGARREDAAGTGRNAVAVVAGGSATSGAERVAARAEDGRRSMDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGPLVAKEKRNGGGELGTKRGLEKRAPLPPPKRRVVSAKRQFPPDFGRDSAVPLGRGRGRGGGVRPSDGAPARAVLGEKVASAGNGDSMANVHHHAVMDTVLMKSSHASDENLVAFKVGSPENGAEGAARGKGAHNGELLGKREVLAQAVNLLPMRRTVSATHRFTAGCGRDAAAPLARREEGKVGSGLEVMPVDVGGGVSKEVMATDGSKHSVNQCTANIVGAVGVLDGTVQYQELEEGEVADEAYCDVESQKVVGCDSFDDSAGERHEGVVPVTFAVTEVLTSHAYDEMMQIKALQEGGSDAAQETEHDLPMGGKCETILPDASPKCSFGGPSNEIVHGKRVLGSHGMKGEVPSLAIEDHGGIAQIDQELEDVEMTTGEYRVQDAQIATHVIPHESTTGRHEGGLCASAAAEDVKVMNKYKGTLPKAAAKSSMNIATGVFGDGIMRSKILSTARKVVKPPVRASHKPPLNTLHRPFSTNSASFGHKKLKVKRPDQSKDIPMKIASTSGLAGKDNLTDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFQYISRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 39527 - protein, 388 aa, Ralstonia metallidurans CH34
MNIHEYQGKEILRKYNVPVPRGIPAFSVEEALKAAEQLGGPVWVVKAQIHAGGRGKGGGVKVAKSIDEVKTYATNILGMTLVTHQTGPEGKKVNRLLIEEGADIKKELYVSLVVDRVSQKVALMASSEGGMDIEEVAAHTPEKIHTLIIEPSEGLKDSDADDIARKIGVPDASVPQARQALQGLYKAFWDTDASLAEINPLILTGDGKVVALDAKFNFDSNALFRHPEIVAYRDLDEEDANEIEASKFDLAYISLDGNIGCLVNGAGLAMATMDTIKLFGGEPANFLDVGGGATTEKVTEAFKLMLKNPNVQAILVNIFGGIMRCDVIAEGVITASKAVQLGVPLVVRMKGTNEELGRKMLADSGLPIISADTMEEAAQKVVAAVAGK

SEQ ID NO: 39528 - protein, 429 aa, Malus x domestica
MKCFNYFKDKARRREQRSAPELKEETKSDYSGGGDRVIKSTCSANSPRGIPEMYEEKAHNLRAFTFAELRQATNDFSRLLKIGEGGFGNVYKGSIKAADDKGSDPVVVAIKKLNNDGLQGHKQWVAEVQFLSVVEHPNLVKLIGYCAVDGERGIQRLLVYEFMPNRSLEDHLFNKVYSTVPWETRLQIILGAAQGLAYLHQGLEVQVIYRDFKCANVLLDDNFKPKLSDFGLAREGPMVGHTHVSTAVVGTYGYAAPDYIETGHLTAKSDVWSFGVVLYEILTGRRSLERNRPRREQKLLEWVKQFPCDGKKFGLIMDSRLENKYSITAARKIANLAESCLSKSAKDRPTMSQVVDKLKQIIQDSEEGIPSDRSPESVENDQADSVTKPRQLEASESWQRRMAHLAKLGEHVESASRRRFMIMQRARVT

SEQ ID NO: 39529 - protein, 610 aa, Haloarcula marismortui ATCC 43049
MNAVNCGSPDAEVTMRSAKIVCTLGPASDSVDDIASLAKAGMSVARLNASHGSPEHRREMIDRIRQVDEAVEEPVAAMLDMPGPEVRTAEIDEPIQLTEGSTIRYVVGDDATPEEVGLSQSITAVEPGDRVLLDDGRIETTVERVEDETVFATVENGGELAARKGVNVPGVELDLPTITENDEQELDVAAEKEPDFVAASFVRDGEDIYEISQALEERGVDIPIIAKIERAGAVENLDSIIDEAYGVMVARGDLGVECPLEDVPIIQKRIIRRCHEAGVPVITATEMLDSMVHSRRPTRAEASDVANAVLDGTDAVMLSGETAIGDHPARVVETMDRIIRDVEGSEEYAESREQRVPNAGDTRTDALARSGRFLARDIGASAIVAASESGYTALKSAKYRPSIPIVASTPSERVRRKLALSWGITPVTTEYTTEGADAVIQTAVQAALDTEAADSGDTVVVLSGMMTELEGMNTANMLKVHVAAETVASGRSIVDGLVTGPVHRISTAPPRESPGDLSNVPEGAILAVPEGFDGEFVGDTSRIGGIIDGHEGVTSYAAIVARELSIPMISNADLPDAVSDGSTVTLDSERGVVYEESVGREDISGRERDY

SEQ ID NO: 39530 - protein, 418 aa, Daucus carota
MFGRAPKKSDNTKYYEILGVPKTASPDDLKKAYRKAAIKNHPDKGGDPEKFKELAQAYEVLSDPEKREIYDQYGEDALKEGMGGGGGGGHDPFDIFQSFFGGSPFGGGGSSRGRRQRRGEDVIHPLKVSLEDLCNGTSKKLSLSRNVICSKCKGKGSKSGASMTCPGCQGSGMKVSIRHLGPSMIQQMQHPCNDCKGTGETINDKDRCPQCKGQKVVQEKKAIEVIVEKGMQNGQKITFPGEADEAPDTVTGDIVFVLQQKEHPKFKRKGDDLFVEHSLTLSEALCGFQFTLTHLDGRQLLIKSQPGEVIKPDQFKGINDEGMPMYQRPFMRGKLYIHFSVDFPESLTPEQCKALEAVLPPRPSIQMTDMELDECEETTLHDVNIEEEMRRKQQAAQEAYDEDEDMHGGAQRVQCAQQ

SEQ ID NO: 39531 - protein, 126 aa, Zea mays
MTSSSSPSRKALSKIACNRLQKELAEWQQNPPVGFKHKVSDNLQRWVIEVTGAAGTLYAGEAYQLQVDFPEHYPMEAPQVIFLNPAPMHPHIYSNGHICLDGKRSPKTQQQHELAWTTDTTTTTEP

SEQ ID NO: 39532 - protein, 504 aa, Debaryomyces hansenii CBS767
MVSTNLPLEIPITLPNGIKYTQPTGLFINNEFVRSKQGNKFEVLSPSTEEVVTSVYEAREDDVDIAVQHALRAFEESSWAKADPCQRGAALYKLANLIEENFETIASIEAMDNGKAIGNAKGDVTLAISVLRSTAGFSDKMLGSVIESGDSHFNFTRREPLGVCGQIIPWNFPLLMFTWKIAPALVTGNCVVIKSSETTPLSALYVSNLIKEANLFPPGVLNVISGFGKYTGNAITEHPLIKKVAFTGSTATGKTIMRKCAESNLKKVTLELGGKSPHIIFNDADMDTTLKSVVTGIFYNSGEVCSAGSRLYIQEGIYDAFVEKFVQTTKSDVKVGDPFLPDTIQGAQNSVDQLDKILKYIQIGTDEGAKILAGGERLQGKGYFIKPTIFGDVKEDMRIVQEEIFGPVITISKFKTTDDVVRMANNTDYGLAAGIQTSNVNRAIDVSRRLKAGTVWVNTYNDFHPMVPFGGYNLSGMGREMGVEVLQNYTQTKAVRMSIIKPKD

SEQ ID NO: 39533 - protein, 494 aa, Xylella fastidiosa 9a5c
MSRKHAFQFLDLPRQMPQRIPVELRTSGDWRELYGKFDKAEAQYQAGRCLDCGNPYCSWKCPVHNAIPQWLQLVQENRIDEAAALCHATNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRKVLEGMGVEFRLGVEIGKDLGIEALLEHYDAVFLGVGAYRYTDGGLPGQDLKNVLPALPFLVQNGRIVSGNDPYGRPIAGWEDQVQLPDVTGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLPEWLTAQGIQASSNGRIVVALSDTGDGLTYQTTHPKLFAGGDCVRGADLVVTAVAEGRDAAESIVRWLRATAQVMDVAVI

SEQ ID NO: 39534 - protein, 290 aa, Symbiobacterium thermophilum IAM 14863
MCDRMTEKSSSGVNSMPVVAFQGELGAYGDEAVRARFGPSAEPYPCKSFVDLFEAVASGTVDYGLAPVENSQAGSINDVYDLLRQYDLYVAGEVLHPVNHALLALPGQTLSDIRRVISHPQALAQCDRFLRDLGVEVMATYDTAGAAKMIREQGLTGVAAVAGLGAAQRYGLAVLAESIQTIKDNITRFVVLQRDPAPREEGPQKTMLFLALAHQPGSLYMALGALANRNINLLKLESRPSRNRPWEYVFYLDFEGHRDDPHVRAALADLAKHANYCKVLGSFRRETVPD

SEQ ID NO: 39535 - protein, 233 aa, Bradyrhizobium sp. BTAi1
MTQSFTPRPLVIAPSILASDFSKLGEEVRAVDAAGADWIHLDVMDGHFVPNISYGPDVIKALRPHTTKIFDAHLMITPCDPYLEAFAKAGCDHITVHAEAGPHLHRSLQAIRALGKKAGVSLNPSTPLNVIEYVLDLVDLVLIMSVNPGFGGQAFIPSAIGKIQDLRAMTAGRPIDIEVDGGVGRDNAGALAAAGANAFVAGSAVFKGGTMEAYRGNISAIRSAAASARGEAI

SEQ ID NO: 39536 - protein, 523 aa, Streptomyces cinnamonensis
MASGSGSGVGGGRVAELREIRAEALRGPSEKATEAQHAKGKLTVRERIELLLDPDSFNEVEQLRRHRATGFGLEAKRPYTDGVVTGWGTVEGRTVFVYAHDFRIFGGALGEAHAAKIHKIMDMAIAAGAPLVSLNDGAGARIQEGVSALAGYGGIFQRNTKASGVIPQISVMLGPCAGGAAYSPALTDFVFMVRGTSQMFITGPDVVRAVTGEEISQNGLGGADVHAETSGVCHFAYDDEETCLAEVRYLISMLPSNNRQAPPTVASSDPAGRTTESLGEMVPADGSRPYDMHRVIEELVDDGEVLEVHERWARNVVCVLARLDGQVVGIVANQPQVLAGVLDIEASEKAARFVQMCDAFNIPILTLLDVPGFLPGVDQEHGGIIRHGAKLLYAYCNATVPRISLILRKAYGGAYIVMDSQSIGADLTYAWPTNEIAVMGAEGAANVIFRRQIAAAEDPEAMRARMVKEYKAELMHPYYAAERGLVDDVIDPAETREVLIKSLAMLRTKHADLPSRKHGNPPQ

SEQ ID NO: 39537 - protein, 432 aa, Enterococcus faecalis V583 [sequence omitted]

SEQ ID NO: 39538 - protein, 251 aa, Enterococcus faecalis V583
MRKPIIAGNWKMNKTLSEAQSFAEAVKNAVPSNDVVDAVIGSPALFLAPLAWNLKDSEVKLAAQNCYWENAGAFTGENSPAAIADLGVDYVIIGHSERREYFHETDEDINKKAKAIFANGMTPIFCCGETLETYEAGKTAEWIEGQITKGLVGLSNEQVASMVIAYEPIWAIGTGKSADANIADEICGVVRSTVEKLYGKEVSEAVRIQYGGSVKPENIAEYMAKENVDGALVGGASLEADSFLALLDAVK

SEQ ID NO: 39539 - protein, 397 aa, Enterococcus faecalis V583
MAKKTIKDVDLKDKKVLVRVDFNVPLKDGVITNDNRIVAALPTIKYVIENGGKAILFSHLGRVKTEEDKAGKSLKPVAERLSELLGQPVTFVPETRGKELEDAVNNMKDGDVLVFENTRFEDVDGKKESGNDAELGKYWASLGDVFVNDAFGTAHRAHASNVGIASTGIPTVAGFLMEKEIKFIGEAVENPKRPFVAILGGAKVSDKIAVIENLIEKADKILIGGGMAYTFMKAQGYSVGLSLLEEDKVDLAKSLMEKAGDKLVLPVDTVVSKEFSNDAPFHTVPSTEIPDDEEGLDIGEKTIELFANELQGAKTVVWNGPMGVFEMSNFAKGTIGVCEAIANLEDATTIIGGGDSAAAAIQLGYENKFSHISTGGGASLELLEGKTLPGLASINDK

SEQ ID NO: 39540 - protein, 333 aa, Enterococcus faecalis V583
MTVKVGINGFGRIGRLAFRRIQDVEGIEVVAINDLTDAKMLAHLLKYDTTQGRFNGTVEVHEGSFNVNGKEIKVLANRNPEELPWGELGVDIVLECTGFFTSKEAAEKHLTAGAKRVVISAPGGNDVPTIVYNTNHETLTGEETVISGASCTTNCLAPMAKALHDNFGVVEGLMTTIHAYTGDQMTLDGPHPKGDFRRARAAAANIVPNSTGAAKAIGLVIPELNGKLDGAAQRVPVATGSLTELVTVLDKEVTVDEVNAVMEKAANESYGYNTDEIVSSDIVGMTYGSLFDATQTKVMTVGDKQLVKTVAWYDNEMSYTAQLVRTLEYFANL

SEQ ID NO: 39541 - protein, 427 aa, Coccidioides immitis RS
MLTTLRIASRSAATKEAGVRVLAYRQACTWANVPQGPPDAILGITEAFKADSFKEKINLGVGAYRDDQGKPYVLPSVRAAETKVVNSKLDKEYAGITGVPSFTKAAAELAFGADSAAVKEGSIAITQSISGTGALRIAAAFLERFYPHAKTVYIPNPSWANHAAVFKDSGLEVEKYRYYNKDTIGLDFEGLIADLKAAPAQSIILLHACAHNPTGIDPTQEQWLQISEVMKQKGHFAFFDMAYQGFASGDINRDAFALRHFVSQGQPVVLAQSFAKNMGLYGERVGAFSVVCESAEEKQRVDSQIKILVRPMYSNPPIHGARIASTILNDPTLNQQWLGEVKGMADRIIEMRALLKKHLEELGSKHDWSHITSQIGMFAYTGLKPEQMEKLAKEHSVYATKDGRISVAGITTGNVKRLAESIYKVTG

SEQ ID NO: 39542 - protein, 322 aa, Oryza sativa
  misc_feature (279)..(279): Xaa can be any naturally occurring amino acid
MADLDFFHTVQWRRAGIGRRWFATEASAASTAAELVDVPLAQTGEGIAECELLRWFVTEGDQVDEFQRLCEVQSDKATIEITSRFKGKVHQIHFGPGDIVKVALGFFFNLNRVDAANPSGEGSVPSGTLSTPAVRHLAKQYGLNISDIQGTGKDGRVLKEDVLSYAASKGLCKEPTSALEENIDQVELLEGRGSLPDANSYEDRRISLRGYQRSMVKSMTLAAKVPHFHYLEEINCDALVELKASFQNANKDHTIKHTFLPFLIKSLSKALSKYKASFXPLLNSCFVEETNEVIFKGSHGTRVAMATEHGLVVPNIKNVQSL

SEQ ID NO: 39543 - protein, 572 aa, Coccidioides immitis RS
MTHPYIPMTLHKVMAATRASSDALFSLSNLDLVRNLVFIVFLLRLSRRSFYTIRGQGFIGTICNIYHKAHLTLYSLFLRAPGVRGQVDKQVSSAISKLESKLAPQGPGIVKYNKLPAQGWSAEQVHAELDRLAGMEHTMWEEGRVSGAVYHGGEDLLKLQTDAWGQFAVANPIHPDVFPGVRKMEAEVVAMVLELFNAPEGGAGVTTSGGTESILMACLSARQKAYTERGVTDPEMIVPITAHAAFNKAAQYFGIKLHSVPCPAPNYTVHIPSVRRLINPNTILLVGSAPNFPHGIVDDIPALSRLAVSYKLPLHVDCCLGSFVIAFLKKSGFPSPYEEQGGFDFRLPGVTSISVDTHKYGFAPKGNSVVLYRDRVLRSYQYFILPEWSGGVYASPSIAGSRPGALIAGCWSSLMAIGESGYKDSCHQIVSAAKKFETSIREDPVLSRDLKVIGEPMVSVVAFATTTAEIDIYDIADAMSAKGWHLNALQNPAAMHVAFTVPTANAVDHLTADLTEVVEIERAKADERKRLGQKVEKERGDTSALYGVAGSIPDKSIVSRLAEGFLDTLYLS

SEQ ID NO: 39544 - protein, 403 aa, Arabidopsis thaliana
MAKRRSWFGWMKRLFICEAKARAEKPRRLRWVFKRLKLRPQLATCGQETRTLNEATQDQRKHAMNVAIATAAAAEAAVAAAKAAAEVVRMAGNAFTSQHFVKKLAPNVAAIKIQSAFRASLARKALRALKALVRLQAIVRGRAVRRKVSALLKSSHSNKASTSNIIQRQTERKHWSNTKSEIKEELQVSNHSLCNSKVKCNGWDSSALTKEDIKAIWLRKQEGVIKRDRMLKYSRSQRERRSPHMLVESLYAKDMGMRSCRLEHWGESKSAKSINSFLIPSEMLVPTKVKLRSLQRQDSGDGQDSPFSFPRRSFSRLEQSILEDESWFQRSNGFQPYMSVTESAREKMRSLSTPRQRVGIMDSLFDNYKKDGDKVSLWSTFVCENSKINNAKKSSLTTYQHNC

SEQ ID NO: 39545 - protein, 105 aa, Zea mays
IKSKNVDVNVKDEEGRALLHWACDRGHKELVTVLLQHRADINCQDNEGQTALHYASACEFLDIVELLLQSGADPTLRDQDGCLPEEVTGCKTVSLVLQRHTTGKA

SEQ ID NO: 39546 - protein, 748 aa, Vibrio cholerae O1 biovar eltor str. N16961
MLSQLRDIVEQVSKVEDVYQALDIFVKQTCEAMSTECCTVYLANEEMHRLELMATQGLKFKGDKIHIDFDEGLVGLVKRSAEPINLAEASKHPSFKYFKQLGEEVYHSFLGTPIIYRKQVLGVLVVQQKSPRLFSEMEVSFLVTLAAQLAVLVAHAQTQGHWRLSKKQQAITGVAASSGVAIGEFWWDDTQPDLSEVLPASALDPDFEQERIALAVENALADFRRMRKKLDGDINKEALAIFDLFTHLLNDPMLRKDLKAQIQKGDRADWALRQVVESYSNRFARMSDVYLRERAQDIRELGQRLLFFLLNTETNQPKIDKPVILVVRELTASVLAALPKDKLLAVVSLEGAANSHAAILSRALGIPAVMGVSINLRDLNGKKGIVDGYSGKLFISPSKTILNEYRALANEERELSRMVNEAIREPACTLDGARIELLLNAGLSADTSIAVNQGVDGVGLYRTEISFLLQHRFPSEEEQTQQYRHVLNTYPHQRVVMRTLDIGGDKPLPYLPIEEDNPFLGWRGIRFTLDHPDIFIIQLRAMLRASAESGNLSILLPMISGAKELDDALKFIYQAYQEVSQQDPRVVMPQIGIMLEVPSMLYLLPLIADKIDFVSVGTNDLTQYLLAVDRNNARVADVYESMHPAVVMALKQIQQTCATHQIPVCVCGELAGDPIGALLLIGLGYTTLSMNTSNVAKVKYLVRHSELAELTQLAEQALTQPYGREIYNMMLAYIEKHGFAGFVRAGKK

SEQ ID NO: 39547 - protein, 297 aa, Triticum turgidum subsp. dicoccoides
GFLGLSGAILVQVQRTLHIDPGSFILMLAILPTAIALLLMYFVDVHSAHQRYNKKFLDAFSLMAVTVAGFLMVVIICDQVFMISSAGQSVCFAILLLLIMSPVTIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYTSRETSTLVSLWSIWNFSGRFGAGYVSDHFLRSRGLGRPFLIAATLLVMGVGHAIISSGFHASLYVGSVLVGLCYGSQWALMPSITSEIFGL

SEQ ID NO: 39548 - protein, 297 aa, Triticum turgidum subsp. dicoccoides
GFLGLSGAILVQVQRTLHIDPGSFILMLAILPTAIALLLMYFVDVHSAHQRYNKKFLDAFSLMAVTVAGFLMVVIICDQVFMISSAGQSVCFAILLLLIMSPVAIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYMSRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 39549 - protein, 266 aa, Brassica napus
  misc_feature (146)..(146): Xaa can be any naturally occurring amino acid
  misc_feature (167)..(167): Xaa can be any naturally occurring amino acid
MIPFLTIASTLFLSSVIAADEAFPSIPTTFHVAMTSSDDLKPIRQEVYGERKIFDITHRYTQDMPVWESTEGVKPFLRLTTSMKNQSLSNTSEMKLSVHTGTHLDAPGHFHDKYYDAGFDSDSLDLQVLHGPALLVDVPRDKNITXVMKSLHIPKGVRRVLFRTLNXDRRLMFKKEFDSSFAGFMMDGAKWLVENTDIKLIGLDYLSFAAYEEAPETHKFILGERDIIPVEALKLDGVEVGVYSLHCLPLRLPGAEGAPTRCILIK

SEQ ID NO: 39550 - protein, 297 aa, Triticum turgidum subsp. dicoccoides
GFLGLSGAILVQVQRTLHIDPGTFILMLAILPTAIALLLMYFVDVHSAHQRYNKKFLDAFSLMAVTVAGFLMVVIICDQVFMISSAGQSVCFAILLLLIMSPVAIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 39551 - protein, 505 aa, Ashbya gossypii ATCC 10895
MVLPRVYAASSRAALQAARRAAPFHGARCLATAAASEGKVRAVIGAVVDVQFEQGNLPAILNALEINTADGKLVLEVAQHLGENTVRTIAMDGTEGLVRGERVVDTGAPISIPVGRETLGRILNVVGDPIDERGPINSKTRMPIHADPPAYVEQSTEAEVLETGIKVVDLLAPYARGGKIGLFGGAGVGKIVFIQELINNIAKTQGGFSVFTGVGEKTKEGNDLSREMRETGVINLEGESKVALVFGQMNEPPGARDRVALTGLTIAEYFRDEKGQDVLLFIDDIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDASVVGQEHYDVATKVQQTLQAYKSLQDIIAILGMDELSEQDKLTVERARKIQRFLSQPFAVAEVFTGIPGRLVRLKDTIASFKAVLEGKYDHLPENAFYMVGGIEDVVAKAEKLAAEAN

SEQ ID NO: 39552 - protein, 415 aa, Shewanella sp. ANA-3
MTHSASTDTALPDSHNQIRAQFPTLSQMLGDYPLCYLDTAATSQKPQSVLDAMAQYYLNDNANVHRAAHQLSARATSSYEKVRDDLQGFINAKRREEIIFTHGTTESINLVAYGLTPQIAAGDLILIDTAAHHANIVPWQELAKRTGAIIKPIPLDQDGRLDRHAYQALLTLKPKVVALCHVSNALGTVNPVVELVQQAKAQGALTLVDGAQAVAHLNLDMAAIDCDFYVFSGHKMYGPTGIGVLYGRFDKLDTLTPLLTGGEMIKRVSFDGTEFGSLPNRLEAGTPPISEVIGLGAAIRFLQQHLTPAVQAHEAELLQYLQQQLRALGDVHLYAAHSDNLGAVAFNLGDEHHQDVGILLDQQGVAVRCGHHCAMPLMQSLNLKGCCRASIGIYTNKADIDRFIAALASVKELLL

SEQ ID NO: 39553 - protein, 578 aa, Shewanella sp. ANA-3
MSFSSLGLSAPIQKAVTEQGYDTPSPIQAQAIPAVLTGKDVMAAAQTGTGKTAGFTLPLLELLSKGNKAKAGQIRALVLTPTRELAAQVSESVETYGKYLPLRSAVVFGGVPINPQIQKLRHGVDVLVATPGRLLDLEQQKAVKFNQLEVLVLDEADRMLDMGFIRDIKKILAMLPAKRQNLMFSATFSDEIRELAKGLVNQPVEISVTPRNAAANTVKQWICPVDKNQKSALLIQLIKQEDWQQVLVFSRTKHGANRLAKSLIQAEISAAAIHGNKSQGARTKALADFKSGEVRVLVATDIAARGLDIDQLPQVVNFDLPNVPEDYVHRIGRTGRAGALGQAVSLVSSEETKLLRDIERLINRVLERQEVEGFSPVHTLPESTLNAHGKENKIKAVASQRKHRSAGKPAPRAGSGRDGRKTPAPKTADNGDLAQQKGQNAQPNSSQRNNQGQRSHQGQRNQHQEQRNHQGESKRPQAAKNAEHKNAPATAEQARSPKPQDKYPQRSKGPANSSNSEHKANREHKAKGQSHSGSQQRSQEARHHEGSSEKTNQGLRRQGKPQGRVQQSTNSAANAPKK

SEQ ID NO: 39554 - protein, 282 aa, Physcomitrella patens subsp. patens
MACAAAASGVTLPAGNIAHARPAAFSSSASGASSSLSVRKSFSGLSKSFAARLAATNAPTGKAASAAGVKIASQKRGVITASAQDSYEPLIGNVAPDFEAEAVFDQEFIKVKLSEYIGKKYVVLFFYPLDFTFVCPTEITAFSDRYSEFEKLSTEVIGVSTDSVFSHLAWIQTDRKAGGLGDLHYPIVSDITKKISRSFNVLIPEQGIALRGLFIIDKQGVIQHATVNNLGIGRSVDETLRTLQAVQYVQDNPDEVCPAGWKPGEKTMKPDSKLSKEYFEAI

SEQ ID NO: 39555 - protein, 507 aa, Physcomitrella patens subsp. patens
MSGASGSSEDLHDEEQVDIDGAVDLDEEVDDASAEHEDEEEVEEEKAQGLDLDIDVEAQEGDDSQEDQDIDVLNGDHDHGITEADLAAAEETDAHVGADVAIVEDKEEKDAEKSGDLLKRPPHGSEIFVGGITRDTTEEDLRTLCSSCGDVYEVRLLKDKDTGQNKGYAFVTFLNEECAEKAIETLNDSEVKGRKLRFSQSQSKHRLFVGNIPKTWEKEELESVLSEQGPGIQSVELLKDPKTPGRNRGFGFVEYYNHACAEHARREMSKSSFRLGTNAPTISWADPRSGPDVSAMSQVKVVYVRNLPDSVTEEQLQKLFERHGEIVKVVLPATKPGQAKRDFGFVHFSDRAQALKAIEKTEVYELEGRILETSLAKPPAEKRAAGGEPAYPPQRAGLLPQHQNRSGYGYGGDVYNSVGGAYGQPRGYNQPIIYGRGLAPAGMTMVPMMLPDGRVGYVLQQPSGGQGGPAPYRGGRGSHGLLPFRHGGGSGGSAASGAGGGRRYRPY

SEQ ID NO: 39556 - protein, 753 aa, Ashbya gossypii ATCC 10895
MSQEGSAKRADFKYKIGKIKHTPPVLKDVRSGLEFIELEKRDDEKVYGVTKFLGNYKEEKKLGQGTFGEVYRGVHLATQRQVAMKKILVKTENDLFPITAQREITILKRLNHRNVVQLIEMVYDYPPAQNGAAYGQDSSQASASADTMKSFYMILPYMVADLSGILHNPRVTLEMADIKNMMLQILEGINYIHCKKFMHRDIKTANILLDHKGILKIADFGLARNYYGAPPNLKYPGGAGTDAKYTSVVVTRWYRAPELVLGDKNYTTAVDIWGIGCVFAEFFEKRPILQGKTDIDQGHVIFKLMGTPSDSDWQLARYLPGAELTRTSYEPTYKERFGKYLTEKGLDLLSTLLSLDPYKRLTAMAAMQHPFFSEDPLPKLQLTLPCEESHETDIARYGQEMQKTVSNLPPAAPSGHAVEQSQTQQQSSRHHQSQPYQSLPPQKSSQPHPQQIPEAAPVQQPSQQPPQEPSAHQQQYSSRGPQQHRTTPAPTSLPPKPKPAPPGARYNREAPPQNKPVKPLTRHLGAQYQHNNYGNYYNHWQGGERYYETYNDGYPHADRYSDDTHYNGYGYRSRGYQRYDMRREGESRYNQRPYAPQQGAAYRPNRRDTYKLVDRTGQPYPPERVPNPELHPSPAPRPKRTLTNTTQLSSHSSAATGSTAASGSAVSNSSEPVRRSSTASLDNSESGNILQQKPPPPVANPLEARIYGRDEVQSNHPGGRLYPRSTPDSKNSEGAAPSEASTDPTKRNIVDYY

SEQ ID NO: 39557 - protein, 402 aa, Physcomitrella patens subsp. patens
METANLKEKFSAFGEKVKTGSGELSRKMSERMSTVSDKMKELFQVPTHADKLVEDATGENMELADWEKNLEICDLISMEKVSGQDAARAVKKRIMLKNAQIQYLALMLLETMVKNCEKMFSEVASEKVLHEMVRMVDDRSTSTANREKALKLIEAWGESTEELRYLPIFEETYKSLKSRGIRFPGRDEESLAPIFTPPQSVQTSNTAGSGGFDGSVHSRDMSGFVAHDVSSTDFKEVFDVARNSVELLNTVLTSSPQQEVLKDELTLTLVEQCRSCQIKVQRIVERTSDGDPVLFEALNVYDDLQRVLTKFEEMSKGTAEQPQPAEATFVHVQALDDDYSCGTAEEATLVRKRDSKPSIPLSSAHDDTAMADLDEMIFGNRSEAEGSRQKSKKQNADDLIMF

SEQ ID NO: 39558 - protein, 510 aa, Arabidopsis thaliana
MVNLFLSEPKWNDDAQKSSNINVILPLLNKLGSQIQSLVTHGARSEARLWLCSALSTISISPSKQLNIFMKLLRSKPRKMQFLSQVLTMMFEKRPRKLGFLLAKRSYILEKFFEGNQKRILEWFSEFAYDGGSDHKRGAKALAQFAFANRDICWEELEWRGKHGQSPAVVATKPHYLLDLDVERTIQNFLDNVPEFWSSNEFAESLKDGQILFLDTKFFIDLFIRFMYEEDMYDVWDAVEEFLREESFSSLTQHLLITLEERDLCRFLELLGNYFEPGIESWDSGDSSRWLGVLLSRYVDTESIDELLLLSSIINQGRQLLRLVRDENGNDEGELLKETMAEICRGLENESSFSVILRELSKMKHIQVIKLLGLLSWTIHFRLSEECQTPDSWELLFRENGIEFRRSSDHSLLSYNGFSEESESDSDSRSRVSKKRHKREKKKRKKKKKRAFDDDDDRGDDELLDLHSISRSWLLSTDGFSATWTSVDLPEYIAKYCLSTWMKGLLARQK

SEQ ID NO: 39559 - protein, 327 aa, Streptomyces cinnamonensis
MRIAVTGSIATDHLMVFPGRFAEQLIKEQLERVSLSFLADRLEVRRGGVAANIAFGLGLLDLDPLLIGAAGRDFAEYDSWLREHGVDTSAVQVSDTLHTARFVCTTDQDQNQIATFYAGAMAEAAHIDLAAVTERTGPPLLVLIGADDPAAMLRHTATAHRLDIPVAADPSQQLARLDREQARRLVDGARWLFTNEYEAALLMERTGWSEDDLLDRVGTWITTLGAGGVSLARAGCPKLPVPAVPTDTIADPTGAGDAFRSGFLAGTAWNLPHERAAQLGCALATTVLESVGTQEYKLIPADLIARIEQTYGPGAARVLEAQIARTA

SEQ ID NO: 39560 - protein, 182 aa, Marinobacter sp. ELB17
MNIPNILTLSRIVMIPVFVVIFYMPVQWSYLVSAAIFTLAAVTDWLDGYLARKLNQSTPFGAFLDPVADKLMVAVALAVLIEEHAALILTLPATIIIGREIVISALREWMAEIGSRASVAVSYIGKIKTVAQMAAIIGLLAFPPGVVQADIAIGLLYLAAGLTLWSMGLYLKAAWPDLFPRK

SEQ ID NO: 39561 - protein, 328 aa, Symbiobacterium thermophilum IAM 14863
MVGGAGYVGSHVVRALLEAGHEPVVYDNLSTGHMEAVCDSEVIIGDVGDRDKLRTVLQARRFDGVVHLAAASLVAESMREPSVYFRNNVSASIVLFDELIRADVPWVVLSSTAAVYGEPEVVPIPEEHPTRPTNPYGESKLMLERILKWYDVAYGFKHISLRYFNAAGAHPSGQIGEDHMPETHLIPIVLQVALGLRDFVTVFGIDYPTPDGSAVRDYVHVCDLADAHVRAITRLCATGTSSVYNLGSARGYSVREIVDVAQQVVGMPIKSVVADRRAGDPPILVADNRKALSELQWMPQFDLEAIVETAWRWHRDHPQGYGNRRSSI

SEQ ID NO: 39562 - protein, 322 aa, Mycobacterium avium 104
MELVDTETRPPGRDEVRLTVGACGICGTDAHFVNGAFPGLSWPLTPGHEIAGRIAELGEGVEGFAVGQRVAVGWFGGCCYRCDPCRAGLFIHCVNGKVPSWHYPGGYAESVTVPTSALARIPEELTDAEAAPMGCAGVTTYNALRHTKALPGDRVAILGVGGLGHLGVQFAAAMGFETIAINRGTGKADDARKLGAHHYIDSTAEDPAEALRALGGAAVVLATAGNSQAMAATVGGLAPQGELVTIGVTPEPLPISPLQLITPGLSIVGHPSGTAKDVEDTMQFAVLSGVRAWIEELPLSRAADGYAALEGGRAHYRTVLTM

SEQ ID NO: 39563 - protein, 382 aa, Oryza sativa
  misc_feature (52)..(52): Xaa can be any naturally occurring amino acid
MKEGGGDGGFVRADQIDLKSLDEQLERHLSRAWTMEKRKEEAAADQRGSKPXPALAAAHYSQNRRQRREEWEIDPAKLVVRGVIARGTFGTVHRGVYDGHDVAVKLLDWGEDGHRSEQDIAALRAAFSQEVSVWHKLDHPNVTKFIGAIMGARDLDIQTESGHLAMPSNICCVVVEYLAGGSLKGFLIKNRRKKLAFKVVVQIALDLARGLSYLHSKKIVHRDVKTENMLLDKTRTVKIADFGVARLEASNPSDMTGETGTLGYMAPEVLNGSPYNRKCDVYSFGICLWEIYCCDMPYPDLSFSEVTSAVVRQNLRPEMPRCCPSSLANVMKRCWDANPDKRPEMAEVVSMLEAIDTSKGGGMIPVDQRQGCLSCFRQYRGP

SEQ ID NO: 39564 - protein, 599 aa, Physcomitrella patens
MALRIENPYYKLLDTDEEIVEDFELMSRNARETQLELLRKILERNANVEYLQRQGLNGRTDEASFKACVPVSTYANIEADVDRIADGDTSPICCVDPPTSFALSSGTTGGKCKLIPRTDALLAQAMKAGQIGSVYRRRAFPRKHEGPPVVMSFQYAGRQFDTKSGLKAGTGTTNFYRSAAFKNAKSAPFSATSPVDIVLGYDVPQQMYCHLLCGLYRCQEVEQMSAIFAYMIVEPFRLLERVWRDICKDIREGTVNERVSDPELRSSVLKVLSPNPELADLIERECAKGWSGIIERLFPNINYIMSIFSGSMLPYVAPMRQYAGSVPLMNADYGASEAWIGINLDPRCPAEDASFTIIPNFAYFEFIPVNRDSAGYDSVEGDEIVGLTDVKVGQEYEIVLTTVGGLYRYRLGDIVKVTGFFNSTPKVAFVCRKGVVLSVNTDKTDEEELRLVVGKASLLLKESNMELADYSSYTDQDSQPGHYVIFWELRSHEHLDMDLLSECCKVLDQSFNNPYMRGRAARTIGPLELAIVKEGAFARLMEQFVRKNGVGASQYKVSRCFKNPATLKHFRDETIATLRSPDFPPELLAAWRPSTKIVG

SEQ ID NO: 39565 - protein, 444 aa, Bacillus subtilis
MSSYLIKPELSSAYPVVSYAKGSYVYDQTGKKYLDGSSGAVTCNIGHGVRDVTEKLKEQLDQVSFAYRSQFTSEPAEQLAALLAQELPGDVNWSFFVNSGSEAIETAMKIAIQYWQEKKQTQKSIFLSRWSSYHGITLGALSLSGFYERRYRFTHLIERYPAISAPHIYRLNHETEEDFVQTAADELDTMIKRIGSQFIAGFVAEPIIGAAGAAITPPPGYYERLSEVCRTHDVLFIADEVMTGLGRTGRMLATEHWDTVPDIAVLGKGLGAGYAPIAAAVVSDSIIETIKQGSGVIMSGHTYSAHPYSAKAALEVLRYVLKHGLIKQSEKKGAVLKKKLDEAASQSGIIGEVRGKGLLLGIEFVQTKKRRKCFRQQQAITQLIVSEAKKRGLIVYPSKAGIDSGEGDAVIIAPPFTISDGEMEELISIFSETVAAVEKNLKKD

SEQ ID NO: 39566 - protein, 297 aa, Triticum turgidum subsp. dicoccoides
GFLGLSGAILVQVQRTLHIDPGSFILMLAILPTAIALLLMYFVDVHSAHQRYNKKFLDAFSLMAVTVAGFLMVVIICDQVFMISSAGQSVCFAILLLLIMSPVAIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 39567 - protein, 218 aa, Triticum aestivum
  misc_feature (32)..(32): Xaa can be any naturally occurring amino acid
MSQDKAAGDKAAAEPKRQTPRLNERILSSLSXRRSVAAHPWQRPRDRAPALRAVFNVVVEITKGSKVKYELDKKTGMIKVDRILYSSVVYPHNYGFVPRTLCEDNDPIDVLVLMQEPVLPGTFLRARAIGLMPMIDQGEKDDKIIAVCADDPEYHNLNHLSELSPHRLQEIRRFFEDYKKNENKEVAVNDFLPADDARAAIQHSMDLYGEYIMHSLRR

SEQ ID NO: 39568 - protein, 453 aa, Magnetospirillum magnetotacticum MS-1
MLFPFDNSYARLPDRFFARVAPTAVEAPRLVRLNRPLALELGLDPDRLESEGAEILSGRRVPEGAEPLAAAYAGHQFGQFVPQLGDGRAILLGEVVGRDGGRRDIQLKGSGPTPFSRRGDGRAALGPVLREYCVSEAMHALGIPTTRALAVVTTGERVIRETVLPGAVLTRVASSHIRVGSFQFFAARGDVEGLRALADHAIARHDPQAAEAENPYRALLAGVIRRQAELVARWLTVGFIHGVMNTDNMSISGETIDYGPCAFLDTYDPATAFSSIDRHGRYAYGNQPRMALWNLTRLAEALLPLLAEEEDKAVSEAEAALGGFAGLFEAAYHGGLNRKLGLTTAREGDAALAGDLLKTMAENEADFTLTFRRLGDALPEAGAGPRAAEGVRSLFIDPTAFDRWAEGWHRRLADEPGEVASFRRTMRAANPAFIPRNHRVEEMIEAAVERQDF

SEQ ID NO: 39569 - protein, 369 aa, Microcystis aeruginosa PCC 7806
MDVRAAVALEAGKPLTIETVQLAAPQAGEVLVEIKATGVCHTDAYTLSGADPEGLFPSILGHEGAGIVVEVGKGVTSLKVGDHVIPLYIPECRQCEYCLSFKTNLCQAIRLTQGRGVMPDGTSRFSLDGQPLYHYMGTSTFSNYTVLPEISLAKIRPDAPFEKVCYIGCGVTTGIGAVINTAKVEPGAKVVVFGLGGIGLNVIQGARLVGADMIVGVDINPQKQALATKFGMTHFVNPQEIEGDLVTYLVDLTKGGADYSFECIGNVQIMRQALECCHKGWGVATIIGVAGAGQEISTRPFQLVTGRVWKGTAFGGARGRTDVPKIVDWYMEGKINIDDLITHVLPLARINEAFDLMRQGDSIRSVITF

SEQ ID NO: 39570 - protein, 377 aa, Synechococcus sp. WH 8102
MSIEELSGEERSRYARHLMLPEVGMAGQERLKAASVLCVGAGGLGSPLLLYLAAAGVGRIGIVDGDVVELSNLQRQVIHGMDWLGQSKGRSAAHRLQELNPHCQVELHEQMLDRENALELIARYDLVCDGSDNFPTRYLVNDACVLQGKPLIYGSVQRFDGQASVFNHTPESPNYRDLLPEPPPVEQVPSCAEAGVMGVMPGLIGLIQATEAIKLITGIGRSLDGRLLVVDALTMRFRELTLRRDPDRPAIDGLIDYQQFCRPTASPMDSISVIELKSLLDGSADDLVLLDVRNPAEAEVAVIPGAVLIPLATIKSGEAIERIRGLAESGRLYVHCKLGGRSAQAVELLAQQGIPATNVDGGIDAWSVQVDQAVPRY

SEQ ID NO: 39571 - protein, 203 aa, Oryza sativa
  misc_feature (177)..(177): Xaa can be any naturally occurring amino acid
HSGMRDSVETSPLLQYRAQTVVPERVLKMEEAIKSRNFESFARLTCADSNQFHAVCLDTSPPIFYMNDTSHRIISLVEKWNQSEGTPRVAYTFDAGPNAVLIAPNRKNATILLQKLLYYFPPQDNDLSSYMVGDKSILSDAGLKSIEDVEALPAPAETKMPSQKFKGDVSYFICSRXLGAGPKVVTDESLALIDSVTGLPKGV

SEQ ID NO: 39572 - protein, 296 aa, Synechococcus sp. WH 8102
MHPQLQQELVASTGPLPGRQLVDVRAVGGGCIHQAWCLTMANGERLFAKSGNLKAMALFEVEAEALEALHAHADPDWLVVPKPLSLSALPSGAVLLLPWLELSGCDQRALGRGLALLHQASEAAAPQRFGWDRDGYIGAGPQPGGWRDGWGACFVELRLQPQLALARDLSLSGEWLDRLLTGLRQRLEGHAPKPALVHGDLWGGNAGALNDGRGALYDPACWLADREVDLAMTRMFGGFSATFYGAYKEVLPLRSGWEERVEIYNLYHLLNHANLFGGGYVSQSQDCLKRLARTIT

SEQ ID NO: 39573 - protein, 294 aa, Symbiobacterium thermophilum IAM 14863
MMRVRKAVIPAAGLGTRFLPATKAQPKEMLPLVDKPIIQYVVEEAVASGIEDIIIVTSRGKRAIEDHFDRNLELELMLEGRNGELLAAVRRLSDMADIHFIRQKQPMGLGHAVYQARRHVGNEPFAVLLGDEVFIGATPCLKQLIDTYEETGGSVIAVRPVPLEEVSRYGVIAPEPAGERLHRAVDLVEKPSVTKAPSNLAIVGRYVLDPAIFEILSDLPPGRNGEIQLTDGLRELNRFSQVYAYEPAVKRYDVGEKLGFIQATIELALERNELADGLRVYLEDLVAGRPTANT

SEQ ID NO: 39574 - protein, 321 aa, Symbiobacterium thermophilum IAM 14863
MGCVMRTVLITGGAGFVGSHVVERFLAEGLRVVVVDNLTTGVREHVPPGAEFHNIDILTPEFTSLVGKVKPDTIVHLAAQVSVAVSVRDPVLDADVNVGGTLRVLEAAREHQVPNFVFSSSAAVYGIPSSLPVTEDAPFSPLSPYGIAKVAAEGYIRAYCFLHGLKAVVMRYSNVFGPRQKAAGDGGVVANFVEAILRGHPPVFFGDGGQTRDFIYVKDVADATLKAIDYLDKSGTSEYLVVNISSGVETSLRTLYTLLCELVKQAPEPILTPPREGDIRHSCLDNRKAREYLGWLPGYSLEQGILETVTAARLAGQGARL

SEQ ID NO: 39575 - protein, 337 aa, Zea mays
  misc_feature (180)..(180): Xaa can be any naturally occurring amino acid
  misc_feature (227)..(227): Xaa can be any naturally occurring amino acid
ARNSARAAAGQSSISARGLRAERQGAMAASVALSSGHRMPAVGLGVWRMEKADIRGLIHTALRVGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMXLVRSIGISNYDIFLTRDCLAYAKIKPAVNQIEVHPYFQRDSLVKFSXKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 39576 - protein, 352 aa, Streptomyces cinnamonensis
MACIGTDQELTALARRTREELLEQMEDRLRAFLRAEHELWAEVNERAVGAVAALTDLVAAGGKRIRPAFCIAGYLAAGGDPDDTAVVAAAAALEMLHASALIHDDVIDASSHRRGRPTVHARHSALHDRNAWQGESRRYGEGVAILVGDLALVYSEQLMAAAPPAVLPVWGTLRSELMIGQYMDMTAAAEFLVDPRLSRWIALAKSGHYTIHRPLVVGASAAGRADLAPAFAKYGEAVGEAFQLRDDLLDAFGDFAHTGKPAGLDFSQHKMTLLLSWAMQRDARIHSLITEPGHTPDEVRRRLVDTGVPDDVEKHIAGLVEQGCEAIADVPIDPVWRTELTTMATQAAYRTT

SEQ ID NO: 39577 - protein, 461 aa, Mycobacterium avium 104
MAPGTADHLRRGIGTFQLTMFGVGSTIGTGIFFVMSQAVPEAGPAVIVSFLLAGVAAGLAAVCYAELASAVPVSGSSYSYAYTTLGEVVAMGVAACLLLEYGVATAAVSVNWSGYLNKLLSNVVGFQLPHALSAAPWDAQPGYVNLPAVMLIGMCALLLIRGASESAKVNAIMVMVKLGVLVVFGILAFTAFDMHHLDDFAPFGVAGVGTAAGTIFFSYIGLDAVSTAGDEVTNPQKTMPRALIAALLTVTGVYVFVALAALGTQPWQDFGGQQEAGLATILDHVTHGSWASTILAAGAVISIFSVTLVTMYGITRILFAMGRDGLLPPRFARVNPRTMTPVNNTVIVAVAAATLAAFIPLQNLADMVSIGTLTAFVVVSVGVIVLRVREPDLPRGFRVPGYPVTPVLSIMACGYILASLHWYTWIAFSGWVLLALIFYFVWGRHHSALNDAAVDPSGQER

SEQ ID NO: 39578 - protein, 599 aa, Dehalococcoides sp. VS
MRKAPWPRAGLLSPWLLASLLLIAAPAYCEAPAQGARAQAAKPASSKPTSNKAAANKPAAAHPPGTAIASAHSLSTQAGLDIVRQGGNAFDAAIAVSSTLSVVEPISSGIGGGGFFLLHDAKSGRDVFVDARETAPAAATPAAYLDAKGELNRDRAINGPWSAGIPGLPAALVHLAQKYGKLPLKTSLAPAIRIARDGFEVYPRLEKGYGSRREVMERYRGTREVFLADGSPPKAGEILKQPDLARTLELLAAKGFDGFYRGEVGAKLLAAVKEEGGQWKPEELSGYKVVEREPLRLKYRGWDIVTAPPPSSGGVAFAEILQMLEGWDLSKLDPAHRTHIIAEAMRRAYRDRTIYLGDPDFVKIPLRRLTSADYAAGLRATIHPDKATPSDLLPGQPAPLEDDETTHFSIIDGEGNRVSATQTVNLLYGSGMVAPGTGVLLNNEMDDFALRPGTPNAFGVMGFAANAPEPGKRMLSSMTPSFLESKDKVIAVGAPGGSRIITQVLLAVLAYDAGLSPQQVAAQPRIHHQWMPDVISAEAGALDADTVAKLQAMGHKVNAGESTWGNLQTVMWDKRADVLSGGTDPRNPVGKADVLLSKP

SEQ ID NO: 39579 - protein, 575 aa, Synechococcus elongatus PCC 7942
MGESSARKPNISVSGRWLVHPAIAAFSSAFPGCFCPLPSPAVTLQTEMEAALEVAALNREMLIILDFGSQYSELIARRIRETQVYSEVLSYRTTADQIRQLSPKGIILSGGPNSVYDDYAPVCDPEIWNLGIPVLGVCYGMQLMVQQLGGQVDRAERGEYGKAALVIDDPTDLLTNVEPGSTMWMSHGDSVKTMPEGFELLAHTDNTPCAAIADHQRKFYGVQFHPEVVHSVHGMALIRNFVYHICDCEPTWTTETFVEEAIREIRARVGDKRVLLALSGGVDSSTLAFLLHRAIGDQLTCMFIDQGFMRKGEPERLMEVFNEKFKIHVEYIQARDRFLQRLEGITDPEEKRKRIGHEFIRVFEEESRRLGPFDYLAQGTLYPDVIESADTNVDPKTGERVAVKIKSHHNVGGLPKDLQFKLVEPLRRLFKDEVRQVGRSLGLPEEIVKRHPFPGPGLAIRILGEVTAEKLNILRDADLIVRQEVNRQGYYDEFWQAFAVLLPVKSVGVMGDKRTYAYPVVLRFVSSEDGMTADWSRAPYDLLETISNRIVNEVKGVNRVVYDITSKPPGTIEWE

SEQ ID NO: 39580 - protein, 283 aa, Oryza sativa
MQYQPLDSSGTDDDLPPTYQPRGPRVIFNGNGSLPQPNLHSNVDREIRQIEQQAYTGVLRAFKVQSDAITWEKESLITELRKELQISDKEHRVLLKGVTEEEAVCRIRQSRQTGGTQSSSHHSSVVHTPVPAKRQKKSHSVPVTPQAPVITMHAVVGKKLFYEGKGRANQGLLYQGGRQASDRVLKRLPSNNSPMLGSSRRRGRLHPNELIKGYSPLDGFGIPNTGNVVMEVEKVLSNPNMLEIEKAMKLLRDQEQSLLDAIARLDEASDGENEITALKIERR

SEQ ID NO: 39581 - protein, 575 aa, Vitis vinifera
SARAPSVISSSEATLGRHLARRLVQIGVSDVFSVPGDFNLTLLDHLIAEPGLKNIGCCNELNAGYAADGYARSRGVGACVVTFTVGGLSVLNAIAGAYSENLPVICIVGGPNSNDYGTNRILHHTIGLPDFSQEFRCFQTVTCYQAVVNNLEDAHEQIDTAISTALKESKPVYISISCNLPGIPHPTFSREPVPFCLAPKVTNQMGLEAAVEAAAAFLNKAVKPVMVGGPKLRVAKACEAFVELADACGYPVAVMPSAKGLVPECHPRFIGTYWGAVSTAFCAEIVESADSYIFAGPIFNDYSSVGYSLLLKKDKAILVQPERVVIGNGPAFGCILMKDFLKALSKRLKCNTTAYENYHRIYVPEGQPLRSDPKEPLRVNVLFQHIQKMLSSETAVIAETGDSWFNCQKLKLPKGCGYEFQMQYGSIGWSVGATLGYAQAVPNKRVISCIGDGSFQVTAQDVSTMIRCEQRTIIFLINNGGYTIEVEIHDGPYNVIKNWNYTGLVDAIHNGEGKCWTTKVVCEEDLINAIETATGSKKDCFCFIEVIAHKDDTSKELLEWGSRVSAANSRPPNPQ

SEQ ID NO: 39582 - protein, 450 aa, Mycobacterium avium 104
MARGSRRGLLVGLTAASVGVIYGYDLSIIAGAQLFVTEDFGLSTRQQELLTTMAVIGQIGGALFAGVLANAIGRRRSVLLILSGYAVFALLAAFSVGLPMLLTARLLLGLTIGVTVVVVPVYVAESAPTAVRGALLTAYQLAIVSGLIVGYLSGYLLAGTHSWRWMLGLACVPAVLLLPLVFRMPDTARWYLLKGRVDDARRALLRVEPAARVDDELAEIGRAVSEEAASLPAMLAEMVRSPYRRATVFVVVLGFLIQITGINAIIYYSPRIFEAMGFTGNFALLALPALVQVAGLVAVGTALLLVDRVGRRPILLCGTAMMIVADVVLVAVFGRGPGGVIAGFAGVLLFIFGYTMGFGSLGWVYASESFPSRLRSIGSSTMLTSNLVANAIVAAVFLTLLHSLGGAGTFAVFAVLAVVAFAFVHRYAPETKGRQLEDIRHFWENGGRWD

SEQ ID NO: 39583 - protein, 453 aa, Synechococcus elongatus PCC 7942
MPDSTLSTVAKPTWQQRLLFGQEPSPELAAILLVYFVQGILGLSRLAVSFFLKDDLGLSPAQVSALTGIAALPWMIKPAFGLLSDGFPLGGYRRRPYLIAAGLLGSTAWLGLGTVVHSPAMATLAIALSSLSVALSDVIVDSLVVERARQESRSESGSLQSLTWAVSALGGLVTAYLSGFLLQLFETRTLFLITATFPLIVCLVAGWIAEVPQTIQPGLALIREQVGQIGQALRQRQIWMPTLFLFLWQVTPSADSAFFFFSTNELHFEPEFLGRVRLVTNLASLLGVWIFQRFLRGVPIRRIFGWMIVVTTLLGLTSLILVTHLNRSWGISDQWFSLGDSLILTVAGQLSFMPVLILAARLCPSGIEATLFALLMSVLNLAHFGSVELGALLTHWLGVTESQFDRLWLLVLLTNLSSLLPLPLLGLLPAEEAETVPSDAIASAAPEPLVVTQ

SEQ ID NO: 39584 - protein, 454 aa, Arabidopsis thaliana
MESERLESHLLNKQEEEASSFTSGLLLSTSVVVAGSFCYGCASKIMEELGLSVADYSFFTSVMTLGGMITAVFSGKISALVGRRQTMWISDVCCIFGWLAVAFAHDIIMLNTGRLFLGFGVGLISYVVPVYIAEITPKTFRGGFSYSNQLLQCLGISLMFFTGNFFHWRTLALLSAIPSAFQVICLFFIPESPRWLAMYGQDQELEVSLKKLRGENSDILKEAAEIRETVEISRKESQSGIRDLFHIGNAHSLIIGLGLMLLQQFCGSAAISAYAARIFDKAGFPSDIGTTILAVILIPQSIVVMLTVDRWGRRPLLMISSIGMCICSFFIGLSYYLQKNGEFQKLCSVMLIVGLVGYVSSFGIGLGGLPWVIMSEIFPVNVKITAGSLVTMSNWFFNWIIIYSFNFMIQWSASGTYFIFSGVSLVTIVFIWTLVPETKGRTLEEIQTSLVRLS

SEQ ID NO: 39585 - protein, 330 aa, Debaryomyces hansenii CBS767
MNVDTDIITLTRFILQEQQKEAPNATGELSLLLNSLQFAFKFIAHNIRRAELVNLIGISGSANSTGDVQKKLDVIGDEIFINAMKSSNNVKVLVSEEQEDLIVFEGGGRYAVCTDPIDGSSNIDAGVSVGTIFGIYRLKEDSQGSIKDVLRKGTEMVAAGYTMYGASAHLMLTTGQGVNGFTLDTQLGEFILTQPHLTIPKTRAIYSVNEGNSHYWADSAKQYIADLKKPQEDGKPYSARYIGSMVADIHRTILYGGIFAYPADSKLKNGKLRILYECFPMAMLMEQAGGAAINDKGERILEILPKGIHDKSGIWLGSTGEVDRYLTYLK

SEQ ID NO: 39586 - protein, 418 aa, Ralstonia metallidurans CH34
MPVFPISTGGACRPRPALIAMTSVLRLTDLISQGKISGKRVFIRADLNVPQDDAGNITEDTRIRASVPAIQACLEAGATVMVTSHLGRPTEGEFKPEDSLAPIATRLSELLGKPVKLVQNWVDGVEVAPGQIVLLENCRVNKGEKKNSDELAQKMAKLCDVYVNDAFGTAHRAEATTHGIAKFAPIACAGPLLAAEIDALGRALGQPARPLVAIVAGSKVSTKLTILKALADKVDNLIVGGGIANTFMLAAGLKIGKSLAEADLVGDAKTIIDIMAARGASVPIPVDVVCAKEFSATAAATVKDVKDVTDDDMILDIGPKTAAMLADQLKAAGTIVWNGPVGVFEFDQFGNGTKVLAEAIATSKAFSIAGGGDTLAAIAKYGIADRVGYISTGGGAFLEFLEGKKLPAFEVLEQRAAG

SEQ ID NO: 39587 - protein, 481 aa, Synechococcus sp. WH 8102
MLEAQAHSHLKTLLRQGESNWPHHLTLSRLVGRSLRRGDRTLLRLAPNQRERWWLGLLMPLCLQSSSAVLVLTAQQRQRLLQVERPRLARQGFRLACWEGNTPPPQDQLWLLDHAGLIQAHRNDLLGDRQLLLPGIDQLSEQLRRCMAIRLDASHWEQLRLALPQAEKPLLELHERLSRQLFREAPRVDACIRLDNSACQSLRDLLAVMGPCPSPWSELLACDPREWSHWAELDHTMLQWSWCLEPLEPLQQLQGLLSQRPTLMLSDSGDSARLEQELQEANASPTVTAVLREAELEEPLPLFAPRRQPLPNTEIYAEHLLEQSRRLILGRPGLTVLLLDDPSLRRSLTASLAAEFGTRVQDECTAPEDNGVISGSWSWWLQHLDQLPEPEQIIIGLLPIASLTSPITAARVERLKSQGADWFRSLLLPEALRQIPAAVAPLRRSGGRLAVLDGRLRGRSWGDQVLQRLEPWRPLQRLLPD

SEQ ID NO: 39588 - protein, 479 aa, Ralstonia metallidurans CH34
MTRSTKIVATIGPASSTLEVLTRMIGAGVDVVRLNFSHGTAQDHIDRAALVREAAAACGREVAIMADLQGPKIRVGKFENGKITLKPGDAFILDSACQMGNQERVGLDYKDLPRDVGPGDLLLLNDGLIVLVVDRVLGNEIFTTVRIGGELSNNKGINRQGGGLSAPALTAKDMEDIKTAMALGADYVAVSFPKNATDMEMARQLTNVAGQPHNHKARMIAKIERAEAIRPGVLEEILLASDGIMVARGDLAVEVGNAAVPALQKRMIKLAREANKLTITATQMMESMIVNPVPTRAEVSDVANAVLDGTDAVMTSAETAAGRYPVETVEAMAAICLEAEKSEVVQLDTDFLNQTFARIDQSIAMGALFTAYHLGVKAIAALTDSGATALWMSRHRIHVPIYAMTPNLASQRKMQLYRNVVPLPLQSSADRDVALEQAEELLLSQGVVQRGDFIVLTIGEPMGQPGGTNTLKIVRVGTR

SEQ ID NO: 39589 - protein, 77 aa, Escherichia coli
STIEERVKKIIGEQLGVKQEEVTNNASFVEDLGADSLDTVELVMALEEEFDTEIPDEEAEKITTVQAAIDYINGHQA

SEQ ID NO: 39590 - protein, 649 aa, Wolinella succinogenes DSM 1740
MSQAHFSSWRGHQEFLAPHLIEGRAVRAFIGWAGVMIYDPTLDVIALAKEYARQYQCFAETCGRCAPGKFGGKILFDLLEKIDQGRGEESDLERLVEVGKLMMTTSKCEVGKTTPLPILDLLEAYRPLFVEALGNRSRKERSKKERYIAKITAPCIDACPAHVDIPAYIEGVRDHLLGDSLAATRKSMPLAQVCGRVCPHPCESACRRGDLDEPISIMELKRLGADYEKERHGGFIHPYPPKPRRKDKRVAIIGAGPAGLSSAYYLALEGIMSDVFEALPVLGGEVSVGVPEYRMPIDRYYHDIEAIKSLGVSFWTNHFVSAKELDEMRQKYDAIILATGARISKKLGVKGEEESLGGYAPAIPWLDQINLATKFNLAALPDLRGKSVVCVGGGFTSMDVVRCAVRLGAKRIVMLYRRDEATLIQNTSKEEYHEALEEGVEFLFQCAVQEIKSCGGEIKALLVEEYEVVYEEGARKPSLRRIEREPLFLECDLLIPAVSQEVDRSFIPKEWNLESTSWGSFKTNGKDFSTTLRGVFAAGDCEKGPLTIVNAVGQGKRAASVVSRFLEDGEITLTPEEEMEDWLKKEGVYDRSMPVVGWLAGLVRQESHKEEPLKRREDFREVNQGLSMQEAFAESERCMRCYYISMVAL

SEQ ID NO: 39591 - protein, 422 aa, Arabidopsis thaliana
MRTSKASVTQTWLLYTQLCLWKDLIIRYVRQIIRRAKSMLFSQNMVADSAEISVIDVKSHLSVAKDPSNFQIAEIRIHDSICIDIPSSEETPLLESIKSCSATTIEEHVTEFVPNISSGSYADKGDYREYMEDEHICIDDLSDHLGSSFYRFPVPMAFYGVFDGHGGSDASQYIKENAMSLFFEDAVFRQSPSVVDSLFLKELETSHREAYRLADLAMEDERIVSSSCGTTALTALVIGRHLMVANVGDCRAVLCRKGKAVDMSFDHKSTFEPERRRVEDLGGYFEGEYLYGDLAVTRALGDWSIKRFSPLGESLSPLISDPDIQQMILTEEDEFLIMGCDGVWDVMTSQYAVTFVRQGLRRHGDPRRCAMELGREALRLDSSDNVTVVVICFSSSPAPQRRRIRFCVSDEARARLQTMLEG

SEQ ID NO: 39592 - protein, 131 aa, Triticum aestivum
MATISATPGTTVVARSAISRPQALGLPHLRTRTERVRCTYSKDAKEATPAAAVRGAGASLLPTAGAVTASAGPALALVDERMSTEGTGLTLGLSNNPLGWILLGVFGLIWSLYTVYTSGLDEDEESGGLSL

SEQ ID NO: 39593 - protein, 118 aa, Brassica napus
  misc_feature (59)..(59): Xaa can be any naturally occurring amino acid
MPEEESIDIKFRLYDGSDIGPFRYSAASTVDFLKQRVVSDWPKGKTVVPKGINEVKLIXSGKILENNKTVAQCKTPFGETAGGVTVMHVVVQPSPAKTKSEKKVDKAPKAVICTCTIL

SEQ ID NO: 39594 - protein, 352 aa, Streptomyces tubercidicus
MTDTASELDPSTGWAEPTAEAPPEAALMQLLMGGFVTQSIGVAARFGVADALAQGPRHVDDIAAEVGAHAPSLYRLLRALGDFGVFAELAGRRFALTPAGELLRSDSTPSLRGLAEHFGSGFHRAAWSGLYDSVRTGEAAFERVHGAPQFDYYRSHPEEAATFDAAMTSVASAIYATLESYDFGRFSTVVDVGGGNGAYLSGILASYPALRGVLFDLPDVVERSAPVLAKAGVADRCEVAGGSFFDAVPPGADAYVLTAVIHDWDDEASVRILRNCRAAMPAHATLLLGEPVLPDGPEPSVGKLLDLETLIGTTGRQRTEAEFRELLDRAGLRLTRVLHSSGPDSLVEAVPR

SEQ ID NO: 39595 - protein, 232 aa, Oryza sativa
MFGCANDYPRDDVKEIKCYVCNQKGHLCCADFSDICPKEVSCYNCAQPGHTGLGCAKQRREASTAATPTLCYKCGEGGHFARGCTKNTKSDRMNGESSAYSRKKGKGKKDFGTRSAPHDARKTSKRKSPLFEERRNSSHFKSKARGGWIADDADDQPYKKCKPNVWASPSTPKKQYNNHQFSSGGDYSTPQSSRWQKHGFASPSATYSPNTRKHSFSSSRFASNTHVRFGRS

SEQ ID NO: 39596 - protein, 210 aa, Paeonia lutea
IVESVGEGVTDLKPGDHVLPVFTGECKECRHCKSEESNMCDLLRINTDRGVMLNDGKSRFSINGQPIFHFVGTSTFSEYTVVHIGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMISAFE

SEQ ID NO: 39597 - protein, 340 aa, Streptomyces tubercidicus
MGSDIAQDGSLQLLEISESFIYARALHLAAELKLADLLADGPRPTAELAEASATRPAALYRLLRALAGRGVFTEVETGRFGLTPVGECLRSDHPRSVRATVAQAGRLTAKTFNHAEEVLRTGEGAFTTAFGQPVWDYLQEHPDEGADFDTAMHEHSRIERDAIVAAYDFSGTARLVDIGGGDGTLLATVLTAHPETAGVLFDLPHVVERHRIGDAGLTDRCEIVGGDVFGELPAGGDLYMMKSVLHGWTDREVVSILTGCRRAMKPDGTLLLIERVIPVGDTPHSSKAFDLAMLVMAGGQERTQDEYTELLTEAGFRVERVIGTDSSLSIVEAVPTGAAL

SEQ ID NO: 39598 - protein, 519 aa, Arabidopsis thaliana
MVFISLFEISIAFFCFLLFRHFLINKKTHRLCPTNWPFFGMIPGLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 39599 - protein, 365 aa, Zea mays
MALRRLLQGSVLPRVTGRVSAPAVAPFSTESGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVAETYPEIQYEEVIIDNCCMTLVKNPGLFDVLVMPNLYGDIISDLCAGLIGGLGLTPSCNIGEGGICLAEAVHGSAPDIAGKNLANPTALMLSAVMMLRHLQFNDKADRIHNAILQTIAGGKYRTADLGGKASTSEFTNAVCDHI

SEQ ID NO: 39600 - protein, 616 aa, Candida albicans
ARASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYSSVQKLMIWSAGVILGMSCCVVDYHSMTSSIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHRLVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRLRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 39601 - protein, 214 aa, Paeonia californica
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPERFEGAKKFGVTEFVNPKDYNKPVQEVIAEMTGGGVDRSVECTGSIMAMISAFECVHD

SEQ ID NO: 39602 - protein, 331 aa, Bacteroides fragilis YCH46
MKLPGKIAIMGGGSWATAIAKMCLAQEESINWYMRRDDRIADFKRLGHNPAYLTGVKFDMKRINFSSNINDVVKESDTLIFVTPSPYLKAHLKKLKTRIRDKFIITAIKGIVPDDNLIVSEYFNKEYGVPPENIAVLAGPCHAEEVALERLSYLTIACPDKDKARVFARRLGSSFIKTSVSDDVIGIEYSSVLKNVYAIAAGICSGLKYGDNFQAVLISNAIQEMNRFLNTVHPINRNVDESVYLGDLLVTGYSNFSRNRTFGTMIGKGYSVKSAQIEMEMIAEGYYGTKCIKEINKHHHVNMPILDAVYNILYERISPMIEIKLLTDSFR

SEQ ID NO: 39603 - protein, 235 aa, Lactobacillus sakei subsp. sakei 23K
MANLVIVRHGESVANQLKTYTGWSDVALTAKGRQQAHQVGRQIKDAGFQFSHVHTSLLKRAILTSYIVLEELDQLALPMTKSWRLNERHYGALRGLNKDTTRTIFGVHQVARWRRSYTALPPLLIRSSTARRYRLVPRKSRPRGESLAQATQRLLPYWQDQVVPGLLAGQDQLIVAHGSTLRALIKVIEQISDQAIDGVEVANGEALYYQFGTDLTVLKKGRLALGSETDEEKEN

SEQ ID NO: 39604 - protein, 574 aa, Shewanella sp. ANA-3
MDADSINSFFLIGALLAAVSVLLSPVSSRLGIPILLIFLAVGILAGEDGPGGILFDDYSTAYLVSNLALAIILLDGGMRTRVASFRVALWPALSLATFGVAITTSITGVMAAWLFDLHWLQGLLVGAIVGSTDAAAVFSLLKGRSLNERVGATLEIESGSNDPMAVFLTVTLIAILANVDAELSVSFMLISFIKQFGLGIFLGLGGGWLLWKLVNLSKLAEGLYSILVLSGGLMIYAASNKLGGSGILSIYLVGLFLGNKPTRGRHSILNVLDGMTWVSQIGMFLVLGLLLTPSDLLDIWLPGLALAFGMILFARPLAVWLSLLPFKSFSSRDRWFISWVGLRGAVPIILAVFPMMAGLPGAQLYFNLAFFVVLVSLLVQGASLTTAARLAKVELPPKPLPISRSGVEIYPSSEWEVFVYHLSENKWCIGEPLKRLSMPDGTRIAAVFRHNTLLHPSGSTCLEAGDILCVLGQEKSLEALSNLFSQAPETKEVPRFFGDFFIDTEVKLLDLAPIYGLELDEATGDMTVADLVAAELGSHPVLGDQFLWQSLHWVVAGLNEGKVTNVGIRLPAEA

SEQ ID NO: 39605 - protein, 218 aa, Vibrio vulnificus
MTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINGIPGVVTVGLFAHRGADVVITGTPEGAKIEE

SEQ ID NO: 39606 - protein, 136 aa, Physcomitrella patens subsp. patens
LSLQGILDDQFTQLQMLQDESNPGFVEEVVTLFFDDSEKLLNNLTDSLYTDPIDYKTVDGHVHQFKGSSSSIGAQRVKELCIKFRICCENGDKQGCLGHLVKVKEEFNTVRTKLGKILELENQIVAKGGVLPLVEC

SEQ ID NO: 39607 - protein, 851 aa, Medicago truncatula
MPVNITAIKTSSDGIWQGDNPLDYAFPLLIIQTVLVLVVSRSLAFGFKPLRQPKVIAEIIGGILLGPSALGRNTSYLHRLFPEWSMPTLESVASIGLLFFLFLVGLELDLNSIRRSGKRAFSIAACGITLPFVCGIGVAIVLRKTVDGADKAGFGQFIVFMGVALSITAFPVLARILAELKLLTTRVGETAMAAAAFNDLAAWILLALAIALAGNGADGGDKKSPLVSVWVLLSGVAFVAFMMIVISPVMNRVAQRCSVENEAVDEVYICLTLAGVMVSGFITDFIGIHAIFGAFVFGLTIPKTGSFAERLIERIEDFVLGLLLPLYFASSGLKTDVTKISGGKAWGLLVLVIATACAGKILGTFVVAMMCRMPVRESITLGVLMNTKGLVELIVLNIGKEKKVLNDEIFAILVLMALFTTFITTPVVMAIYNPARGIASKTIRKLGDMSSHSKESNNVVNTLRVLACIHGPTNIPSIINLIESTRSTQKSLLKVFIMHLVELTERSSSIIMVQRARKNGFPFFNRFNRDEWYNRLAGAFQAYSQLGRVIVRSTTAISSLSTMHEDICHAAEEKRVTMIILPFHKHWRMEVDDENDKEAHEVLENAGHGWRGVNQRVLKNAPCSVAVLVDRGYGLGLKNLGSDGRVAQRICIVFFGGPDDREALELGKKMVEHPAVVVTVVRFVEQNELSGNNFVLRQSPGKSTEENYSFSIAKINRQKEQVLDENAMEEFRSKCGETVKYIEKGSGNVVEEVIALGESADYDLIVVGKGRFPSTMVAELAEREAEHAELGPIGDILTSSMGHKMASSVFVIQQHDVALTEDVPMYKVKVHDENVAEVSSGRHEISVANAV

SEQ ID NO: 39608 - protein, 384 aa, Physcomitrella patens subsp. patens
MAATEGKVITCKAGVAYEANKPLSFEDIHVSPPQPTEVRVKITHACICQSDLYFWKGKDTQKLFPRILGHEGAGICESVGAQVRHIKAGDKCIPVWQCECTKCGKCKSSKTNICDVFMFNWGSGLMPSDKATTRFTRVEDGKPIYHFFGISVFSQYSTMDEACIAKINPKAELHKICLLGCGIPTGVFGSVWNICKVHPGSTVAVFGLGTIGLAVVEACKVSGCSRIIGVARDAGKLQRAMEFGLTDTLNIKSFDKPIEQVIRDMTGGGVDYSFDCTGDPGIIKSALECCVEWGGVSCILGLVESSQRVSFHPALLLWGRVWTSGLFGGYKGRSQLPDLVDRCIKGHINLDHYITHKLPFSKINEAFELLNQGGCIRCVMDYEK

SEQ ID NO: 39609 - protein, 551 aa, Pelomonas saccharophila
MSHILRAAVLAAVLLPFPALADQAGKSPAGVRYHGGDEIILQGFHWNVVREAPNDWYNILRQQASTIAADGFSAIWMPVPWRDFSSWTDGGKSGGGEGYFWHDFNKNGRYGSDAQLRQAAGALGGAGVKVLYDVVPNHMNRGYPDKEINLPAGQGFWRNDCADPGNYPNDCDDGDRFIGGESDLNTGHPQIYGMFRDELANLRSGYGAGGFRFDFVRGYAPERVDSWMSDSADSSFCVGELWKGPSEYPSWDWRNTASWQQIIKDWSDRAKCPVFDFALKERMQNGSVADWKHGLNGNPDPRWREVAVTFVDNHDTGYSPGQNGGQHHWALQDGLIRQAYAYILTSPGTPVVYWSHMYDWGYGDFIRQLIQVRRTAGVRADSAISFHSGYSGLVATVSGSQQTLVVALNSDLANPGQVASGSFSEAVNASNGQVRVWRSGSGDGGGNDGGEGGLVNVNFRCDNGVTQMGDSVYAVGNVSQLGNWSPASAVRLTDTSSYPTWKGSIALPDGQNVEWKCLIRNEADATLVRQWQSGGNNQVQAAAGASTSGSF

SEQ ID NO: 39610 - protein, 338 aa, Synechococcus elongatus PCC 7942
MMSNTMRAVVLEMPGGPEQLQLQSLPWPAIAHPSEVLVQLQAAGLNPIDTKLRQRGSFDPDRRPAILGCDGAGWVAAVGSAVDRFAVGDAVYFCHGGLGLEPGTYADYAVVDQAWLAPKPERLSFVEAAGVPLALITAWEALYDRGRLQAAQTVLIHAGAGGVGHLAIQLAKLRGARVATTVSTPEKAAIAEHYGADFVIPYRDRDWVAAVLDWTDGKGVDLAFDTVGGAVLEQTFPAVRLYGDLVTILAPDAATNWKVARDRNLRISLELMLTPQLQRVTEARQHQTQILTTASRWFDQEQLHIHIGQVLPISEISQAHQFLERQQGAGKIVIDLTA

SEQ ID NO: 39611 - protein, 214 aa, Paeonia suffruticosa subsp. spontanea
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMMSAFECVHD

SEQ ID NO: 39612 - protein, 438 aa, Hordeum vulgare
MGKNGSLCCFSLLLLLLLAGLASGHQVLFQGFNWESWKQSGGWYNMMMGKVDDIAAAGVTHVWLPPPSHSVSNEGYMPGRLYDIDASKYGNAAELKSLIGALHGKGVQAIADIVINHRCADYKDSRGIYCIFEGGTSDGRLDWGPHMICRDDTKYSDGTANLDTGADFAAAPDIDHLNDRVQRELKEWLLWLKSDLGFDAWRLDFARGYSPEMAKVYIDGTSPSLAVAEVWDNMATGGDGKPNYDQDAHRQNLVNWVDKVGGAASAGMVFDFTTKGILNAAVEGELWRLIDPQGKAPGVMGWWPAKAATFVDNHDTGSTQAMWPFPSDKVMQGYAYILTHPGIPCIFYDHFFNWGFKDQIAALVAIRKRNGITATSALKILMHEGDAYVAEIDGKVVVKIGSRYDVGAVIPAGFVTSAHGNDYAVWEKNGAAATLQRS

SEQ ID NO: 39613 - protein, 380 aa, Gluconobacter oxydans
MATRIDYYESLEVSRMASQDELKKAFRKQAMRYHPDRNPGDDAAEQKFKEINEAYDVLKDEQKRAAYDRYGHDAFEGGMGGMGGGFGGGFAGAGGLGDIFDQMFGDMMGGRRDGGRRTGADVQVQVEITLMEAFTGVTKDVEVRTRVTCEACHGSGSADPKAGSSTCPTCHGAGKVRAQQGFFLVERPCPTCHGSGRTVTNPCKVCHGTGTEAKTETISIDIPAGVEDGTRIRMAGKGEAGGEGVQPGDLYVHISVLSHDIFQRDGANIYCRVPLRMTQAALGTEVEVPVVDGGRSKVRIPAGTQTGETFRLRGEGFSVLRSSARGDMYIQVSVETPSHLTKRQRELLEEFEKEAGDDHAKGSPENSGFFAKVRDFLEGR

SEQ ID NO: 39614 - protein, 214 aa, Paeonia szechuanica
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTECVNPKDYNKPVQEVIAEMTGGGVDRSVECTGSIMAMMSAFECVHD

SEQ ID NO: 39615 - protein, 381 aa, Nostoc sp. PCC 7120
MAQIISINDNQRLQLEPLEVPSRLLLGPGPSNAHPSVLQAMNVSPVGHLDPAFLALMDEIQSLLRYVWQTENPLTIAVSGTGTAAMEATIANAVEPGDVVLIGVAGYFGNRLVDMAGRYGADVRTISKPWGEVFSLEELRTALETHRPAILALVHAETSTGARQPLEGVGELCREFGTLLLVDTVTSLGGVPIFLDAWGVDLAYSCSQKGLGCSPGASPFTMSSRAIEKLQRRRTKVANWYLDMNLLGKYWGSERVYHHTAPINLYYALREALRLIAQEGLANCWQRHQKNVEYLWERLEDIGLSLHVEKEYRLPTLTTVCIPDGVDGKAVARRLLNEHNIEVGGGLGELAGKVWRVGLMGFNSRKESVDQLIPALEQVLR

SEQ ID NO: 39616 - protein, 214 aa, Paeonia tenuifolia
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 39617 - protein, 151 aa, Arabidopsis thaliana
MWFAGGGGGLRKLCRASAIFDNEISYNSLLVRYMSRERAVNVRKINPKVPIQEAYAISNSLYDLFKLHGPLSVPNTWLRAQEAGVSGLNSKTHMKLLLKWMRGKKMLKLICNQVGSSKKFFHTVLPEDPLQEQPAAPIENKKQAVKKKRSK

SEQ ID NO: 39618 - protein, 196 aa, Oryza sativa
MGALYVEISPAPPHQPSRLMDGVGTRQQASTSMAESTEAIPNLDQGFKALRWYGEPGEAHAASASASAPTGAGGRASCARVRTGPPGDGGGGYPNPPDAAIPDAATLREQWLFAVRQYSRWYSHAWGTAILAGAAFFGLGWLVKGSNPLPSRAEPHASNAKEEGLPKVLAGEPSPRVSRSRRACGAPSRSLLPPST

SEQ ID NO: 39619 - protein, 214 aa, Paeonia veitchii
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAIISAFECVHD

SEQ ID NO: 39620 - protein, 372 aa, Photobacterium profundum SS9
MTITSFYPPQRTLMGPGPSDIYPQVLQALSRPTIGHLDPLFVGMMDELKQLLQYAFQTKNTFTIAVSAPGSAGMEACFVNLVEPGDKVIVCRNGVFGDRMRENVERCGGKAVVVDNTWGEPVDPLLVEQALIDNPDAKVLAFVHAETSTGALSDAEALAKLARQHDCLTIVDAVTSLGGVPLLVDEWQLDAVYSGSQKCLSCVPGLSPLTFSQRAIDKIQARKTPVQSWFLDQSLVLGYWSGEGKRTYHHTAPVNSLYALHEALVLLQNEGLENAWQRHKDAHLELREGLEKLGITFVVDEASRLPQLNAVYIPDGVDDALVRKKLLERYNLEIGAGLGALGGKAWRIGLMGYAARSENVALCLKALESTLK

SEQ ID NO: 39621 - protein, 534 aa, Arabidopsis thaliana
MGLCFSSPKATRRGTGSRNPNPDSPTQGKASEKVSNKNKKNTKKIQLRHQGGIPYGKRIDFGYAKDFDNRYTIGKLLGHGQFGFTYVATDNNNGNRVAVKRIDKAKMTQPIEVEDVKREVKILQALGGHENVVGFHNAFEDKTYIYIVMELCDGGELLDRILAKKDSRYTEKDAAVVVRQMLKVAAECHLRGLVHRDMKPENFLFKSTEEGSSLKATDFGLSDFIKPGVKFQDIVGSAYYVAPEVLKRRSGPESDVWSIGVITYILLCGRRPFWDKTQDGIFNEVMRKKPDFREVPWPTISNGAKDFVKKLLVKEPRARLTAAQALSHSWVKEGGEASEVPIDISVLNNMRQFVKFSRLKQIALRALAKTINEDELDDLRDQFDAIDIDKNGSISLEEMRQALAKDVPWKLKDARVAEILQANDSNTDGLVDFTEFVVAALHVNQLEEHDSEKWQQRSRAAFDKFDIDGDGFITPEELRLQTGLKGSIEPLLEEADVDEDGRISINEFRRLLRSASLKSKNVKSPPGYQLSQKM

SEQ ID NO: 39622 - protein, 562 aa, Coprinopsis cinerea
MHPHLRPLLVALTSSFALQNFAAAALTTPRAIHSKDTMIISNIRASPDGFERPVIAVNGHHPALLIKAKKGDEFELTVANHLTEETMLRQTSIHWHGIFQHKSSWADGPEGVTQRPVAQFDNSFTYKFNAGNETGTYWYHSHFETQYCDGLRGPLVIYDDNDPYRNDYDVDNEDTIITLADWYHLQAPSINITIAPPVNATLINGKGRQPVKPDSPLAIVNVKQGKRYRFRILSSSCDPNYNFSIDGHDLTVIEADGQLTRKLVVQRLQIFAGQRYSVILHANRPKGNYWIRAEPNFGVGLNGTSGTKANGVNSAILRYYGANDEEPKDRPFTNPIDLKEFNLHALLNPSPPGRNQPADKTFFFNITFNGGRWWMNQTAEGTPIGSWHSPHTDSKGPVLLQILNGVKPEKLVPKDSIFHVKRNQVIEITLPAFTIGPHPFHLHGHAFSVIQSAGSPNKNYIDPVRRDVVSIGDPDRKENVTIRFVTDNPGPWFFHCHIEFHLSGGLGAVFVEDQKDIKSSDRAPPPSWSELCPTFDALPTNATFVSTVATPSAPTAPTNIPF

SEQ ID NO: 39623 - protein, 75 aa, Arachis hypogaea
MQPTIWAENAGVELPYSCRAGACSTCAGKIVSGTVDQSDGAFLDENQLNKGFLLTCVSYPTSDCVIETHKEGDLY

SEQ ID NO: 39624 - protein, 352 aa, Streptomyces tubercidicus
MTDTASELDPSTGWAGPTAEAPPEAALMQLLMGGFVTQSIGVAARFGVADALAGGPRHVDDIAAEVGAHAPSLYRLLRALGDFGVFAELADRHFALTPAGELLRTDSTPSLRGLAAHFGSGFHRAAWSGLYDSVRTGAAAFERVHGAPQFDYYRSHPEEAAVFDAAMTSVASAIYATLESYDFGRFSTVVDVGGGNGAYLSGILASNPALRGVLFDLPDVVERSAPVLAKAGVADRCEVAGGSFFDEVPRGADAYVLTAVIHDWDDEASVRILRNCRAAMPAHATLLLGEPVLPDGPEPSVGKLLDLETLIGTTGRQRTEAEFRELLDRAGLRLTRVIHSAGPDSLVEAVPR

SEQ ID NO: 39625 - protein, 322 aa, Zea mays
MSGHGDTATSAKMAKLKELLQKSENHICADCGASDPKWASANIGVFICVKCSGVHRSLGTHISKVLSVTLDKWSDSEVDSMIEVGGNSQANAIYEAFIPEGYQKPHSDSTQEEREKFIRSKYELQEFLKPSLRIVSHQPSDSGKHAGNASHSDGSKSQVGMIEFIGILNVKVIGGTNLAIRDMSSSDPYVVLTLGQQKAQTSVINGNLNPVWNEELKLSVPQQYGPLKLQVFDHDMVSKDDLMGEAEIDLQTMINAAAAFGDPELLGDIQIGRWLKSEDNALVRDSAVVVSGGKVKQGMALKLQHTESGELELEMEWMPLNV

SEQ ID NO: 39626 - protein, 274 aa, Oenococcus oeni
MIENEKQLKRNFGFFGTLSLVIGTVIGSGIFFKQGRVLQEAGSAKMALLAWVVGGVLTLSSAMSVAELGSEMPQTGGIYIYISKIFGKFWGFLAGWMQISFYGPALIASVSYFFSTLFVTFFKLPTKITFFSFSMRSVVAVSILACILIALMNMLENRVSRTFAITTTVIKMIPIFALILFGLFFGKTGATGSAISVLSEQVDKGNFGVAVLSTLFAYDGWVIISNLGGEIKNAQKNLPRAVTIGIFIVLLAYMGVSFGVFSSLPGKEIVSLGD

SEQ ID NO: 39627 - protein, 368 aa, Hordeum vulgare
MANKHLSLSLFLVLLGLSASLASGQVLFQGFNWESWKHNGGWYNFLMGKVDDIAAAGITHVWLPPASQSVAEQGYMPGRLYDLDASKYGNKAQLKSLIGALHGKGVKAIADIVINHRTAEHKDGRGIYCIFEGVTPDARLDWGPHMICRDDRPYADGTGNPDTGADFGAAPDIDHLNLRVQKELAEWLNWLKADIGFDGWRFDFAKGYSADVAKIYIDRSEPSFAVAEIWTSLAYGGDGKPNLNQDQHRQELVNWVDKVGGKGPATTFDFTTKGILNVAVEGELWRLRGTDGKAPGMIGWWPAKAVTFVDNHDTGSTQHMWPFPSDRVMQGYAYILTHPGTPCIFYDHFFDWGLKEEIDRLVSVRTGA

SEQ ID NO: 39628 - protein, 459 aa, Photobacterium profundum SS9
MSLVDSYVNPYTSLTVAKFGGTSVADFTAMSRSAAIILHAPQTRLVLISACSGVTNILVELANGVTDTQQRHALLTRLTDIHQSVLSQLKQPQQADEAITLLLKNVAELAKKAAIEKSVALTDQLVSHGELLSTHLFAQILRELGIKAIRFDIRDVMRTDGQFGKAIPQPSIIRQLSEQHLLPQLKKHVVVSQGFIGSDEQGNTTTLGRGGSDYSAALMAEAIGASTLEIWTDVPGMYTTDPRIATKAKPIKEISFSEASEMANFGAKILHPSTLVPAIRQQIPVFIGSSKAPEQGGTWIRETVSDAPLFRALALRCNQTMVTLTSLNMFHAYGFLAEVFRILAEHKISVDLITTSEVSVSLTLDQTDTSGGAPTLPAQALAELSELCRVEVEQDLCLVALIGNQMSSTKGSAKTVFSTLEYYNLRMICYGASPHNLCFLVKAQDAKSAIKDLHCAIFE

SEQ ID NO: 39629 - protein, 413 aa, Triticum aestivum
MGKHSATLCGLLVVVLCLASSLAQAQILFQGFNWESWKTQGGWYKFMQGKVEEIASTGATHVWLPPPSQSVSPEGYLPGQLYNLNSKYGSGADLKSLIQAFRGKNISCVADIVINHRCADKKDGRGVYCIFEGGTSDNRLDWGPDEICSDDTKYSNGRGHRDTGGGFDAAPDIDHLNPRVQRELSAWLNWLKTDLGFDGWRLDFAKGYSAAMAKIYVDNSKPAFVVGELYDRDRQLLANWVRGVGGPATAFDFPTKGVLQEAVQGDLGRMRGSDGKAPGMIGWMPEKTVTFIDNHDTGSTQRLWPFPSDKVMQGYAYILTHPGIPCIFYDHVFDWKLKQEITALATVRSRNGIHPGSTLDILKAEGDLYVAKIGGKVITKIGSRYNIGDNVIPSGFKIAAKGNNYCVWEKSGL

SEQ ID NO: 39630 - protein, 482 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMVVSGGEEGARNGPSLMPGGSFEAYKYVKDIVLKVAAQVPDSGPCVTYIGKGGSGNFVKMVHNGIEYGDMQLISEAYDVLKFVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 39631 - protein, 153 aa, Hordeum vulgare
ILNVAVEGALWRLRGTDGKAPSMIGWWPAKAVTFVDNHDTGSTQHMWPFPSDRVMQGYAYILTHPRTPCIFYDHFFDWGPKEEIDRLVSVRTRHGIHNESKLQIIEADADLYLAEIDGKVIVKLGPRYDVGNLIPGGFEGAAHGNDYAVWEKI

SEQ ID NO: 39632 - protein, 369 aa, Photobacterium profundum SS9
MQLNSLLISILKAFYLKGILGFLLFAGGLGIKLPNLEDQKWEITVLALGATLFSTFFIGGALWGICQLLGFQFDLIYCLIFGSLISPTDPIAVLAIVKKLDAPRRISTQIEGESLFNDGFGLVIFVTLFTIAFGNEAPTVLGVGQLFLQEAIGGIAYGFILGLLFHYLISSTNDHSMELLLTLGIPTAGYVFADVIHVSGPLAMVVSGIMIGNWTRYIGFSKESEEHLDHFWELVDEFLNGVLFLLIGMTMLQFSFHQEDWVLMVIAIPLVLLSRYLSVKLSYLGFQKYRDYNPHSVKILTWGGLRGGLALAMAMAIPAGVIVIPEKNIDVREIILVMTYAVVVFSILIQGSTITTLIHKAKEWEAQNK

SEQ ID NO: 39633 - protein, 214 aa, Paeonia lactiflora
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTGGGVDRSVECTGSIMAMISAFECVHD

SEQ ID NO: 39634 - protein, 135 aa, Hordeum vulgare
KAPGMIGWWPAKAVTFVNNHDTGSTQHMWPFPSDRVMQGYAYILTHQGTPCIFYDHFFDWGPKEEIDRLVSVSTRHGIHSESKLQIIEADADLCLAEIDGKVIVKLGPRYDVGNLIPGGFEVAAHGNDYAVWEKI

SEQ ID NO: 39635 - protein, 174 aa, Triticum aestivum
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 39636 - protein, 429 aa, Hordeum vulgare
MANKHMSLSLFIVLLGLSCSLASGQVLFQGFNWESWKHNGGWYNFLMGKVDDIAAAGVTHVWLPPASQSVAEQGYMPGRLYDLDASKYGNKAQLKSLIGALHGKAVKAIADIVINHRTAERKDGRGIYCIFEGGTPDARLDWGPHMICRDDRPYPDGTGNRPTRTRADFGAAPDIDHLNPRVQKELVEWLNWLRTDDGFDGWRFDFAKGYSADVAKIYVDRSEPSFAVAEIWTSLAYGGDGKPNLNQDPHRQELVNWVNKVGGSGPATTFDFTTKGILNVAVEGELWRLRGTDGKAPGMIGWWPAKAVTFVDNHDTGSTQHMWPFPSDRVMQGYAYILTHPGNPCIFYDHFFDWGLKEEIDRLVSIRTRQGIHSESKLQIMEADADLYLAEIEGKVIVKLGPRYDVGHLIPEGFKVVAHGNDYAVWEKV

SEQ ID NO: 39637 - protein, 214 aa, Paeonia lutea
IVESVGEGITDLKPGDHVLPVFTGECKECRHCKSEESNMCDLLRINTDRGVMLSDGKSRFSINGQPIFHFIGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVGCTGSIMAMVSAFECVHD

SEQ ID NO: 39638 - protein, 455 aa, Zea mays
  misc_feature (296)..(296): Xaa can be any naturally occurring amino acid
  misc_feature (320)..(320): Xaa can be any naturally occurring amino acid
MVMQRFSWPYGGRSASLCGSFTGWREYPMGLVGAEFQVVFDLPPGVYQYRFLVDGVWRCDETKPFVCDEYGLISNEVLVENNVQPVVQPEPSIRGTNLDEGTVLTTMPPESSSQNPGVQIAVFRHVVSGILLHNTIYEVVPLSSKLAVLDTQLPVKQAFKIMHDEGLALVPLWDDHQGTITGMLTALDFVLMLRKLQRNIRVTGNEELEMHPISAWKEAKLQFYGGPDGAAMQRRPLIHVKDSDSLADVALTIIRNEISSVPIFKCMPDSSGVPFLNLATLQGILKFLCSKLQEQXEGCSLLHNQLLSIPIGTWSPHPGXSSSRQLRTLLLSFPLNPCLDILFQDRVSSIPIVDDKGSLRDVYSLSDIMVLGKNDVYARFELEQVPVQNALDVQSQGHGGRQCHTCFQTSPLLEVLGGLSFPGVGGLVVFEQSPRFVEGIFSLGEVFPFFLGWQG

SEQ ID NO: 39639 - protein, 380 aa, Physcomitrella patens subsp. patens
VFSQGFDWESHNHNPSWWIHFQSKIEDLFELGITDVWLPPASQSVDKHGYLPGQLYNLDSSRYGKGIELRNLLDVLHMHGMCGIADIVINHRTAGTQDKQGHWNIFDGGVPDKRLAWGAWAVVDNDVYNSGGKGKHDTGESYGAAPDLDHTSKRVQDELTDWMNWLRAEVGFDGWRFDFAKGYGPQYCGLYCERTCPSFAVGEIWTSMSYKDSSLLADQDAHRQKLCDWIDGTGGRVCAFDFTTKGILQTAVEGQLWRLQDSFGKPPGLIGWWPQKAVTFVDNHDTGSTQRHWSFPDDKIAMGYAYILTHPGIPCIFYDHYFNTHLKFQIKELVQVRLRNHINTESKVSIKIAEADIYVASIADRVLVKLGPRQVPISLS

SEQ ID NO: 39640 - protein, 411 aa, Vitis vinifera
MNALAATNRNFKLAARLLGLDSKLEKSLLIPFREIKVECTIPKDDGTLASFVGFRVQHDQWRGPMKGGIRYQPEVDPDEVNALAQLMTWKTAVANIPYGGAKGGIGCNPGELSLSELERLTRVFTQKIHDLIGVSTDVPAPDMGTNSQTMAWILDEYSKFHGYSPAVVTGKPTDLGGSLGRDAATGRGVLFATEALLHEHGKSIAGQRFVVQGFGNVGSWAAQLISGHGGKIVAVSDITGAIKNSKGIDVPSLLKHSVEHRGVKGFNGADPIDPKSILVEDCDVLIPAALGGVINRENANEIKAKFIIEAANHPTDPEADEILSKKGVIILPDIYANSGGVTVSYFEWVQNIQGFMWDEEKVNNELRTYMTRGFKDVKEMCRTHNCDLRMGAFTLGVNRVARATVLRGWEA

SEQ ID NO: 39641 - protein, 247 aa, Photobacterium profundum SS9
MSILLESIYEIALDAGKVIMNHYHSGVHVEEKADHSPVTAADIAANDIIVERLMMLTPDIPILSEESALSSWSERQGWTAFWLVDPLDGTKEFLRQNGEFTVNIALIEGGKPTLSVVHAPALNKSWLADGSTAWLETMSGRDEIKAIPAMIPTIVGSRSHPSPDMANYLQEVGEHKMVEVGSSLKFCLIAEGVAQSYPRLGPTMMWDTAAGQCVAESAGAAVLQLDGEELQYHRDKLLNPSFIVSII

SEQ ID NO: 39642 - protein, 214 aa, Paeonia suffruticosa subsp. spontanea
IVESVGEGVTDLKPGDQVLPVFTGECKECRHCKSEESNLCDLLRINTDRGVMLSDGKSRFSINGQPIFHFIGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVECTGSIMAMVSAFECVHD

SEQ ID NO: 39643 - protein, 1273 aa, Debaryomyces hansenii CBS767
MSLPDLQDLDIGPLDKIQNPMNKIVLDFDDTSKTVSNSQSPNPVDEETYDRYKNSTSQVDIRRNLSLVPITSEAALGSSNHEDDKDSSKISAYARLDFENFTFFVQTLQVILGRKSNDELLQSSHHAVDVHLSSTKAISRRHAKIFYNFGTQRFELSVLGRNGAFVDDAFTEKGITVPLADGTKIQIGDIPFAFVLPSIDSNTNDNSAGTAKQFNPSDAINLRSNLYKVSESPSKNDQKPKQSKEADKPREESKSNILQSPSNSNSDNSSHTSRRTSQSKSNTSRRLSGARKKSVTNDEIDDILNELETNSINAIDEEESELLDSEIQSILNDPDSHGQDEEMDLDEENLLKLTQFNEASNEEDEIDKLVQQHNLEQGVTWDEDELDREDENDDDMHDIDLDLSVLDQEIATLAPLIDAHHQDLMKEKEEKRKQLEQEKRKKELQQLRKMAGKKLPFNKPKVKPSTGSVSQPPTRSTPLMGKPAVPRMGRPASIQPPASRLYGRQAPINGLSKAQLVDNRLTTMSSPLAGLPTHLVAQGSANSGLPLKIAQGTHHSMAHLVNSQMSKPLMPPKPPAPKLDVQLQTITSSTSSTIRIPIRAITIDSKVELPPVCVPKNLTEQKDTPKVPKRRKDINQIKKAAKSIYTIDEIPEHYRIKPTLSYPLMITNVLKSKGGDIGLTLSEINESIKEIYPYYKYCPDGWQASVSHNVTLNKIFKRISKKEYDANWTWGIDDAYIAEREKVKQKQQEMAAAKAKAAAIKAEELKQKQRLEAQQGTTHNIVGRNFASPYGLSPLNAGLRMPQSQFISQLQQKQMGSANTNGQKPKTIAELASEIRRDGLIGSKAPLYFKPQSTLQVNSSGELVKRNDIPATVSSPAASTVSQQPQVTTNTIKAQLAANRSQSPSSLSPTSQGTHTLSEAKPKMNQDTKKSLAYLQKELFTLYKARKLSYNTATTTEVITKALATTIAQVNIIGVKAGCGDNALSFLVEKAPQQVSKILDIALTKSIKEKQGTLSSRPASRGNTPGPTSHSLASSPEKQISSMVNTPQLAGSPKPSSLAASPIEKLGEQLTTSSHKSESVAYSNSKENTPNALGELANDMPKPNQLSGIKSESPSASPSLTRPPVYKSGLSKPPTFFGKSESSSPSQSAFASASYSSGAGLPKPQSFSKPSALSNPPRFLSNKPARPSFHGNKDETAVPRPPSFTSGSFPSTKGQNNSTTATNSPNIRETPTGDSVAEQATVANAPGTKRSASDEGNVEEKLEDNSRKIIKIE

SEQ ID NO: 39644 - protein, 476 aa, Bordetella petrii
MHANYINGAWVDGVDTRNNINPSNLADIVGEYAQADAAQTSQAIAAARAAAYDWARTTGQRRADILDAVGTEILARKEELGRLLSREEGKTLPEGIGEASRAGYIFKFFAGEALRIQGEKLPMTRPGVEADVTREPVGVVGIIAPWNFPIAIPAWKIAPALAYGNTVVFKPADLVPGSAWALAEILSRAGLPAGVFNLVMGRGGIVGQTILDDKRVDAISFTGSVATGRRVAQAAMTRLAKVQLEMGGKNPMVVLDDADLNVAVESCINGAFFSTGQRCTASSRLIVQKGIYPRFVAAMQERLKSLKVDDALLAGTDIGPVVDESQLAQNEQYVSIGREEGAKLAYGGERVKRATEGFYMTPALFVDCSNDLRISREEIFGPVAAVIPADSFEHALELANDTEFGLSSGICTTSLKYATQFKRDSQAGMVMVNCPTAGVDYHVPFGGRKGSSYGSREQGRYAAEFYTSVKTAYTAA

SEQ ID NO: 39645 - protein, 318 aa, Pelargonium x hortorum
MESFPVINMEKLNGEERAATMEKIKDACENWGFFELLNHGIPYELLDTVEKMTKEHYRKCMEQRFKEMVASKGLEGVEVEVEDLDWESTFFLKHLPESNISQVPDLQDEYRKVMKEFAAKLEKLAEELLDLLSENLGLEKGYLKKAFYGSKGPTFGTKVSNYPPCPKPDLIKGLRAHTDAGGLILLFQDDKVSGLQLLKDGKWVDVPPMHHSIVINLGDQLEVITNGKYKSIEHRVIAQSDGTRMSIASFYNPGSDAVIYPAPALLEKETEEKQVYPKFVFEDYMKLYSGLKFQAKEPRFEAMKAVEANVTLDPIRTA

SEQ ID NO: 39646 - protein, 321 aa, Schizosaccharomyces pombe 972h-
MSAEQKYFENAQNVHFTLADGSKIPGLGLGTWRSEPNQTKNAVKTALQYGYRHIDAAAIYGNEDEVGDGIKESGVPRKDIWVTSKLWCNAHAPEAVPKALEKTLKDLKLDYLDEYLIHWPVSFKTGEDKFPKDKDGNLIYEKNPIEETWKAMEKLLETGKVRHIGLSNFNDTNLERILKVAKVKPAVHQMELHPFLPQTEFVEKHKKLGIHVTAYSPFGNQNTIYESKIPKLIEHETIQKIAKSKGEGVTGATIAVSWAITRGTSVIPKSVNEQRIKSNFKYIPLTKEDMDEINSIGIRARFNQATFSNEPVFAGLEDGRT

SEQ ID NO: 39647 - protein, 211 aa, Schizosaccharomyces pombe 972h-
MTTEAAPNLLVLTRHGESEWNKLNLFTGWKDPALSETGIKEAKLGGERLKSRGYKFDIAFTSALQRAQKTCQIILEEVGEPNLETIKSEKLNERYYGDLQGLNKDDARKKWGAEQVQIWRRSYDIAPPNGESLKDTAERVLPYYKSTIVPHILKGEKVLIAAHGNSLRALIMDLEGLTGDQIVKRELATGVPIVYHLDKDGKYVSKELIDN

SEQ ID NO: 39648 - protein, 480 aa, Pisum sativum
MKLLSTKATCNSHGQDSSYFLGWQEYEKNPYDHVQNPKGIIQMGLAENQLSFDLLESWLAKNQDVGGFKRDGKSIFRELALFQDYHGLPSFKKALVDFMAEIRGNKVTFDPNHIVLTAGATSANETLMFCLAEKGEAFLLPTPYYPGFDRDLKWRTGVEIVPIQCTSSNNFQMTESALQQAHEDAKKKNLKVKGVLVTNPSNPLGTTMSKNELNLLIDFIKDKNMHLISDEIYSGTVFTSPNFVSVMEILNERTDKDFLDANVSERVHIVYSLSKDLGLPGFRVGAIYSDNETVVAAATKMSSFGLVSSQTQYLLSAMLGDKKFTRNYLSENQKRLKKRQKMLVNGLQKAGISCLKTNNAGLFCWVDMRNLLTSDTFEAEMDLWKKILYEVGLNISPGSSCHCTEPGWFRVCFANMSEDTLNLAMKRLKDFVSNSNGEEGSNSDNKRTRSSQSSRSFTRKSISNWVFRLSSRDHHEQEER

SEQ ID NO: 39649 - protein, 299 aa, Zea mays
VALAAAAAAGDQTPAPPKRPSIVLHAFLFLLAYLALGVTFYAAAPANFTSSAGPTHPVADALYFCIVTLCTIGYGDITPATPAAKLFSISFVLVGFGFVDILLSGMVSYVLDLQEHLLITALNNPTSARKHRHNYIFDIKKGRMRIRMKVALALGVVAVCVGVGAAVLRKVESLGWLDAVYLAVMSVTTVGYGDQAFQTLAGRLFASAWLLVSTLAVARAFLYLAEMRIDKRHRAMANWVLSRDMTVSEFLAADIDNNGYVTMYDHLKNHCGTVEDEIKGTVPYLVQLHLLGCYHTFKM

SEQ ID NO: 39650 - protein, 542 aa, Nicotiana tabacum
MAIPTAFSGAKLESLSSSATSPAPIGLFSHPGRVRRLPIQKGLFNLGIRCVVAASDVLSQSQNSENVTSSSSLSALEQLKTSAADRYTKERSSIVVIGLSIHTTPVEIREKLAIPEAEWPRAIGELCNLNHIEEAAVLSTCNRMEIYVVALSQHRGVKEVTEWMSKTSGVPVTEICKHRFLLYNNDATQHLFEVSAGLDSLVLGEGQILAQVKQVVKVGQGVTGFGRNISGLFKHAITVGKRVRTETNIAAGAVSVSSAAVELALMKLPESSHASARMLVIGAGKMGKLVIKHLVAKGCTRMVVVNRTEERVSAIREEIKDVEIIYKPLSEMLNSAAEADVIFTSTASETPLFLKEHVLDLPAVAASVGGLRLFVDISVPRNVGACVNELENARVYNVDDLKEVVAANKEDRLRKAMEAQAIISEESKQFEAWRDSLETVPTIKKLRAYAERLRVAELEKCMSKMGDDISKKTRKAVDDLSRGIVNKLLHGPMQHLRCDGSDSRTLSETLENMHALNRMFNLETDISVLEQKIRAKVEQTQK

SEQ ID NO: 39651 - protein, 450 aa, Lactobacillus sakei subsp. sakei 23K
MIDIKTQTPPQELNRTVGFTAALSTVMGTVIGAGVFFKASSVTEVTGSTGLTILAWLLGGIITICAGLTAAELAAAIPETGGMMRYIEKTYGSVAAFLLGWAQTTVYFPANIAALSIIFATQCLNLFGWAPSWQIPVAVIVATSLTIMNFFGSRVGGFVQSFTTVFKLIPLAIIIIFGLINPGTNASHVSLFTVAGTGTSNNVLSALGNGVLATLFAYDGWIHVGNIAGEMRHPEKDLPKSILLGLFGTMVVYLLVNAVFLLVLPISQIAGNENAAAEVAGHLFGGFGGKLVTIGILVSVYGAINGYTMTGMRVPYAMATEQHLPFSKQLSCLSKAGIPILCGILQLVIAIGMIFVGGFNTLTDMLIFVIWIFYVMTFAAVIILRKREPEMKRPYKAVLYPVVPLIAILGGTFIVINTLFTQTILALIGLGITLIGLPIYYYLEKKYHQD

SEQ ID NO: 39652 - protein, 467 aa, Wolinella succinogenes DSM 1740
MEGRITQVMGPVVDVDFDSYLPAINEALDVNYDIEGHPKKLVLEVAAHIGDSRVRTIAMDMTEGLTRGTKVVARGKSIEVPVGEQVLGRIFNVVGDVIDGGDELKEPVKWSIHRTAPTFENQSTKTEMFETGIKVVDLLAPYSKGGKVGLFGGAGVGKTVVIMELIHNVAFKHSGYSVFAGVGERTREGNDLYHEMKESGVLDKVALCYGQMNEPPGARNRIAFTGLTMAEYFRDEKGLDVLMFIDNIFRYAQSGAEMSALLGRIPSAVGYQPTLASEMGKLQERITSTKKGSITSVQAVYVPADDLTDPAPASVFAHLDATTVLNRKIAEKGIYPAVDPLDSTSRILDPQVVGEDHYKTATGVQQVLQKYKDLQDIIAILGMDELSEEDKRVVERARRIEKFLSQPFFVAEVFTGSPGKYVTLQETLEGFKGILEGKYDQIPENAFYMVGGIDEVLEKAERLKANA

SEQ ID NO: 39653 - protein, 312 aa, Oryza sativa
MAAAWAAVVAVMLLLAQVSAAAPVMGPAFLWAPKNYGFSSDEAKEIVHYQTVSPKSLVKSVLEEGGWSNLVCSREDHAKSVDVAVLFLGSKLQSSDISKDKQADSTLVDTLKNSFASSEFSMAFPYIAMSDDDKLEKSLLSGFAENCNNGFGDNHITYTDTCSVSEDLKKHHDMDSIHGLVASQTKKNPSGQTDLVVFCDGGFKDNTKSEGELLSELVTLLKKSGAKYTILYASQPYGLLESPSNLPLGRYLAEKTNTTKPGRGKCDGECLVKSTLLEGSFVGIVLLIILISGLKCMMGIDTPSKFDAPPES

SEQ ID NO: 39654 - protein, 311 aa, Propionibacterium acnes KPA171202
MAKIANDVTELIGNTPLVKINKLFPDSQATVLAKLEFYNPASSVKDRIATSIVDAAEASGQLNPGGTIVEATSGNTGVGLALVGAARGYKVIITMPETMSKERRAIIRLLGAELVLTPGADGVPGANSKAAEIVENTPGAILASQFDNPANPAIHHDCTGEEIWNDTEGEVDAIVAGIGTGGTISGAGKYLKEKDPEIKIFGAEPAESPVITKGDKAPHKIQGWGPGFVPDNLDKSVVDGILLVPGDEAIAFARRAAAEEGIITGISGGGALQAAGQVVARPEFAGKTIVVVIADTGERYLSTALFEGLLD

SEQ ID NO: 39655 - protein, 203 aa, Zea mays
  misc_feature (51)..(51): Xaa can be any naturally occurring amino acid
  misc_feature (81)..(81): Xaa can be any naturally occurring amino acid
  misc_feature (102)..(102): Xaa can be any naturally occurring amino acid
  misc_feature (126)..(126): Xaa can be any naturally occurring amino acid
  misc_feature (139)..(139): Xaa can be any naturally occurring amino acid
  misc_feature (159)..(159): Xaa can be any naturally occurring amino acid
MRTTRSQSNNIVKTLNEGQVPPSDVGEVSAFPPYVFLPADDSPVHRDCSVXAAHNCCRHNECAFSAEYSDEILVNLDVHWXILGHYDRIALLAESHDFRADXDADDLTRALNVIALMTTTPLEQKXAGSTMHVDSAQTXQMIYKYWTDSNGIDTYEHSXAIGTGKVATPTHVHGVHASLMDCIETNARPDVAESTTIIYARSV

SEQ ID NO: 39656 - protein, 421 aa, Vigna mungo
MDSFSRLSIFCLFISLLPLFSSPALLFQGFNWESSKKGGWYNSLKNSIPDLANAGITHVWLPPPSQSVSPEGYLPGRLYDLDASKYGSKNELKSLIAAFHEKGIKCLADIVINHRTAERKDGRGIYCIFEGGTPDSRQDWGPSFICRDDTAYSDGTGNNDSGEGYDAAPDIDHLNPQVQRELSEWMNWLKTEIGFDGWRFDFVKGYAPSISKIYMEQTKPDFAVGEKWDSISYGQDGKPNYNQDSHRGALVNWVESAGGAITAFDFTTKGILQAAVQGELWRLIDPNGKPPGMIGVKPENAVTFIDNHDTGSTQRLWPFPSDKVMQGYAYILTHPGTPSIFYDHFFDWGLKEQIAKLSSIRLRNGINEKSTVKIMASEGDLYVAKIDNKIMVKIGPKMDLGNLIPSNLHVATSGQDYAVWE

SEQ ID NO: 39657 - protein, 1196 aa, Paenibacillus polymyxa
MTLYRSLWKKGCMLLLSLVLSLTAFIGSPSNTASAAVADDFQASVMGPLAKINDWGSFKKQLQTLKNNGVYAITTDVWWGYVESAGDNQFDWSYYKTYANAVKEAGLKWVPIISTHKCGGNVGDDCNIPLPSWLSSKGSADEMQFKDESGYANSEALSPLWSGTGKQYDELYASFAENFAGYKSIIPKIYLSGGPSGELRYPSYYPAAGWSYPGRGKFQAYTETAKNAFRTAMNDKYGSLDKINAAWGTKLTSLSQINPPTDGDGFYTNGGYNSAYGKDFLSWYQSVLEKHLGVIGAAAHKNFDSVFGVRIGAKISGLHWQMNNPAMPHGTEQAGGYYDYNRLIQKFKDADLDLTFTCLEMSDSGTAPNYSLPSTLVDTVSSIANAKGVRLNGENALPTGGSGFQKIEEKITKFGYHGFTLLRINNLVNNDGSPTGELSGFKQYIISKAKPDNNGGTGNKVTIYYKKGFNSPYIHYRPAGGSWTAAPGVKMQDAEISGYAKITVDIGSASQLEAAFNDGNNNWDSNNTKNYSFSTGTSTYTPGNSGNAGTITSGAPAGANPGDGGGTTNKVTVYYKKGFNSPYIHYRPAGGSWTAAPGVKMQDAEISGYAKITVDIGSASQLEAAFNDGNNNWDSNNTKNYLFSTGTSTYTPGSNGAAGTIRTGAPSGSVLSVVTSTYATDLNEVTGPIQTEKLSGVSLNVSTSTYAPNSNGVEVTAQTEAPSGAFTSMDLGTLSNPTSLNTDWSKQSIYFIMTDRFSNGDPSNDNYGGFNSNNSDQRKWHGGDFQGIINKLDYIKNMGFTAIWITPVTMQKSEYAYHGYHTYDFYAVDGHLGTMDKLQELVRKAHDKNIAVMVDVVVNHTGDFQPGNGFAKAPFDKADWYHHNGDITDGDYNSNNQWKIENGDVAGLDDLNHENPATANELKNWIKWLLNETGIDGLRLDTVKHVPKGFLKDFDQAANTFTMGEIFHGDPAYVGDYTRYLDAALDFPMYYTIKDVFGHDQSMRKIKDRYSDDRYYRDAQTNGVFIDNHDVKRFLNDASGKPGANYDKWPQLKAALGFTLTSRGIPIIYQGTEQGYSGGDDPANRENMNFNANHDLYQYIAKLNYVRNNHPALQNGSQREKWVDDSFYSFQRSKNGDEAIVFINNSWNSQTRTIGNFDNLSNGTRLTNQLSNDSVQINNGSITVTLAPKEVKVFTK

SEQ ID NO: 39658 - protein, 353 aa, Bacillus licheniformis ATCC 14580
MLREDDVKKIVGDLDEPFLHKPLRELDAVKEIKIKPEKRHVSVKVALAKTGSAEQMQLQQEIVIRLKEAGAETVGLRFEELPEEVVMSYQESAKGQDQSLLNSEKQPVFLAVASGKGGVGKSTVSVNLAVSLARIGKKVGLIDADIYGFSVPDMMGITVRPTIEGEKVVPVERFGVKVISMGFFVEDNAPVIWRGPMLGKMLNNFFHEVEWGDVDYIILDLPPGTGDVALDVHSMLPSCKEVIVSTPHPTAAFVAARAGAMALKTDHEIVGIVENMAYYESVKTGEKEYVFGKGGGEKLAEELGVPILGKIPLKQPDWDDSEFAPSVYDESHPTGAIYLDIAKKIDESIGAKA

SEQ ID NO: 39659 - protein, 536 aa, Oryza sativa Japonica Group
MAFSSILQLTLCFLCFSVFYYYHIKSKRKNPAIPVCWPLVGMLPDLLVNRHQLHDWITSFLTASQLNFRFIGPTMSSNMRFFFTCDSANVRHIFTSNFANYPKGPDFAEIFDDTLGDGIFNVDGDSWRRQRAKTQLLMYNHRFQSFVSRCSSDKVENALLPLLSHFAGTGERCNLQDVFMRLTFDMSTMLASGEDPGCLAISLPMPKVPFVRAVDYTTRVLLVRHIIPLSLWKLARRLGVGFERKMAEALRTINQFIYETIVKRRAKKANEGIEDSEDLLSSYLKDDDENADTFLRDTTMTLIAAGRDTIGSALSWFFYLLTKNPHVASKILEELDSVERATTTPDGMVTFDPDELKSLVYLHAAVCESLRLYPPVPLDHKGVVAADVMPSGHKVRPGDKIVVSIYAMGRTESVWGSDCMEFRPERWISDDGKLRYVPSYKFTPFITGPRTCLGKDMALVQLKVVAATVVKNFEIEAVPGHIVEPKLSMVLHMKNGLMVRVKRSLLGPSFSSCLDLIGCTRALYLYLQKLFVRCNG

SEQ ID NO: 39660 - protein, 650 aa, Physcomitrella patens subsp. patens
MADSHLSQVQLIQSLIDVVNTIGLKGDYIKSHKKECALLTRRVKLLAPLFEELRESRQKMSYKTCTALHDLEEALQSANKLLQMCHDGSKLYLVLERQAAAEQFDKVNADLECALDALPYDQFASDEVKEQVDLVRSQLKRAKGRVDNHDSQIHSSLVAVLHEKEDSSAGFEELQMLAEKLELRTPAAIRQENQALQEMMLEKQNLGDDNHEQEMCFQQLFTVLRKLTSILPPEESDEDTPELDRISDVESAGAEKAKMQVVPDDFKCPISLDLMKDPVIVATGQTYERACIQRWLDSGHKTCPKTGVLLTHLGLTPNYSLRSVIAQWCESVGMEVPNQVSSKPKPSKLLEYSSGERATVEHLLLKLRSGQADMQRAAAGELRLLAKRNVENRVCIAEAGAIPLLIGLLSTEDLKTQEHAVTALLNLSINDANKGIIVNAGAIKPIVEVLKNGSKEARENAAATLFSLSVVDENKVTIGSLGAIPALVDLLKDGTARGKKDAATALFNLSIYQGNKARAVRAGVVPPLMDLLRDPSAGMVDEALAILAILATHPDGRLAIGQASALPILVDLIKSGSPRNKENAVAITVNLATHDPVHLVTTYKLGAQDPLRSLVNDGTPRAKRKAAQLLENMRKQLESTQPFTGSECCT

SEQ ID NO: 39661 - protein, 612 aa, Ashbya gossypii ATCC 10895
MAQRVFFHMVALVLCQLLNLGLVAAKVHRFNFTTGWVTARPDGVAKQVIGFNGQWPLPDIHVDKGDRVELYLTNGFADVGTTLHFHGLFHNSSEGNLAAMDGPDMVTQCGIPPGQTYLYNFSVPTQVGTYWYHSHTGAQYADGMRGAFVVHDPDAQLEYDEEMTHMVGDIYHKPYTQLVHEFLSRYNPTGAEPVPQNLLFNNTVDGSLYFKPNKTYLLRIINGAFFVSQYLYLEGHEFTIVETDGVYVQPNATNLLYLASGQRVSVLVHTKETTDRNFAFMQLFDEDMLDDIPSSLQLNRTNHVIYDDSKPRANPYFLPDYNNPAEEFYLTPLHGKPLYEHYDRQVVLDLHMDNLADGVNYAFFNNITYTTPKVPTLTTALTAGEFASNPLIYGNVNPFVLRYGEIVEIVINNYDDGKHPFHLHGHNFQLVQKSPASISEDGETVRYNESAPVMPYPEFPATRDTVVLEPNGHIVLRFRADNPGVWIFHCHVNWHMEQGLAAVFIEAPHELQAGDPLSDNYRQVCAASNIPNAGNAGGNSANWLDLSDAPRQQDPLPAGFTAKGYFAFALTTLAGLLGLYTITNFGLQKSVIDDAEMYNKLSVLLKENNVLD

SEQ ID NO: 39662 - protein, 475 aa, Mycoplasma gallisepticum R
MAKTNSTSKNNKLEIKSVFAYQAFDSRGFPTVACEVVLNDGSKGLSMVSSGASTGEKEALELRDGGTKYHGKGVTKAVNNINKKIGPKILGVDATLQTQIDEFMIELDGTKTKAKLGANAILAVSMAVCRAAAKSLNLPLYQYIAKKVAKVKGADFILPVPMLNVINGGAHADNTIDFQEFMIMPVGAKTMAKALQMASEVFHSLQKLLKAKKFNTNKGDEGGFAPNLKSAEEALDLMSQAVVDAGYALGKDVAFALDCAASEFYSKEKQAYVFKKAVKAGILSEEKGTKTTEQLISYLEDLTKKYPIVSIEDGLDENDWKGMESLTKKIGKKVQIVGDDTYCTNPELTSKGVSLSATNSVLIKLNQIGTLTETIQTINIAKKANWTAVVSHRSGETEDAFIADLAVALSTGQIKTGSMSRSERIAKYNRLLAIEMQLGNKAKYLGSKTFYNLSTPAATPKKSPAKKTTKAKSKK

SEQ ID NO: 39663 - protein, 250 aa, Bordetella petrii
MYKLVLMRHGESQWNLENRFTGWTDVDLTETGREQARKAGELLKKEGYQFDLAYTSVLKRAIRTLWIALDAMDAMYTPVGISWRLNERHYGNLQGLNKAETAAKYGDEQVLIWRRAYAIAPEPLPLDDERHPRFDSRYAKIPADQLPATECLQDTVARVLPYWNDSIAPAIRAGRRVLVAAHGNSLRALIKHLDNISDDDIVGLNIPTGQPLVYELDEALRPIRHYYLGDAAEIEAAMAAVAAQGKAKKD

SEQ ID NO: 39664 - protein, 103 aa, Zea mays
MEDFFDIWQETVAKKSLPGQFIHVDSNFSEYGLSDQYSFQHTAVQYATCLQQLMAAITHSQCLDICCVIDIQFTNGFPSSCSFKMPTTGTYKVVKFSIVDSKG

SEQ ID NO: 39665 - protein, 369 aa, Yarrowia lipolytica CLIB122
MLNLRTALRAVRPVTLTRSYATSVASFTGQKNSNGKYTVSLIEGDGIGTEISKAVKDIYHAAKVPIDWEVVDVTPTLVNGKTTIPDSAIESINRNKVALKGPLATPIGKGHVSMNLTLRRTFNLFANVRPCKSVVGYKTPYENVDTLLIRENTEGEYSGIEHTVVPGVVQSIKLITREASERVIRYAYEYALSRGMKKVLVVHKASIMKVSDGLFLEVARELAKEYPSIDLSVELIDNTCLRMVQDPALYRDVVMVMPNLYGDILSDLASGLIGGLGLTPSGNMGDEVSIFEAVHGSAPDIAGKGLANPTALLLSSVMMLRHMGLNDNATNIEQAVFGTIASGPENRTKDLKGTATTSHFAEQIIKRLK

SEQ ID NO: 39666 - protein, 345 aa, Bordetella petrii
MSRPPAPLSVAVLGAGSWGTALAAVASRRHRTVLWARDATQADAMANTRENARYLPGSRLPGALAITSDLSAALAPLAAAPGHALIILGVPVAGLHATCLELAARLPDLGLAQAPVIWTCKGFEADTARLPHEIVADALAMPDARGGVLSGPSFAREVAQGLPVALTIASSHDAVREGATRALHGAAVRVYASTDVAGVEVGGALKNVIAVACGIADGLALGTNARAALITRGLAEMTRFGVALGAQAETFAGLTGLGDLVLTATGDLSRNRRVGLEIGAGRKLSDILASGITAEGVRCARAALQRARSLNVELPITEAVCAVLFDGVAPMTAVSALLAREAREE

SEQ ID NO: 39667 - protein, 435 aa, Bacillus cereus G9241
MGVITLTTGEKITVTNGVMNVPNNPIIPFIEGDGIGPDIWAAASRVLEAAVEKAYDGEKKIVWKEVLAGEKAFNQTGEWLPEETLNLIREYLIAIKGPLTTPVGGGIRSLNVALRQELDLYVCLRPVRYFEGVPSPVKRPEDTDMVIFRENTEDIYAGIEYAQGSPEAEKVLAFLKEAMGVNKIRFPETSGIGIKPISEEGTKRLVRAAIQYAINEKRSSVTLVHKGNIMKFTEGAFKNWGYEVAEQEFGDKVFTWAEYDRIVEKDGKDAANKAMADAEVAGKIIVKDSIADIFLQQILTRPREFDVVATMNLNGDYISDALAAQVGGIGIAPGANINYVTGHAIFEATHGTAPKYAGLDKVNPSSVLLSGVLLLEHLGWNEAAKLVTASVEKTIASKVVTYDFARLMEGATEVKCSEFANELIKNMDVAIIKNA

SEQ ID NO: 39668 - protein, 612 aa, Lactobacillus sakei subsp. sakei 23K
MTNLALVIVLLAALMTPLLMAKFKMSYLPTAVAEIIVGIILGTSGFHLIVSTPTLTELSTLGVTVLIFLSGMEIDFDLFKKQPTPTDPQLKVQPSPVRLAITSFAFILLISFGLSGLLAWSGLFKDIGLATILFSTIALGVVIAALKEKELLSQPLGQTILLIAVLGEIIPLVALTVYSSLNNPGSKSLWLLSLIFVAAIYLLVRFKGVYHFFARIDKSTTQLDIRLAFFLIITLVSIAEEVGAESILGAFLAGMVMKLLRPREETTDKLTSIGYGFFIPIFFIMTGAKLDLPALLADRKSLSLIPFFFIGFMLSKAATYWVLKRRFKQTNAIAGTFLSATTITLVLPILTVGLNLKTITEQQSGAFTLAAILSCILGPILFNRFYQPTPEDLPRKRVKFIGANIMTIPIAQQLSNGLYTTQLFTDNQGNYEIYHSAADLTLLPDLSEDSLVTSGAFDADIIILGYLNHEQNYRLAQLALDAKVPRIIARFEAKDILDEKYDQLKEQGVEVFNTYEANISLLRSLIETPSTLQIIDNTDAGLFEVTVQNRRFTGLQISNLPFVDQVTISRIYRNQELIMPHGDTQIHLNDHLILTGNKKAVPAIRQQLETRN

SEQ ID NO: 39669 - protein, 496 aa, Yarrowia lipolytica CLIB122
MLRQGIKRAVVHARAVQAVCKRTNMTITKKDLNPQVVNAQYAVRGKLAVRADEIKEQMRTNPSLFPFDKVINANIGNPQQLDQKPVTFYRQVLAMLQYPELMDRAADVGIPNDAVQRARKLLDDIGSVGAYSSSQGVTTVRNSVANFIQKRDGYAASASDIYLTTGASNAVTFLLTTLARGDGSDGFMIPIPQYPLYTATLTLQNSNPVPYYLDEAKEWGTNMAALNDAVESSKHKLKAVVVINPGNPTGACLGVKEIKDILLLAQKEGIAVIADEVYQANIFASGQFHSFKKVWSILKEENPDFNVPLASLHSTSKGKIGECGQRGGYMELVGFHEDVIEQIYKLCSISLCPVVTGQALIECMVNPPVEGDESYPLFNKETNHIMDTLTQRANRLYEAFKEMPKVSCEPPQGAMYLFPSIELPAGAIAEAERHNEQPDEFYCMKLLEQTGICVIPGSGFGQKDGTYHFRTTFLAPGDDYGEKIVNFHKKFLAQYE

SEQ ID NO: 39670 - protein, 231 aa, Glycine max
MVETDMDAETVANVVPPKETPNSVPISYHSSHSHPPLNERIISSMTRRSVAAHPWHDLEIGPGAPTIFNCVIEIGKGSKVKYELDKKSGLIKIDRVLYSSVVYPHNYGFIPRTICEDSDPLDVLIIMQEPVLPGCFLRAKAIGLMPMIDQGEKDDKIIAVCADDPEYRHYNDIKELPPHRLAEIRRFFEDYKKNENKEVAVNDFLPASAAFEAVNRSMSLYADYIVESLRR

SEQ ID NO: 39671 - protein, 517 aa, Lactobacillus sakei subsp. sakei 23K
MAQKDMQDFDKIIVLDYGSQYNQLITRRIREFGIFSELLPNTTTAAEIKKIAPKGIIFSGGPMSVYDGGAFSVDPEIFELGIPILGICYGMQLISFKNGGNVEASTEREYGKAEITVTDKDSDLFKGLPEKQTVWMSHGDKVTAIPEGYVTVAESDNTPFTAIENRDKHIYGIQFHTEVQNTEFGNDILKNFAFGVCGAQDNWTMNDFIDMQIEKIREQVGDKKVLLGLSGGVDSSVVGVLLHRAIGDQLVSIFVDHGLLRKGEVEQVMESLGGKFGLNIIQVDAKERFMSKLAGVSDPEKKRKIIGNEFIQVFDEEATKLNGIDFLAQGTLYTDIIESGTSTATTIKSHHNVGGLPEDMQFSLIEPLNTLFKDEVRDLGEKLGMPYELVWRQPFPGPGLGIRVLGEVTEDKLKIVRDSDLILREEFALAGLDKTVWQYFTVLPGIRSVGVMGDGRTYDYTVGIRAVNSIDGMTADFSRIPWDILQKVSVRIVNEVDHVNRIVYDITSKPPSTVEWE

SEQ ID NO: 39672 - protein, 411 aa, Xylella fastidiosa Ann-1
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFRGSFHGRTLGAVTATAQPKYQEGYEPLPGGFRYVDFNHIEALEAAMVGGDVAAVMLEPIQGEGGVMPVVSGYLAQVRALCDRYGALLVLDEIQCGMGRTGALFAYWQEKVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRFGG

SEQ ID NO: 39673 - protein, 336 aa, Chlamydomonas reinhardtii
MAGWAQHSPRVLLLGWRLLRFRRWRDETAQVPRFLVCFLVMLAELTIENCVVWLVSASDLRKYEQVPGLQDNVEIAVRAAAGACPALAAALALPAATVLHFLAALLALAFSVLWDQVPYSGFGMFSRVVLTIAASRVLRMACFMCTVLPNPRPGCYSRRFPPVPATAWETVMAGYTTIRGFGGCNDLIFSGHGAFWVLAPLAFRTYYPAAPSRMLPAGLLAALRRRWLLLPAALQRVWRLLPGLRLRLSTAVLWLALTHASLRDVLDRQHYSVDMLLAVVVTWAVWDWLEWVYPAGRVALPRRPTGSPPDPLNPAVLALILVCLGVAGVIVIGGKA

SEQ ID NO: 39674 - protein, 219 aa, Xylella fastidiosa Ann-1
MPPNAQHSPQTCDPKQMSSPLECAKYLLSAHTIHQLPSDDGSEVAFAGRSNAGKSSVLNTLTRQNALARVSKTPGRTQQLVYFTVTPQRYLVDLPGYGYAKVPKELQIHWQAFIDTYFHHRQSLRGLVVVMDIRHPLKEYDLQMLAYARQRGLPAQALLTKADKLGRGQQAQTLQKVRNELTKHFADHINIQTFSSKSRQGVEQLHTVIETWLGLARSG

SEQ ID NO: 39675 - protein, 214 aa, Thermoanaerobacter tengcongensis MB4
MKISASILAADTAFLGKEVLELEKLGIDFIHVDVIDGHYANNFGFSPKTVKDLRRITDLPIEVHLEILNPENYVEIFSEAGADIIIVQFDTCSHPLRILRKIKALGKKAGVALSPCVSFESLRWCLNDVDYLLFMSVEPGFGGQNFETFTIDKIKLAKVQLKEMGFSIPIGVDGGVNLGNINLLREVGVDIVVVGSALFLNENKERFIFQVKGG

SEQ ID NO: 39676 - protein, 287 aa, Chlamydomonas reinhardtii
MGKAQESKNAEDRGTTEAWKEKDQAITVTEGNGFLYNLKLRAKVDATPSDIYDILTDPNTVSIFRSIKECTYRNEVENDGKGRRKLEIGHRALARFLFINITFETHLHVWEDDVAKTIRFQMAKPGMMQKFDGCWEVKPFTQATLDAIYHPDKAAAAASHHHHHNPFGPQGLFGFLGPKPAEATESLVTLEQSILPRGPTPPGVKGLIRGLCAHQIRCMMEDLRKELQRRKEGTSWVKPVVPEEAEEAARKGGNGKLRQQAAPAASSSLAAASLWRNAAPINIVVQL

SEQ ID NO: 39677 - protein, 394 aa, Staphylococcus epidermidis RP62A
MKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKGQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 39678 - protein, 414 aa, Thermoanaerobacter tengcongensis MB4
MANVKLMPKLGMTMTAGKVVRWLKKEGEKVEAGEPLLEIETDKVTMEEEAGYTGTLLKILVREGEEVPINQPIAIIGGEGEDIEEILKTLKVSEGVEEEKKEEKIKVKIEEKPEEVKREEISKPRATPAARKIAREHGIDLSEVIGSGAHGRIHRKDVEEYIRKRTEIVPSQVTVEQKVEKKEEIPSYRVIPFTGMRKIIAEKMQKSINTAPHFYVTMEVKMREILKLRETLNSKLKEDEAKISLNTLLMKAAGIAIKDYPIFNSYVEEGQIILRNEINIGLAVALDEGLIVPVIREVDKKGLKEIAREEKALIQKAREGKLTPDEYTGGSFTISNLGMFDVVRFAAIINPPEVAILAVGKIREIPVVEEGQIEIEPIMEMTLSSDHRVIDGALAAKFLRRIKEILEDPLQFML

SEQ ID NO: 39679 - protein, 574 aa, Zea mays
RPRVAPFSDPKSSHPQTARPSARAAAMAETGESSPNPAAAPEDTHHEGSEVPAAAVAAVHAQPQLQPQPRPPPQPSKVRLMVSYGGRIQPRPHDNQLAYVNGETKILSLERPVLFADFAARLTTLVGNARDVCVKYQLPGEDLDALISVTNDEDLEHLVVEYDRAHNNGPAAGSGSGRGGATPRLRVFLFPVQPPPPPPPAGLLEPKADQRLYIVEALNTVSLPSSKLDPPPVPSHQSSPPQQQKRESVFAQQSSSPPPPPPQAKHEAVFVQQAPPQPQTAFQMPPPPQPSHVVLTAAGPDYLFGLDNGFVPPPAVKVKDPAGDPPTVRENVPVEIPAKNDDRHPNPAGDHVAVSPVVSPAEYQRQIQELEKLQVADNATHQPPPPATAPAPTHGPVPAALPRNGSDDSLARAYPPVTATPTSNAEYYIPKFPEKPPVPPLSSAPPPTTYVQVQGRYASVAPGSGADHAPVFFIPAPHGYFAAAASPGATSYPAVYAVAPPSATANGSAPSAVVSNATAYAPAPTQVAYDSNGRAIYYTSMLPQYPSAVNGMSAPGGVLGTEPAKQVAVKPTVS

SEQ ID NO: 39680 - protein, 317 aa, Brassica napus
MLLSASATPLRFGGHVPEKPCRMRMKQAIRSSSSNNFDLRTYWTTLITEINQKLDEAIPVKYPAGIYEAMRYSVLAKGAKRAPPVMCVAACELFGGDRLAAFPTACALEMVHAASLIHDDLPCMDDDPVRRGKPSNHTVFGADMAILAGDALFPLGFQHIVSLTPPHLVPRSTILRLISEIARTVGSTGMAAGQYVDLEGGPFPISFAQEKKFGAMGECSAVCGGLLGGATDDELQSLRLYGRAVGMLYQVVDDIRDDDKKSYAGVFGSERAMEMADELSVKAKKELQVFDKYGDASVAPLYSFVDYAAHRDFLLHV

SEQ ID NO: 39681 - protein, 454 aa, Aspergillus fumigatus
MPSETITPLLAHRARTNIQWFTHKHMRQVSRLNAKQHRVNMMTAENWSIRDELVDQYKTLFAQHLSPRHLSYADGMGGDAELLQAAADFFNRVFAAHSRVQPAHLVVGAGCSSLLENLLYDICEPGEGVLIETPFWGGFETSFVLRSNVTAVHVRPPCHGNGSADLDRLVSAYIEAYERALRQAPCRIKAILVCNPHNPCGHIYPPRVIQALLQFAQRHDLFYISDEIYALSTLDEQTAFTSVLSIDVAALGVDLARVFTLYSISKDLGSSGLRLVYCLISSDSQGLRRTDTVQGFGITQAHPDLRLSLAISNHSRVSTFTSLVITALLHDPEAATAILHQNRAALQRSAKLISDFLAFHQIPFVPPAAGVYVWARLGWRSSSRPGDEPSWDEEARLNDRFEAAGVSVGAGQGYCASEPGWFRITFAIPREELVAGLRRIEQVVGMEGQKWTAI

SEQ ID NO: 39682 - protein, 365 aa, Ralstonia metallidurans CH34; identical to SEQ ID NO: 1268

SEQ ID NO: 39683 - protein, 297 aa, Triticum turgidum subsp. dicoccoides
  misc_feature (137)..(157): Xaa can be any naturally occurring amino acid
GFLGLSGAILVQVQRTLHIDPGTFILMLAILPTAIALLLMYFVDVHSAHQRYNKKFLDAFSLMAVTVAGFLMVVIICDQVFMISSAGQSVCFAILLLLIMSPVAIVVRAQRSESKQREEPTSEEQTGLLLHEETAQXXXXXXXXXXXXXXXXXXXXXSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 39684 - protein, 837 aa, Oryza sativa Japonica Group
MPPPLYVLLLLSGLLLSSLHTPPCSAAIADGDTLMVGQALSVGEKLVSRNGKFALGFFQPQPTAGISKSINTTTNTLPGWYLGIWFNKIQVFTTAWVANRENPITGPELKQAQLKISRDGNLAIVLNNNNTSSESIIWSSTHTIVNRTTGSSSTNTSALLMNNGNLLLMASSNVVLWQSFDYPADVGLPGAKLGRNKITGLNRRFVAKKSLIDMGLGSYILEMDTNTVLRLRRRKPPVVVYWSWSSGQLAYTLVPLLNELLDMDPRTKGLLKPAYVHNNEEEYFTYTSLDESASVFVSIDITGQVKLNVWSQPKMSWQTIYAEPSDPCSLHDVCGPFTVCNGNSVPFCGCMESFSPKSPQDWDAGDPIGGCIRDTPLDCASGKQNNTSSTDMFHPIAPVTLPLYPQSMEDASTQSDCEEACLHDCACTAYTYNGNRCSIWHGELRSVNQNDGIDNHSENVLYLRLAARDSQSLRKNNKRRPRVVAIVSIVVSFGLLMLMLLLTIWINKSKWCGVPLYGSQGNDGGIIAFRYTGLVRATKCFSEKLGGGGFGSVFKGMLGDQTAIAVKRLDGARQGEKQFRAEVSSIGMTQHINLIKLIGFCCEGDKRLLVYERMLNGSLDAHLFQSNATVLNWSTRYQIAIGVARGLCYLHQSCRECIIHCDIKPENILLNESFVPKIADFGMAAIVGRDFSRVLTTFRGTVGYLAPEWLSGVAITPKVDVYSFGMVLLEIISGRRNSPKVSASNSYHGAYFPVRAINKLHVGDVHSLMDPRLHDDFSLEEAERVCKVACWCIQEIESDRPTMGEVVRAIEGLHELDMPPMPRLLAAIIEHSDVASI

SEQ ID NO: 39685 - protein, 358 aa, Dehalococcoides ethenogenes 195
MNLSDLRKQIDELDAELVKLMAKRLEVSDQIGKVKEETNSPVQDLSRESEVLNRVQSLARSLGLDPQDIESLYQEILFISKKQQRFTVAFQGAAGAYSEETALKIFGPNTLALPYEQLDGAFEAVEKGMARFAVVPVENSLEGSISRTYDLLFDSNLMVAAEHELRVSHCLIANPETTLEGVKTIYSHPQALGQCQSFLKHLRAELIPAYDTAGSVKMIKEKHLLDGAAIASERAAVIYNMKVLEREIEDNINNYTRFFVLAKQDSAPSGNDKTSVVFAVKHEAGALYDFIKELASRKINMTKLESRPTRLKPWEYNFYLDIEGHRQDENIKQALAKAEDHVIFMKVLGSYPKMKKRI

SEQ ID NO: 39686 - protein, 283 aa, Escherichia coli CFT073
MQKVKLNNGIEMPLLGFGVFQMTDAAECERAVIDAINSGYRLIDTAASYQNEIQVGNALKQSGIARNELFVTTKLWLQDTSYEGAKAQFERSLNRLQLDYVDLYLIHQPYGDVHGAWRAMEELQQAGKIRAIGVSNFHPDRLADLIAFNNVVPAVNQVEVNPFNQQLQAVPWMQSRGIQPEAWAPFAEGKNGLFQHPVLTAIGEKYGKSVGQVVLRWIYQRGIVSLAKSVRKERMEENINILDFELSPEDMLQITALDTATSAFFSHRDPAMVEWLTGRKLDV

SEQ ID NO: 39687 - protein, 492 aa, Bordetella petrii
MKRYQLYIDGQYVDPASGEWFESDNPCDGKPWASIPKSNAEDVDRAVQAAHRAGREGPWATYTPSQRGQLLHRLGDLIARDAEALARTEVRDNGKLYAEMAGQLKYMPQWFYYYGGLADKIEGTVPPIDKPGHFGYTRREPLGVVAAITPWNSPLLLTAWKIAPALAAGCTLVLKPSEFTSASTLEFVKLFEEAGFPPGVVNAVTGFGAEVGTPLVTHPLVRKITFTGSDATGRLINEQASRDFKHVSLELGGKSPNIVFDDANLDDAVNGAVSGIFAATGQTCIAGSRLLLQDSIYDAFVEKLLALARTAKMGDPMQADTQVGPITTPPQYRKVLEYIDIARNEGARLLLGGAPMREGPWKDGRFIQPTIFGDVDNAMRIAQEEVFGPVLSIIRFKDEDEAVRLGNDVRFGLGAGVWTRDIGRALRMADRIQSGTVWVNTYRLVSYLMPFGGYKDSGLGRESGIDAMREYQQVKSVVINAGAPVGNPFVMR

SEQ ID NO: 39688 - protein, 294 aa, Escherichia coli CFT073
MEGLTVEFSVLSNNLKMPMMGFGVFQVTDKDVCKQSVLNAIRTGYRLIDTAAVYGNEDAVGEAVREAISEGLCTREELFITSKLWVQDMLNQDIAAAGIEASLKKSGLECFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 39689 - protein, 206 aa, Zea mays
MQAVIRSFVSGGNVVRSSLLQHLRVVNPAIQPSVLSTRYESTQPARMEEHGFESTTISDVMNAKGKSADGSWLWCTTDDTVYDAVKSMTQHNVGALVVVKPGEQQSLAGIITEKDYLRKIIVQGRSSKSTKVGDIMTEENKLITVTPETKVLVAMQLMTDNRIRHIPVIKDKGMIGMVSIGDVVRRVVHEHREELQRLNAYIQGGY

SEQ ID NO: 39690 - protein, 306 aa, Zea mays
PRVRRPIAGVGCASTGDTSAALSAYCAAAGIPAIVFLPADRISLQQLIQPIANGATVLSLDTDFDGCMRLIREVTAELPIYLANSLNPLRLEGQKTAAIEILQQFNWQVPDWVIVPGGNLGNIYAFYKGFEMCRVLGLVDRVPRLVCAQAANANPLYRYYKSGWTEFEPQTAETTFASAIQIGDPVSVDRAVVALKATDGIVEEATEEELMDATALADRTGMFACPHTGVALAALFKLQGQRIIDPNDRTVVVSTAHGLKFTQSKIDYHDKNIKDMVCQYANPPISVKADFGSVMDVLQKNLNGKI

SEQ ID NO: 39691 - protein, 483 aa, Candidatus Protochlamydia amoebophila UWE25
MMAAQLIPITVAEGDGIGPEIMDATLRILKAAGAPLDIKNVEIGEKVYLSGQPTGIENSTWDLIRQSKALLKAPITTPQGGGFKSLNVTIRTTLGLYANVRPCVAYYPFVETKYPGMNVVIVRENEEDLYTGIEYRQTPDVYEALKLITRPGCEKIIRYAFEYAQIYHRKKVTCFTKDNILKLTDGLFHKIFDEIGAEYPQIEKEHWIVDIGAAKLADTPTAFDVIVMPNLYGDILSDVAAQIAGSVGLAGSANIGNSGAMFEAIHGSAPRRAGQNLANPSGLLLAAIQMLVHLEQSNLAELIHNAWLKTLEEGIHTYDIFKEKTSKQKVGTKEFANAVTARLGKKPETLPAAHYSTSFHIKHSNFSSLKNFKQELYGIDIFIKWSEDVETLATLLQSTSNHDLKLKMINNRGVKVWPNKMPETACIDNWRCRFISSTNKIVSQEQILNLLNRLVQKKLTLTQTAYLFAFDGQAGYTLAQDEQ

SEQ ID NO: 39692 - protein, 402 aa, Bacillus cereus G9241
MHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYDGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 39693 - protein, 133 aa, Magnaporthe grisea 70-15
MLLIRVVFALIIINKAGGLIYNRTFHEDGLNKLSTNDYLVLAAAPGNRPDPPSGLEVLETENFRAQCFCTLTGIKFLLFTDTTQANVDVTIRRIYDLYTDYVMKNPFYQLEMPVRCDMFERKLNSYVREINNR

SEQ ID NO: 39694 - protein, 212 aa, Yarrowia lipolytica CLIB122
MSSDDAQKLWKVYRTAKELVKDRGYTITDKEVNLSFDQFVSEMCDPMGKPIKKKMCFMASPSPEAIEKFPEMGNIWVEFCEEASVTVKTMRNFCIHISENKFATGILVYENNMTPSANRLIPSVAPATIDTFQETDLLVNITKHVLVPTHIKLSGAEKKFLLERYRLKESQLPRIQREDPVARYLGLRRGQIVKIIRRSETSGRYASYRICL

SEQ ID NO: 39695 - protein, 455 aa, Xanthomonas axonopodis pv. citri str. 306
MDPSVLKALQQLDAAHHLHPFNDNAALAQKGTRILTRGEGVYVWDADGNQLLDAFGGLWCVNVGYGRKELAQAAARQMEQLAYYNSFFQCTTEPTIQLAAKLAELAPGDLNHAFFANSGSEANDTILRLVRHFWAVQGQPQKRIFIGRHDGYHGTTMAGASLGGMRGMHQQGGLPIADIHHVAPPYHFGDGGEMDPEEYGLLAARRLEDKILELGPDNVAAFIGEPIMGATGVYIPPRSYWPEIERICRRYDVLLVADEVICGFGRTGEWFGAEYFGFQPDVMTLAKGITSGYIPLAAAMFNDRVAGVLKTQGGELAHGGTYAGHPVCAAVALENLRLLQDEGIVETARTQVAPYLAQRWAALGEHRLVGEARIAGLVGALELVPDKQRRGAYFPRRGRVGAMCRDFALRRGLILRATYDAMLLSPPLIITPAQVDELFDKAWAALDDTAQALGR

SEQ ID NO: 39696 - protein, 434 aa, Prochlorococcus marinus str. MIT 9303
MTSSVSSDQSMPLAMAAVEASANLADLTRADFPLLGQTACLGQPLIYMDHAATSQKPRQVLDALQHYYDHDNANVHRGAHQLSVRATEDFERARQKVADFIAASSAREIVFTRNASEAINLVARSWGDANLHEGDEVLLTLMEHHSNIVPWQMLAKRTGCVLRFVDLTDCGELDLNDLRQKLSERTRLVSLAHLSNVLGCFNPISEVTAEAHRFGALVLLDACQSLPHMPVDVSRLGCDFLVGSSHKLCGPTGMGFLWAREELLDAMPPFLGGGEMIQDVYLDHSSWADLPYKFEAGTPAIGEAIGMGVALDYLNQVGLDRIHAWEQQLTLQLFDRLQGIDGLTILGPTPQQEPDRAVLAAFTVDGLHPNDIGALLDSAGICIRSGHHCTQPLHRHYGIPGSARASLSFTNTPEEVDRFAEELVSTIGFLREHS

SEQ ID NO: 39697 - protein, 459 aa, Xanthomonas axonopodis pv. citri str. 306
MASETSVASLPAADAHTLSRIAGCESVDLLLPDTNGVLRGKRVTADALSKVYRDGVCLPMSLIATDITGNTVEETGLGYAIGDADRICRPIEGSLRLVPWAPRPMAQLLLAMHTPEGGLFEVAPRAVLQRVLQGFGALGLTPVIAVELEFYLFDAVADAQGRPQTPRDPITGERSDSTQVYSLQDLDDQRGFTDAVTVACRQQGIPADTAVAEYAPGQFEINLQHRADAVAACDEAVLLKRTIKAIAQQRGKLASFMAKPFPGQAGSGLHVHVSLLDAAGHNVLASAADAPAQSLRHAIAGLQRHADASLLMFAPHANSYRRFVSNAFVPLDASWGFNNRTVALRIPHSDAHNTRIEHRIAGADANPYLAAAAVLAAMLDGLRQPAEPTAPVTGNAYAQSVFAPRSWQGAVDAFLGSDFIGEQFGTQFQHVFGQQKQRELLDYQAQVPDLDYARYLRTV

SEQ ID NO: 39698 - protein, 238 aa, Propionibacterium acnes KPA171202
MSMADNLAAVRTRIDDACRACDRNPGEVSLLPVSKTKPPSMVDEAYRAGYRLFGENKVQDALAKSELMDANHPGLEWSIIGGLQTNKAKYVARFATEFQALDSLKIAHELDKRLQKEGRQLRVLVQVNSSAEPQKSGIAPEEAVDFARELAAFDSLDVRGLMTVALNSSDQRAVADCFDLVVATQEKLRQEAGDTSDWSELSMGMSGDLEIAIAHGSTQVRIGTDIFGARDPARTWRP

SEQ ID NO: 39699 - protein, 497 aa, Streptomyces nodosus
MTPQPPPPKADNGQAGRTGPTSPAEHGSGLQAGLKNRHLSMIAIGGVIGAGLFVGSSSGIATAGPGILLSYALVGTLVVLVMRMLGEMSAANPTSGSFSAHADRALGSWAGFSIGWLYWFFWVVVLAVEATAGAAILSSWVPAVPQWGWALIVMIVLTATNLISVGSYGEFEFWFAGIKVVAISIFIVIGLLAVFGVLPGVHADKAGLGNLTDHGGFLPHGLSAIFTGVLLVVFSFMGSEIATLAAGESEDPQRAVTKATNSIIWRIGVFYLGSVFVVVTLLPWNDKAIAEKGSYVAALDSLGIAHAGEIMKFIVLTSVLSCLNSGLYTASRMAFSLGERGDAPKAFARTNSRGVPMAAILSSVVFGFVAVFFNYRFPDSVFLFLVNSSGAVALFVWLVICFSQLRLRRIIQSEAPEKLIVKMWLYPYLTWAAAFLIILVFGYMLTDTEHDGRETVLLSMLVAVIVLAVAFIKQRVEGGRAKATEPAAAEAEKVSAG

SEQ ID NO: 39700 - protein, 111 aa, Brassica napus
  misc_feature (75)..(75): Xaa can be any naturally occurring amino acid
  misc_feature (105)..(105): Xaa can be any naturally occurring amino acid
MSSIQQTAMKPRMGSFKKRSSSKNLRYSMKRRTSSKVTPVEIEDVHDAEELKSVDAFRQALILDELLPEKHDDYXMMLRFLKARKFDLDKTKLMWTEMLRWRKEXGADTVM

SEQ ID NO: 39701 - protein, 467 aa, Thermoanaerobacter tengcongensis MB4
MNDVGLIGLAVMGQNFALNMARKGYRVSVYNRTPERTKKFVEEKVRDESIFPFYTIEEFVKSLKKPRKIILMIKAGKAVDDMIAEILPYLELGDLIVDSGNSHFADTARRLEYLSQKNILFLGMGISGGEYGALHGPSLMPGGTKEAYDLIKDILLKAAAKTEDGPCCTYVGKGSAGHFVKMVHNGIEYAIMQLIAEVYDFMKKVLNMTNEQIGDVFEKWNKGELNSYLMEISYKIMRYKDKETGGFLIDYILDKAEQKGTGKWTAQTSLDLGVPTPTLNLAVEARIISHYKEERKILSKLYSKEKNIISVNKEEMIEHLKKALLFGVFMSFSQGLWLIDEASKQYNYGIDLSEILRIWKGGCIIRAEILDFLRDIIRENEEDANLLHSDKAIDFIKDKLNSIYQVTEIGKNYRIPLMTMNSALDYYFALTEENLPANIIQAQRDFFGAHTYERIDREGIFHTEWER

SEQ ID NO: 39702 - protein, 297 aa, Triticum turgidum subsp. dicoccoides
GFLGLSGAILVQVQRTLHIDPGSFILMLAILPTAIALLLMYFVDVHSAHQRYNKKFLDAFSLMAVTVAGFLMVVIICDQVFMISSAGQSVCFAILLLLIMSPVTIVVRAQRSESKQREEPTSEEQTGLLLHEETAQQDSENASSSTPLVGSNNQDMSSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGLHASLYVGSVLVGLCYGSQWALMPSITSEIFGL

SEQ ID NO: 39703 - protein, 306 aa, Thermoanaerobacter tengcongensis MB4
MRKIVVVGSINMDIVIRVPRIPVVGETVIAYDLKNYGGGKGANQAVSIARLGGNVSMIGRVGNDEYGQKLYRDLKSNGVGVEGIEFDSETPTGTAYINVSEKGENNIVVYQGANKRLNMTQIKRYEHFFDEAEICLLQLEIPIETVKFVVDLCYSRGIKVILNPAPAYELPDTVLEKVYILTPNETELAFLSKSKIETIEDIRKASKYLLDKGVQNVITTIGEKGSYFINKNTEKLFDAIKVTAVDTTAAGDSFTGALAFALSKGEKIEDAIRFATFVAALTVTKEGAQTSLPYKEEVEKFIKERS

SEQ ID NO: 39704 - protein, 389 aa, Arabidopsis thaliana
  misc_feature (196)..(196): Xaa can be any naturally occurring amino acid
MTVSEAYSPPLFSIAPMMGWTDNHYRTLARLITKHAWLYTEMLAAETIVYQEDNLDSFLAFSPDQHPIVLQIGGRNLENLAKATRLANAYAYDEINFNCGCPSPKVSGRGCFGALLMLDPKFVGEAMSVIAANTNAAVTVKCRIGVDDHDSYNELCDFIHIVSSLSPTKHFIIHSRKALLSGLSPSDNRRIPPLKXCRKFFFALLRDFPDLKFTINGGINSVVEADAALRSGAHGVMLGRAVYYNPWHILGHVDTVVYGSPSSGITRRQVLEKYKLYGESVLGKYGKGRPNLRDIVRPLINLFHSESGNGQWKRRTDAALLHCTTLQSFLDEVLPAIPDYVLDSSAVKEATGREDLFADVQRLLPPPYEKESFKALERIPTRPVILDEE

SEQ ID NO: 39705 - protein, 433 aa, Prochlorococcus marinus str. NATL2A
MADSLELVIDTIMAREVLDSRGNPTVEAEVLLEGGAIGRSIVPSGASTGAHEAHELRDGGKRYLGKGVLQAVNHIEENIAPALCGLSSLDQATVDSVMKQLDDTDNKSNLGANSILAVSMATARAAANGLGLPLYRYLGGPMSSLLPVPLMNVINGGEHAANNLDFQEFMLVPHGAESFREALRMGAEVFHTLKDLLSQKGLSTAVGDEGGFAPNLESNKAAGDLLMQAIEQAGFKPGEQVSLALDVASTEFYAEGQYCYGGNSYSSEQMVEELAGLVNAFPIVSIEDGLAEDDWDGWRLLTKKLGKNVQLVGDDLFVTNTLRLQRGIDENIANSILIKVNQIGSLTETLEAIELASRSSYTTVISHRSGETEDTTIADLSVATKSGQIKTGSLSRSERVAKYNQLLRIEDELGSQATYAGLVGLGPRGSLKG

SEQ ID NO: 39706 - protein, 510 aa, Arabidopsis thaliana
MDPHKKVALETEFFTEYGEASRYQIQEVIGKGSYGVVASAIDTHSCEKVAIKKSNDVFEHVSDATRILREIKLLRLLRHPDIVEIKHVMLPPSRRDFRDIYVVFELMESDLHQVIKANDDLTPEHYQFFLYQLLRGLKFIHTANVFHRDLKPKNILANSDCKLKICDFGLARVSFNDAPSAIFWTDYVANRWYRAPELCGSFFSKYTPAIDIWSIGCIFAEMLTGKPLFPGKNVVHQLDIMTDLLGTPPPEAIARIRNEKARRYLGNMRRKPPVPFTHKFPHVDPLALRLLHRLLAFDPKDRPSAEEALADPYFYGLANVDREPSTQPIPKLEFEFERRKLTKEDVRELIYREILEYHPQMLQEYLRGGEQTSFMYPSGVDRFKRQFAHLEENYGKGEKGSPLQRQHASLPRERVPAPKKENGSHNHDIENRSIASLVTTLESPPTSQHEGSDYRNGTSQQGYSARSLLKSASISASKCIGMKPRNKSEYGESNNDTVDALSQKVAALHT

SEQ ID NO: 39707 - protein, 221 aa, Oryza sativa
MAAAAPATTSSAAARPSSSSSFSRQSDAPLRAATVSFPYSPRPAALAAGARASRVSPVVVAAGGGHQRLMGSLTNTQGLRFGVVVARFNEIVTNLLLQGALETFERYSVKKENITVVSVPGSFEIPVAAQKLGKSGKFDAILCIGAVIRGDTTHYDAVANSAASGVLSAGLSAEIPCIFGVLTCDDMDQALNRAGGKAGNKGAEAALTAIEMASLFQHHLA

SEQ ID NO: 39708 - protein, 356 aa, Methanosarcina acetivorans C2A
MNNMKGFAMLEIGKVGWIDAERPSAGPYDAIVRPLAVAPCTSDVHTVWEGALGERKNMILGHEAVGVIDEIGSEVKDFKPDDKVIIPAVTPDWRSMEAQDEIPMHSNGMLGGWKFSNFKNGVFAEYFHVNDADMNLALLPKGMPLEQAVMLSDMATTGIQGAEMANIKTGSTVAVIGIGPVGLMAVAGASILGAGRLIAVGSRKVTVDLALEYGASEVVDYRKGGLVGQILEKTNGKGVDSVIIAGGNENTISDAVKIVKPGGTVSNVNYYGTGDTLPIPRIEWGSGMAHKDIRGGLTTGGRLRMERMAALCTYGRIKPEKMATHVFEGFDKIEEALMLMKDKPRDLIKPVVLLEE

SEQ ID NO: 39709 - protein, 110 aa, Aspergillus oryzae
MSIELQQLIPNLYSPVIFKALTSSGPVVVDFFATWCGPCKAVAPVVGKLSETYENVRFIQVDVDKNRQVAQDMKVRAMPTFIVFKDGKPHGEPIVGGNMKALEDRIKEVA

SEQ ID NO: 39710 - protein, 412 aa, Rickettsia conorii str. Malish 7
MKENFNVSKLKNGLTILTYNMPYVNSVAINLIAKVGARYENAEEDGISHFLEHMAFKGTKTRTAKQIAEAFDAIGGHFNAYTGHENTVYYARVLSENCDKALNILADIIQNSIFSDEEIAKEYQVIMQEIAHHQDNPDDLVYEKFYNKVYREQPLGKSILGTAKTLATFTKEHFFNFIDKYYNAANLYLSIAGNIDHDKIVIIAEQLFSSLKQGVKSSFIPAKYIGGNGFINKELEQTSLVLGFEGTSYINLEKLYQTHLLSIIFGGGMSSRLFQSIREKLGLAYAVGSYNSAYFDSGVFTIYASTAHDKLELLYKEIKNEIIKMTEQVSTEEILRAKTQLRSNLQMAQEKNTYKSEEIGKNYSVFGQYISPEEIMEIIMSIKADDIINTANKIFSGTTTSAIIGPNDLQGF

SEQ ID NO: 39711 - protein, 297 aa, Triticum turgidum subsp. dicoccoides
  misc_feature (136)..(153): Xaa can be any naturally occurring amino acid
GFLGLSGAILVQVQRTLHIDPGSFILMLAILPTAIVLLLMYFVDVHSAHQRYNKKFLDAFSLMAVTVAGFLMVVIICDQVFMISSAGQSVCFAILLLLIMSPVAIVVRAQRSESKQREEPTSEEQTGLLLHEETAXXXXXXXXXXXXXXXXXXQDMSSDKAENLNVVQAMCKLDFWLLFLAMACGMGSGLATVNNISQIGGSLGYTSRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 39712 - protein, 165 aa, Triticum aestivum
KDDESLRRWKEQLLGSVDLNSVGETLEPDVKIMSLSIQSPGRPDIFLPLPVEPSSGKGVWFTLKEGSPYKLKFTFSVSNNIVSGLRYTNTVWKTGIKVDSAKEMLGTFSPQPEPYAYVTPEETTPSGMFARGSYSAKTKFLDDDRKCYLQINYTFDIRREWPSSG

SEQ ID NO: 39713 - protein, 555 aa, Prochlorococcus marinus str. NATL2A
MALINGFHLKNIRGDVLGGLTAAVVALPLALAFGNAALGPGGAIYGLYGAVVVGFLAALFGGTPAQVSGPTGPMSVTVAGVVASLAAVGVPRDLSAGEILPLVMAAVVIGGLFQILFGLLRLGKYITLVPYSVVSGFMSGIGVIIITLQIGPLLGISTRGGVLESLSTLFNNFEPNGAAIAVATMTLAIVFLTPRKISQWVPSPLLALLIVTPLSILLFGDSSLDRIGAIPEGGLSLSLPDPSLGNFFPIILKAGLVLAVLGAIDSLLTSLVADNISQTRHNSDRELIGQGIGNAVAGIFTGLPGAGATMRTVINVKSGGSTPISGMVHSVVLLFVLVGAGPLAAQIPTALLAGILIKVGLDIIDWGFLLRAHKLSLKTASVMYGVLFMTVFWDLIWAVLVGVFIANMLTIDSITETQLEGMEADNPFDSSSNNNAANAQLPSDEKALLDRCAGEVMLFRLKGPLSFGAAKGITERMMLVRNYKVLILDITDVPRLGVTATLAIEDMVQEALSNSRKAYVAGATGRVKDRLAKFGVDVIGTRKEALVAAIDSLNG

SEQ ID NO: 39714 - protein, 402 aa, Aspergillus oryzae
MIMNSSHYPVALLAGAPARTTVNRYIFTTDGDHWAQSRAMIRPNFVKDQVAHLDIFEELMADLLALIPTDGTTVDLQDLFFCYTIDSATEFLFGHSVQSLKKRLSGVKLDDNDFASSFNYAQDAIAKNTRLGPLRHFFRDTKAEHCNQVCHELVEQFVEKALKYRANYDEEKAATDDDKKQRYLFLQGLAQQTGDPKRIRDELMNVLLAGRDTTASLLSNMFFMLAKNPHIWNKLREEVASLEGRAPTYEQLRNLTYLKYCMNESLRLHPVVPSNARFAINDTVLPVGGGPDGNAPVFVPKGSIVAYSVYSMHRREDFYGPDANEYRPERWADLRPSWEYLPFNGGPRICVGQQYALTEAGYVTVRLAQQFSVLESRDPGPWEENLTLTLCSRNGTKVALRH

SEQ ID NO: 39715 - protein, 339 aa, Escherichia coli
MNILVTGGAGYIGSHTSLCLLNKGYNVVIIDNLSNSSCESIRRIELLAKKKVVFYELNINNEKKVDQILKKHKVDCVMHFAGAKSVAESLIKPIFYNDNNVAGTLQLINCAIKNDVANFIFSSSATVYGESEIMPVTEDCHIGGTLNPYGTSKYISELMIRDIAKKYSDTNFLCLRYFNPTGAHESGIIGENPADIPSNLVPYILQVAMGKLEKLMVFGGDYPTKDGTGVRDYIHVMDLAEGHVAALSYLSSCNNTNYHVFNLGTGKGYSVLELVSTFEKISGVGIPYEIVSRREGDVAESWSSPEKANKYLNWSAKRALETMLEDAWRWQLKNPNGYK

SEQ ID NO: 39716 - protein, 469 aa, Pseudomonas syringae pv. syringae B728a
MSETTSPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPGWVSAAAFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDTAAHILNFVVLTAALSVYNSGTYCNSRMLVGMAEQGDAPRALAQVDKRGVPVKAIFASAAVTLVAVLLNYFVPQQALELLMSLVVATLVINWAMISYSHLKFRQHMNRTAQVPLFKALWYPYGNYVCLAFVVFILGIMLMIPGIQISVYAIPVWLAVMWVCYRAKNRRSVVVPAESGK

SEQ ID NO: 39717 - protein, 410 aa, Serratia liquefaciens
MTFTPELARRQFSALSQHIDGKPAIFFDGPGGAQVSRGVLEKMTDYLGKYNANLGGHYFSSRVTGEVMGQARESVRALLNAPSPDNIVFGMNMTTLTFHLSRIISRDWRAGDEVIVTALDHYANVSSWQQAAADKGAVVHQIPLESADCALDAAKVCERINANTRLVAVSYASNVTGSIVDIKTIVEAAHRVGAQVYVDAVHYAPHNLIDVQALGCDFLVCSAYKFFGPHVGMAYLAPQWLQRLRPYKVEPATDVGPGRFETGTQSFEALAGVAAAIDYLAQWGTPDAPLRQRLQESFAAYHRHEEALCRHFLQRLQHLDGVRLYGHSQADSARRTPTFALTFSGQTPDAIARRLGQHNICAGSGHFYALGLIQQLGLQDGGVLRIGMMHYNTQGEIDALFKVIAEDILS

SEQ ID NO: 39718 - protein, 238 aa, Yarrowia lipolytica CLIB122
MVVQHHSSTTTSPHYYTIQTTMTVQENVNQEPIEHRFNPYGGDDFALLAGDTRNTTGYSINSRYQPKVFDVGDNILVTANGFSADGDALIENIKQHVELYHYQNNKPLKVQSCARAIQHMLYNKRFFPYYVHTIIAGLDEEGKGAVYSYDPVGSYEREFCRAGGSAASLVMPFLDSQVNKKNQQVENPPPLTLEEALKVVKDAFSSATERHIHVGDGLEILIVTKEGVRKEFFPLKRD

SEQ ID NO: 39719 - protein, 120 aa, Glycine max
MAGSSEEGQVISCHTVEEWNDQLQKGNESKKLIVVDFTASWCGPCRFIAPFLAELAKKFTSVIFLKVDVDELKSVSQDWAIEAMPTFVFVKEGTLLDKVVGAKKDELQQKIQKHVASSNA

SEQ ID NO: 39720 - protein, 482 aa, Pisum sativum
MVVEKNASKNHHHQTFDVSIDQQLDSKFFDDDGRVKRTGTSWTASAHVITAVIGSGVLSLAWAIAQLGWIAGPVVMILFAWVTYYTSVLLAECYRNGDPVNGKRNYTYMEVVHSNLGGLQVQFCGFIQYLNLIGVAIGYTVASAISMMAIERSNCYHRSGGKDPCHMNSNAYMIAFGAVQIIVSQIPDFDQLWWLSIVAAVMSFTYSTIGLGLGIGKVMENKKFAGTITGVNDVTKAQKTWGSLQALGDIAFAYSFSMILIEIQDTVKAPPPSESKTMKKATLISVIVTTFFYMLCGCLGYAAFGNSSPGNLLTGFGFYNPFWLLDIANAAIVIHLIGAYQVYCQPLYAFVENYMVKRFPDNYFLNKNIKIPIPGLDMYKLNLFKLVWRTVFVILTTLVSMLLPFFNDIVGLLGALGFWPLTVYFPVEMYIIQKKIPKWSTKWTCLQLLSGACLIITIAASVGSIAGIYLDLKVFKPFKTIY

SEQ ID NO: 39721 - protein, 450 aa, Xanthomonas axonopodis pv. citri str. 306
MPDHLPSDAADALQAPTQLDAFWMPFTANRQFKARPRLLASAQGMYYRDVQGRQILDGTAGLWCCNAGHSRERIVAAIRDQAGTLDFAPTFQMGSPLPFVLAQRLAAIAPPGLGHVFFTNSGSEAVDSAMKIVLAYHRLRGEGQRTRFIGREKAYHGVGFGGMSIGGLPNNRKWFGPLLAGTDHLPHTLDLQHNAYARGLPVHGAELADDLERLITLHDASTIAAVFVEPVSGSAGVILPPEGYLQRLRAICDRHGIVLVFDEVITGFGRVGDAFAAQRFGVIPDIITAAKGLTSGTVPMGAVLVADAIHDAFMHGPQNAIELFHGYTYSGHPLACAAAIATLDTYAEEELFTRAITLGPQWEDALHGLRGSPHVIDIRNIGLIGAIELAPRDGAPGARGYDVFERCFHEGGLLVRVTGDVIALSPPLIVTPEQIGQMVETLGKILRQVD

SEQ ID NO: 39722 - protein, 481 aa, Propionibacterium acnes KPA171202
MASNGHARVEMKPGDSGSAGATRNSQTSRAVFIAVTAAALGITYGYDISNTAAALQFVQRDFGIYSAINTASVVGQIAGAILGGPMANAIGRKKSMLVIAAGYTIFAILTAISPSAGLFLAMRVLLGITIGLSITVVPVFIAESAPASRRGGLATAYQVTCVVGIILGYLVGYSLLPTDTWRWILGVAAVPAFIVLLMLVRTQETPSWYMLKGREDEARRAMERIEVAELVEPSLDEIRNSLSSRPSGSVWGRLREMFHGGMARATIFAIVLGFSIQITGINATIYYAPGIYSRMGFTDTATTYLVPSLVQFLSLISVVISMLVIDKVGRRFVLITGISTMIVATIVLIVTYLASGFEGAVAGIIGLVGMSLFTMGFTFGFGSIVWVYAGEIFPARYRSLGASLVLTADLIANAITAQLGAAMLDGIGLAGTFGVYGGLLVVALLFLLRYAPETSGRSLEEIQDYWNNGARWPKADSPSMG

SEQ ID NO: 39723 - protein, 468 aa, Pisum sativum
GTSIEGAVASHNDSKLFDDDDRLKRTGTVWTTSSHIITAVVGSGVLSLAWAIAQLGWVIGPSVMLFFSLITWYTSSLLAECYRIGDPHSGKRNYTFMEAVHTILGGFNDTLCGIVQYSNLYGTAIGYTIAAAISMMAIKRSGCFHSSGGKDGCHISSNPYMISFGVIQIFFSQIPDFHKMWWLSIVAAIMSFTYSLIGLGLAIAKVAENGSFKGSLTGVTIGMVTEAQKVWGVFQALGNIAFAYSYSQILIEIQDTIKNPPSEVKTMKQATRISIGVTTIFYMLCGGMGYAAFGDTSPGNLLTGFGFYNPYWLIDIANAAIVIHLVGAYQVYAQPLFAFVEKIMIKRWPKINKEYIVTIPGFHPYHLNLFRLIWRTIFVITTTVISMLIPFFNDVLGLIGAVGFWPLTVYFPVEMYIKQKKIPKWNYKWICMQTLSVICFVVSVVATVGSVASIVLDLKKYKPFTTDY

SEQ ID NO: 39724 - protein, 167 aa, Bacillus subtilis
  misc_feature (1)..(1): Xaa can be any naturally occurring amino acid
  misc_feature (52)..(52): Xaa can be any naturally occurring amino acid
  misc_feature (82)..(82): Xaa can be any naturally occurring amino acid
  misc_feature (118)..(118): Xaa can be any naturally occurring amino acid
  misc_feature (130)..(130): Xaa can be any naturally occurring amino acid
  misc_feature (137)..(137): Xaa can be any naturally occurring amino acid
XNINIVTIGKLKEKYLKQGIEEYTKRLSAYAKIDIIELPDEKAPENLSDQDXKIIKDKEGDRILSKISPDAHVIALAIEGKXKTSEELADTIDKLATYGKSKVTFVIGGSLGLSDTVXKRADEKLSFSKXTFPHQLXRLILVEQIYRAFRINRGEPYHKLEHHHHHH

SEQ ID NO: 39725 - protein, 380 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPIYHFVGTSTFSEYTVVHVGCVAKINPAAPLDKVCVLSCGISTGLGATLNVAKPWKGSSVAIFGLGAVGLAAAEGARIAGASRIIGIDLNPKRFNDAKKFGVTEFVNPKDHDKPVQEVIAEMTDGGVDRSVECTGNVNAMISAFECVHDGWGVAVLVGVPNKDDSFKTHPVNLLNERTLKGTFFGNYKPRSDLPSVVEKYMNKELELEKFITHEVPFAEINKAFEYMLSGDGLRCIIRMNA

SEQ ID NO: 39726 - protein, 309 aa, Crocosphaera watsonii WH 8501
MVMTGEDRVTHTEASNFELASYLKEKKQLVEAALDQSLHITRPEKIYEAMRYSLLAGGKRLRPILCLTTCELMGGTVEMSLPTACALEMIHTMSLIHDDLPAMDNDDYRRGKLTNHKVYGEDIAILAGDALLSYAFEYVATQTCNVDFPNLIDVIARLGRTVGAAGLVGGQVLDLESEGRTDVTVDTLKFIHIHKTGALLETSVVSGAILAGAKPEDIERLSRYAQNIGLAFQIIDDVLDVTASSEELGKTAGKDERAQKATYPSLWGLEESQKQAQALIDDAIAQLSPYGQAAQPLEAIAQFIVARKN

SEQ ID NO: 39727 - protein, 380 aa, Vitis vinifera
MSGTAGQVIRCKAAVAWEAGKPLVIEEVEVAPPQAMEVRLKILFTSLCHTDVYFWEAKGQTPLFPRIFGHEAGGIVESVGEGVTDLQPGDHVLPVFTGECKDCRHCKSEESNMCDLLRINTDRGVMLNDNKSRFSINGKPIYHFVGTSTFSEYTVVHVGCVAKINPAAPLDKVCVLSCGISTGLGATLNVARPWKGSSVAIFGLGAVGLAAAEGARIAGAARIIGIDLNPKRFNEAKKFGVTEFVNPKDHDKPVQEVIAEMTGGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLQGDGLRCIIRMDP

SEQ ID NO: 39728 - protein, 316 aa, Vibrio angustum S14
MNNKIKKAVIPVAGLGTRMLPATKAIPKEMLPLVDKPLIQYIVNECVNAGIKEIVLVTHSSKNAIENHFDTSFELEATLEARVKRQLLDEVQAICPKDVTIMHVRQGQAKGLGHAVLCAKPLVGDEPFAVVLPDVILDEYTADQSKENLAAMISHFEQTGASQIMVEPVPMSDVSKYGVVDCNGTELKAGESCPMTRMVEKPAVEGAPSNLAVVGRYVLSHNIWDKLAITPPGAGDEIQLTDAIDMLMQDETVEAFHMTGRSHDCGDKLGYAKAFVEYGMHDKALGEAFTAYIKSLNDTSFTDSLDLTPLSEKIDA

SEQ ID NO: 39729 - protein, 349 aa, Oryza sativa Japonica Group
MEEEKAAAYYDELSRKGEGARRFKQGLGFSSSDPQSTSFPSKPPSTSSSFLSGFVRAGATPAPAQPTKQPPPPPPPPHEPSRTGRHSRSPSPSRRHRTRSSSPSRLAAPPVQVEGAEAPVQVQGEGEGGPQGVAPPLPVSFSVAVAFSPKREELVLREPAWGQAARRWWRPPWKLEGARWQGGWFLVLGSDGLSIFFQTPAERVKAKMKLQLSETASKDSTLGNATVGWERFEFNKDAPLDEDDNDVEVANDDASLVKHIGKSFRLSAVQSKHEDTVRDAHENAIFGVPAYPIVDTETTEAEPETNDESEKAKDVEAEPSSSLISDKVLATQSGSWRERAQKLRQNPNA

SEQ ID NO: 39730 - protein, 388 aa, Vibrio angustum S14
MKIAIAGTGYVGLSNAMLLAKHHEVIAVDIIEEKVRLLNDKISPIVDKEIEDFLQNKALNFTATLNKELAYKDAEYVVIATPTDYDTVNNYFNTSSVEAVIKDVMAINPNAIMIIKSTVPVGYTKQVKEQFNCENIIFSPEFLREGRALYDNLYPSRIIVGEQSKRAEVFANLLVEGAIKKDIPVLFTDSTEAEAVKLFSNTYLAMRVAYFNELDTYAASNGLDSRQIIEGVGLDPRIGNHYNNPSFGYGGYCLPKDTKQLRANYRDVPNNIIGAIVDANTTRKDFIADSIIARNPKRVGIYRLIMKAGSDNFRASSIQGIMKRIKAKGIEVVVYEPVLKEKEFFNSLVIEDLNTFKQECDVIVSNRMVEELSDVAEKVYTRDLFGAD

SEQ ID NO: 39731 - protein, 468 aa, Vibrio angustum S14
MLLPVIMAGGSGSRLWPLSRTLYPKQFLALTSNATMLQETVKRLDGIDHQAPLLICNEEHRFIVAEQLRKGGMDNSGIILEPVGRNTAPAIALAALKAVVNDEDPLLLVLAADHVIQDTDAFLASVQHAKAEAEKGKLVTFGIVPTHPETGYGYIARGDAINNNAYYVNAFKEKPVLELAKKYVNSGEYYWNSGMFLFKASRYLAELEKYSPDILKACQAAINTATQDLDFTRLDKDIFECCPDDSIDYAVMENTKDAVVVPMDANWSDVGSWSALWEVNEKDASGNATRGDVLVENTSNSYIFSQNKLVATVGVDDLIVVETKDAVLVAHKDKVQDVKGIVGQLKQASRYEYLQHREVYRPWGTHDEIAEGDRFHVKHVMVKPGERTATQMHYHRAEHWVIVKGTAKVINGDKSYLLSENESTYIPIGSPHSIANPGQIPLELIEVRSGAYLSEDDVVRLEDYGVGY

SEQ ID NO: 39732 - protein, 310 aa, Arabidopsis thaliana
MADKKIRIGINGFGRIGRLVARVVLQRDDVELVAVNDPFITTEYMTYMFKYDSVHGQWKHHELKVKDDKTLLFGEKPVTVFGIRNPEDIPWGEAGADFVVESTGVFTDKDKAAAHLKGGAKKVVISAPSKDAPMFVVGVNEHEFGIVEGLMTTVHSITATQKTVDGPSMKDWRGGRAASFNIIPSSTGAAKAVGKVLPSLNGKLTGMSFRVPTVDVSVVDLTVRLEKAATYDEIKKAIKEESEGKMKGILGYTEDDVVSTDFVGDNRSSIFDAKAGIALSDKFVKLVSWYDNEWGYSSRVVDLIVHMSKA

SEQ ID NO: 39733 - protein, 266 aa, Glycine max
MASVTSPTTLISSSTRAFPAKSYSLPSPSVSFLRTLSSPSSSASLRSAFAQRSSLSSSSRRSFAVKAQTDDLPLVGNKAPDFEAEAVFDQEFIKVKLSEYIGKKYVILFFYPLDFTFVCPTEITAFSDRYAEFEKLNTEVLGVSVDSVFSHLAWVQTDRKSGGLGDLNYPLISDVTKSISKSFGVLIHDQGIALRGLFIIDKEGVIQHSTINNLGIGRSVDETMRTLQALQYIQENPDEVCPAGWKPGEKSMKPDPKLSKEYFSAI

SEQ ID NO: 39734 - protein, 359 aa, Dehalococcoides ethenogenes 195
MSHNVTLIPGDGIGPEISEATRRVLEATGVKFNWEIVNAGADVVAEYGTPLPDMVLESIRKNKVAIKGPVTTPVGSGFRSVNVGMRKALNLYTCLRPCKTYPGVPSRYDNVDIVIVRENMEDLYAGIEFEKGSPEALRLIEFIKENKKVEIRADSGISIKPISVFGTERIFRWAFKYARDNKRKRVTAVHKANIMKYSDGLFLAIGRKVAEEYPEIEFEDRIVDNMTMQLVKNPSQFDILVCPNLYGDILSDLCAGLVGGLGVAPGANIGDEYALFEPTHGSAPKYKGMNKVNPMAMMLSGVLMLRYLKEEKAADKLENAIAAVIAEGKSVTYDMLSPDKQAAAVGTSQVADAIIAKMK

SEQ ID NO: 39735 - protein, 561 aa, Synechococcus elongatus PCC 6301
MTLPEDFQFDAIADAIAEIKAGRSVVVVDDENRENEGDLICAAQFATPEKINFMAVEARGLICLAMTGDRLDQLDLPLMVDRNTDSNQTAFTVSIDAAPHLGVSTGISAEDRARTIQATINPLTKPHDLRRPGHIFPLRSREGGVLKRAGHTEAAVDLARMAGLYPAGVICEIQNPNGSMARLPDLIDYARQHRLKLISIADLISYRLQHERFVIRETIATLPSEFGQFTIFAYRNSLDGSEHVALVKGDPSRFSQQPVMVRVHSECLTGDAFGSLRCDCRMQLQAAMKMIENAGQGVIVYLRQEGRGIGLINKLKAYSLQDLGLDTVEANARLGFPADLRNYGVGAQILNDLGVTRIRLITNNPRKIAGLKGYGLEVVDRVPLLIEATPYNSSYLATKGEKLGHLLLKTHLAAIALHLTPELQNNPYRQTLIGQIRSLVQGEGLFLQEELRSVASALFGPQVLTLQVGLAQSEAIAADWYRSPDSPLADQLQHCLEQMAAIDGLEDLEFLLADGHDPLTSLQVQLDRQSLPLPDLSRQFKTLKLQQIYHLQLQERPSFVS

SEQ ID NO: 39736 - protein, 491 aa, Escherichia coli CFT073
MMSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADIAMMANFFSSGQVCTNGTRVFVPTKCKAAFEQKVLARVERIRAGDVFDPQTNFGPLVSFPHRDNVLRYIAKGKEEGARVLCGGNVLKGDSFDNGAWVAPTVFTDCSDDMTIVREEIFGPVMSILTYESEDEVIRRANDTDYGLAAGIVTADLNRAHRVIHQLEAGICWINTWGESPAEIPVGGYKHSGIGRENGVMTLQSYTQVKSIQVEMAKFQSIF

SEQ ID NO: 39737 - protein, 324 aa, Prochlorococcus marinus str. NATL2A
MAIPPIFVKAARDIWSFEWKILMNGLAPSDSNGNYKRPINIQQQIQIPTKEDLKNRASNQMPGLIIGRSCPWAHRAWIIHEIKGLKKSINLHIAQVDEEGGRWRLDPPIKGCKTLQELYQKCGNYQSRRATVPMLFDPGKEPESKLRLINNESAELVEILNNWPIYDQEIDLNPSKYKKEIINWQNLIQENVNNGVYKCGFARNQKAYEKASNNLFSALNIIEEHLKSNGPWLCGKNLSIADIRLFPTLIRWEAIYYPLFKCSNKPIESFPHIIKWRKKIFNMYNIKKTCDVDAWRKDYFGALFPLNPSSIIPKGDDITTTINN

SEQ ID NO: 39738 - protein, 137 aa, Solanum lycopersicum
DLKPENVLVKSYSRCEVKVIDLGSSCFETDHLCSYVQSRSYRAPEVILGLPYDKKIDIWSLGCILAELCTGNVVLSLCICVFNLFLTSESMILMLGNFHLSCRHYGSSKIFIHCPHIFKKLQSGLLGFGTHELFAPE

SEQ ID NO: 39739 - protein, 516 aa, Dehalococcoides ethenogenes 195
MAVQEQLDNLNRLKKQAEMGGGEAKIDAQHKRGKLTARERIDLLFDKGTFNELGAFAAHRCRDFGLEKQRNAGDAVVTGSGLVNGRLVFAYSQDFTVLGGSISEVVGQKVAQVIDMAIRAGAPLIAINDSGGARIQEGVASLSGVGDILLRNTIASGVIPQISVVVGPSAGGAVYAPALTDFIFAVKGISQMYITGPDVIKAVTGEDISHEALGGAEIHAKKSGVAHFLCENEKECFEQIRELMGFLPQSNRHKPPRGKNKDNEERKTRDLRDIIPDNPKRAYDMKKVITEVADEKEFFEVHKHFAQNIIVGFVRMGGQPAGIVAQQPSHMAGVIDINASLKAARFIRFCDAFEIPLVSFVDVPGFMPGTDQEHSGIIKHGAKLIYAYAEATVPKITVITRKAYGGAYIVMSSKHLRGDINYAWPASEVAVMGAEGAVNIISRKAIAEAANPEETRQKLLDEYREHFANPYQAAQLGYIDDVIDPADTRSKIIKALRSLENKVLANPPKKHGNIPL

SEQ ID NO: 39740 - protein, 332 aa, Polaromonas sp. JS666
MTIKVGINGFGRIGRNVFRSAVQSFSDIEIVGINDLLEPEYLAYMLQYDSVHGRFKGEVSVDGNTLIVNGKKIRLTQERDPANLKWNDVGAQVVIESTGLFLDKTSAEKHLAAGAKKVIISAPSKDDTPMFVFGVNDKTYKGEAVISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTCELSKEATLKEICAEMKAQSEGALKGVLGYTEDKVVATDFRGDARTSIFDADASIALDSTFIKVVAWYDNEWGYSNKCLEMVRVVAG

SEQ ID NO: 39741 - protein, 457 aa, Dischidia lanceolata
  misc_feature (4)..(4): Xaa can be any naturally occurring amino acid
  misc_feature (228)..(228): Xaa can be any naturally occurring amino acid
GRIXQIIGPVLDVTFPPGKMPYIYNALVVKGRDTLGEPINVTCEVQQLLGNNRVRTVAMSATNGLMRGMEVVDTGSPLSVPVGSLTLGRIFNVLGQPIDNLGPVATDTTSPIHKSPPAFIQLETKLSIFETGIKVVDLLAPYRRGGKTGLFGGAGVGKTVLIMELINNIAKAHQGVSVFAGVGERTREGNDLYKEMKESGVINEQNLSESKVALVYGQMNEPPGARMXVGLTALTMAEYFRDVNKQDVLLFIDNIFRFVQAGSEVSALLGRIPSAVGYQPTLSTEMGSLQERITSTKEGSITSIQAVYVPADDLTDPAPATTFAHLDATTVLSRGLAAKGIYPAVDPLDSTSTMLQPKIVGDEHYETAQQVKQTLQRYKEVQDIIAILGLDELSEEDRLTVARARKIERFLSQPFVVAEVFTGSIGKYVSLPETIRGFKLILSGELDDLPEQAFYLV

SEQ ID NO: 39742 - protein, 365 aa, Ashbya gossypii ATCC 10895
MPRTITFDIPSHYKLVDLIGEGAYGIVCSAIHKPTGTKVAIKKIQPFTRPMFVTRTLRELKLLKFFHSHENIISVLDIVRPTSYQDFEAVYLVQELMETDLQRIISQPNSFLSDDHIQYFTYQILRALKSLHSAQVIHRDLKPSNLLLNSSCDLKLCDFGLSRCLASSDRSRENMVGFMTEYVATRWYRAPEIMLSFQEYTTAMDIWSCGCILAEMISGKPLFPGRDYHHQLWIILEILGTPSFEDFEQIKSKRAKAYIANLPMRPKIPWNVALSTNDINPLAMDLLDKMLTFNPDKRISAADALKHPYLETYHDAEDEPDYELLNLQDNFWKVDNEARQKTEEEELSMDTLKAMLYEEVMKPLQ

SEQ ID NO: 39743 - protein, 237 aa, Wolinella succinogenes DSM 1740
MSRLREFFSIIKEDFAVVFEKDPAIRSRVELFFNYPGLIAIVHHRFAHALHRRGFRVVARILMAFNQFVTNIDIHPGATIGRRVFIDHGIGVVIGETAIVGDDVTIYQGVSLGGVSLERTKRHPTIEEGVVIGAGAKILGNITIGAHSKIGANSVVIRSVPADSTAVGIPARVIDKGRSKDPSDMGKLPDIDKQLFEYLLKRVALLEHALKSDHKELDSRGEELEKIYESFVKSLRS

SEQ ID NO: 39744 - protein, 369 aa, Prochlorococcus marinus str. MIT 9303
MTTNPSPNDPLDKVPSDRLWLRSELMGTHVITRDTGRRLGVVGEVVVDIDRREVVALGLRDNPLTRYLPGLPRWMPLDRIRQVGDVILVDSSDSLKEGFTPDRYSRVINCQVITESGQQLGRVLGFSFDIETGELTTLVIGAIGVPLLGEGVLSTWEMPVDEVVSSGADRIIVYEGAEEKLKQLNSGFLEKLGVGGPSWEEQERERYRMNLVPVENQLNSGQPTEQEQRRLQPSTTQTFEPEEELEYVELEERQQEVIPQQRYLDETPSSSPTRYRNDREERMTFEEPPAYEQRPVFEESAAYEQRRTFEDQQPQRPRPASRRPVQSLGDPLDVEPLDFSGRDQAGRDRDAEVEEPPPRRNGTELDDPW

SEQ ID NO: 39745 - protein, 362 aa, Propionibacterium acnes KPA171202
MSRRTLLLADGTSYQGEAFGADREVSAEVVFTTGMTGYQETLTDQSYNGQIVTFTYPLIGNCGINRDDMESLFPTTAGVICREVPRLASNWRNRRSLGEFLTTHGIPGLAGIDTRALVRRLRTAGVMKGVLLAPDADLDAELGKLRNIHLPTDQIAQVSTRTAYPSPLGGRSVVLFDFGLKHSILRELSRRGCAVTVVPWNISADRVRALAPDGIMLSNGPGDPKSIPGVQDVVRELQEEYPVFGICMGHQIFALANGADTYKLRFGHRGFNHPVRELSTGRIDFTSQNHGYVVDPESVSGTELEVTHIEINDETVMGVRHTRLGSFSVQYHPDAAAGPHDAAHVFDDFVALMDANHTGGQN

SEQ ID NO: 39746 - protein, 838 aa, Xanthomonas axonopodis pv. citri str. 306
MSSPSPAPVTPDLVRLRASARDKDDAIAQAAQLLVAAGCVAPGYEASMRRREGLANTFLGHGLAIPHGVGEDRHLVRRDGIAVLQLPDGVEWNPGQITRLVVGIAAQSDTHITLLRRLTRLIQDPAQLEALFSTDDPSVIVAALTGDRAPETSAAPATDLAEAFEWTIAYPSGLHARPATRWAETARGFSARAQVRAGDQAADAKSLVGLLQLGLRAGDSITVSAEGSDAAELLKRLRAVMDSLTAQEKADAERAAQRRAAPVAGWTPPQAQPAIVGIGASPGVAIGIVHRLRAAQTEVADQPVGLGDGGAQLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPDQPCILLASDLSPSDTANLDTARVLGLATAQGGPTSHTAILSRTLGLPALVAAGGQLLEIEDGVTAIIDGSSGRLYIDPSEQDLDAARTHIAEQQAIREREAAQRALPAETTDGHHIDIGANVNLPDQVAMALTQGAEGVGLMRTEFLFLESGRTPSEDEQHATYLAMAQALDGRPLIVRALDIGGDKQVAHLELPHEENPFLGVRGARLLLRRPDLLEPQLRALYRAAKDGARLSIMFPMITSVPELVALRAICARIRADLDAPEVPIGIMIEVPAAAAQADVLARHADFFSIGTNDLTQYVLAIDRQNPELAAEADSLHPAVLRMIRSTIEGARMHDRWVGVCGGLAGDAFGASLLAGLGVQELSMTPNDIPAVKARLRGAALSQLQQLAEQALACETAEQVRALEAKREDKA

SEQ ID NO: 39747 - protein, 268 aa, Propionibacterium acnes KPA171202
MDEVVSTASYASTVGSMTFRKTDHHKNAIDYEVAGLMWLAAARPDGAGIVEVLDHGKGWLTEPELSTGHPTREAAEDFGRRLAHTHAAGASHLGAAPDGFVPDDGYIGRAPLPLPSEPISSWGEFYAQYRIEPYMDSLDADARAIMSKLVDRLASGALDHDEPALVTCPAARTHGDMWAGNLMWTPDGVVLIDPAAQGGHAEEDLAALSVFGAPFAERIRAAYNEESPLADGWEDRIGLHQLHMLIVHCWLFGGGYVDQTVAIARRWV

SEQ ID NO: 39748 - protein, 245 aa, Hordeum vulgare subsp. vulgare
MAGEDATRAATEEELSSVAEAAPVTAQRPVRSDLEKYIPKPYLARALVAPDVYHPQGSKERGHEHRHRSVLQQHVAFFDMDGDGVIYPWETYQGLRALGFNMIVSFVIVIIIHATLSYTTLPTGYRLSLPFYIDNIHRAKHGSDTATYDTEGRYMPVNFENIFSKNARWSPDKLTFREIWTMTDDQRQANDPFGWVASKAEWILLYMLAKDEEGNLPREAIRRCFDGSLFEFIADERRQAHGKQY

SEQ ID NO: 39749 - protein, 302 aa, Lactobacillus reuteri
MTTKIIMDTDPGIDDAAALTMAINDPSLDLKLVTTVAGNVTADKTTANALKIIHFFGKDIPVAAGAKQPLIKPFEDAARIHGESGMPGYDFGDDYGKPLDKTAVEALHDAIMAEDEVILVPTGSYTNIALLFSEYPEVKSHIKQIVAMGGSFSGGNMTSAAEFNVFTDPDAAKIMYNAGVPIVTVGLDVTLKALLTADTIEKLGSLNKTGEMLHGLITHYNDGNDQGRPMHDVNTIFYLLHPEAFTTKDMWVDIQTDGPAIGATVGDIRAAYHDGKTNAKVCLDIDAEYFNKWFLEEVSKMK

SEQ ID NO: 39750 - protein, 301 aa, Agrobacterium tumefaciens str. C58
MDLNRTVRKAVIPVAGNGTRFLPATKAMPKEMLTIVDRPVVQYAVDEAMQAGIEHIIFVTSRNKTAIEDYFDSAPELINTLTRSGKTVQVLQLEKMLPVAGTVSYTRQQVPLGLGHAVWCARELVGKEPFALLLPDMVSYGARGCIAGLMELYDEVGGNILGVEECLPEEVSSYGVVGVGQKVNHGFSVTEMVEKPEPSKAPSNYYLNGRYILQPEIFDILARQERGAGNEIQLTDGMKRLAEKQPFHAQKYSGRTFDCGSKQGFIAANVAFSLMRSDMEAQVLASVKELIANHESRVQAA

SEQ ID NO: 39751 - protein, 618 aa, Yarrowia lipolytica CLIB122
MEKIGHKQKIWGERLEKLICFHPWVRAIFFSKAQIKHYPKRGSSTNAKERGWTRPIIIVGWIFVYLYAASKELAEKVHPTMAPLATSHFAGLSLLSSKAVVQSSIFIVTRPAFAKVCDHIGRLEGWVIVVLCHLVGSVLFASAPNTGCYFAGIVFWEVATVGGHMMTELYASDTSTINTRIIFSSFIQSPNIWGPYAAAPIVGAILDVATWRWGYGMFAIVIPVCSLGVLFLFSVMRVKEFRLGARGDFYTPGGFKRFLLSFDIVGLVMLCAGTILLFFPITLAEGTDKWSRPGFIAMLTIGSFLLAAFPLWEIYGAQSPLISWKLFRNRAMICSCTILFFSSMSNKLSVPYYTSWLLVVRGYSPKATTNINSAVTVANNAFGILFAAPYLLWSGKPKHMMVLGTCLYLVGTGLTYRFRRQHSGLGILIISQVIEGIGRGTLYIPCGTIAQAMFDKHKVAKVTAVYFTMGGIGQLVGDAILGAIYKEVYPQYIHKYAPDIPQKDLNLIINKIKKATKFPIGSPVRNEINRAFDETMKHMLYGTFACAAMMFLAVLCYPSVDFKEQGSVSVDEGEDIEPDDYRIEVRSQSDTELSESPSEKLEDPHFGSCKGQEEKLKK

SEQ ID NO: 39752 - protein, 295 aa, Methylobacillus flagellatus KT
MYKTLDDFVGNTPLVKLQRMAGKTSNTILLKLEGNNPAGSVKDRPALSMIKRAEARGDIKPGDTLIEATSGNTGIALAMVAAMRGYKMVLVMPDNQSVERRQSMKAYGAELVLTPRDGGMELARDVATKLQAEGEGIVLDQFANQDNPLAHYEGTGPEIWRDTAGKITHFVSSMGTTGTIMGTSRYLKEQNRDIRIVGVQPEEGAQIPGIRKWPEEYLPKIYDAKRIDELVYVNQENAEKTTRRLAQEEGIFAGISSGGALYAALQLSKRVENAVIVTIVCDRGDRYLSTGVFPS

SEQ ID NO: 39753 - protein, 277 aa, Triticum aestivum
VTLQNKFVQKSRLLPVRNSRDIVDPRVRSKLAANAFLAQRISSVNAMSALCEATGANVSEVSYAIGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCKGLVGDKAQVSIYDPQVTEEQIQRDLAMNKFDWDHPMHLQPTSPTGGKAGERGCGTPYKGLQRAPPRRGASLTRRGERVPRKPLNYPRRILPNNNGKKPRALSSFHTGRTKGG

SEQ ID NO: 39754 - protein, 346 aa, Mycobacterium avium
MRITHGGYRVAAVWSSTDRGLEGVILKISVVGSGYVGLVTGACLADSGNDVVCVDIDQAKIDLLLAGGVPIFEPGLAELIARNRENGLIDFTTDRQRGIEHADVIFIAVPTPMGESGAADLTYVFSVADDIGSYIDRYKVIVDKSTVPVGTADQITAIIRSKTDQEFDVVSNPEFLKQGKAIADFMQPDRVVIGSDSKRALRIMEELYEPFLRTFHPLIAIDVRSAEMAKYAANCFLATKISFINEMSNLCEKAGADISAVREAIGADKRIGYDFLFPGIGYGGSCLPKDVRALLYTADCLGSDMHLLRAVERVNDEQKAALVSKIITRFGGSEKNLDGCALGCGD

SEQ ID NO: 39755 - protein, 228 aa, Buchnera aphidicola (Baizongia pistaciae)
MYLVDTIDYQKICCIIKTFEDNILFQKNYHSTWFLKSIANIQKEKYNYGLEVAFVGYSNSGKSSIINALTNQKKLAKISRTPGRTRLINIFSVTSEIRLVDFPGYGYAQVSRSISKKWKEMIFQYLNIQKCLQGLVIITDIRCPIKEIDELVINLAVSLNIPILLLLNKMDKVTRSIQKSKLFSTREKMLNFSNNINVELFSSFKKIGIHKLQFVLNNWFSSDKKLCQ

SEQ ID NO: 39756 - protein, 236 aa, Myxococcus xanthus DK 1622
MSQQGDGAATARYKQAAAEWAVDGFLQPGMVVGLGTGSTAAFAVQRLAALRAQGRLLDIVGVPTSRATEALARSLGVPVSTLDAHPVLDVTLDGADEVAPDLSLIKGGGGALLREKIVAQASRRVVIVVDAGKLSPVLGTHWPVPVEVMSFGWRSQARFLESLGARVTVRQGAGGEPFLTDQGNLVLDCAFGPIDAPAALAASLGARAGIMGHGLFLNLATDLVVAGPEGVEHRAR

SEQ ID NO: 39757 - protein, 239 aa, Triticum aestivum
MSSSSKLFQSACKAARSFLASSSAPAAAPRAASSVLADGRNAALATLANLGRNSTLPAAYAHHLHTNAAASSHAYAWLAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVFVGRNIIHGSDGPETAKDEIALWFQPKELVSYTSN

SEQ ID NO: 39758 - protein, 246 aa, Bordetella petrii
MDSPTSMSSDDSMAARVARVRQRMDAACARAGRAPESVTLLPVSKTFGPEAVREAAALGLRRFGENKTQEIRQKAGPLADLDIQWVMIGHLQTNKAKDAARHAAEVQSLDRLDLAYALQRRLQAEGRAIDVLVQVKTSPEPSKHGLDMQAVSSFLRIVAGDCPALRVQGLMTLAVQSDDTAAVRACFRALRELRDRLRDENIPDVRLDRLSMGMSGDFEIAIEEGATEVRVGSAIFGTRTYLQAPL

SEQ ID NO: 39759 - protein, 411 aa, Brassica napus
MIIVDILWKSFPLYLFSGSGTDPLSESILQMMASPKILCDAGESDLCRDDSAAFVLKFVAIASIFLSGAAGVAIPLVGKNRRFLQTEGNLFVSAKAFAAGVILATGFVHMLAGGTEALTNACLPEFPWSKFPFPGFFAMVAALITLLVDFMGTQYYERRQERSDNAAAPSEASAVVGVESGREEASVVVPVVVERVSDGNNKVLGEEEGGGMHMVGIRAHAAHHRHSHSNGLGTCDGHGHSHGHGHQDLGNGARHVVVSQILELGIVSHSIIIGLSLGVSQSPCTIRPLIAALSFHQFFEGFALGGCISQAQFKNKLATVMACFFALTTPVGIGIGTAVASSFNSHSPGALVAEGILDSLSAGILVYMALVDLIAADFLSKRMSCNVRLQVVSYVMLFLGAGLMSALAIWA

SEQ ID NO: 39760 - protein, 621 aa, Aspergillus oryzae
MNLLSLLSLSAISAIAWAETHVFDWNITWVTANPDGMQPRPVIGINNEWPLPLLNFTKGDRIIANVRNQLGNESTSVHFHGFFQNGTNEMDGPPGVTQCNIPPNETMVYNFTLDQSGTYWYHSHTKGQYPDGWRQALVIHDEEDPYIGKYYEERVITLSDWYHDEMPGLLKEFINVANPTGAEPVPKSALMNDTQNLTVPVEPGKTYLFRVVNIGAFASQYFWIEDHDMQIVEVDGVWTEPATASMIYIASAQRYSVLVTMKNETNANYAMVGSMDTDLFDTLPSDLNYNSTGWLVYDSSVEKPAAKSVSEFDFYDDFELVPYDGLERYGDADITVTLDLTMDNLGDGANYAFFNGISYVAPKVPILYSTLTTGSAATDAAIYGTDTNAFVLNKGDIVDIVLNNDDTGKHPFHLHGHNFQVIWRSGDYEGHFNPDNVTFSSVPVRRDTLIAKPMGNFVVRFKADNPGIWLFHCHIEWHMDAGLAAVMVEAPLYLQENLTIPQNHYDVCSASGTPTEGNAAGNTEDFYDLTGENKAVAPLPAGFTARGIVALVFSCVAAFVGLASIVWYGVAPIKNSRICLPFHSEQWDAKITARKPDQIGMDAHFAHNPGIRPVAETLGDA

SEQ ID NO: 39761 - protein, 535 aa, Oryza sativa Indica Group
MTILLLVVFFCRMLGNMAGKNKRKKQPKLPPGPATMPVLGNIHQILMNKPVFRWIHRLLDEMDTEILCLRLGSVHVIAIASPEMAREALRRNDAVLTSRPVSFAWRAFSFGYKNTVGSTGDQWKKMRRMLASEILSSAMERRMLGQRVEEADHLVNYIYRNCNSGTVDIRHVTRHFCGNIIRKLVFGRRHFAFGAGNIGPGRDEEAHIDALFTALDYLGAFSISDYFPSLVLNGLMSTFRRLHDPIIMERMEEWRAPRRNGDERREVADFLDVLISLDDAQGKPLLSLDEVKAETLEIILNSVDNPSNAVEWALAEMVNNPKVMKKAVDELDMVVGKERLVEESDIHSLTYLKACIREAFRIHPYHPFNPSHVAIANITIAGFMIPKGSHIILSRIGLGRNPRAWDNPLEFRPERHLKNTDNVVLAEPELRFLSFSAGRRGCPAVSLGTSITMMLFARLLQGFSWSISPGANRIELQEIIYEGELSLALSVEGKSVAALKNGSQAAGPTLPYFIAVHCTFEPKLLATAHCQVVVA

SEQ ID NO: 39762 - protein, 120 aa, Hortaea werneckii
FHRPYFHVRIVSDVAGVSLGGALKNVVALGAGWVDGLGWGDNAKAAVMRVGIMEEVRFGKMFFGDTVRAESFTEESCGVADMITSCGSGRNFRCAKMSAAEGKPIAEIEKRELNGQSAQG

SEQ ID NO: 39763 - protein, 138 aa, Glycine max
  misc_feature (126)..(126): Xaa can be any naturally occurring amino acid
TPPLPQSARYGNVSYRTWHEKMSNSAESLIQTLLPENFHPATVELAPYFADSFGNSSRIDYGTGHETNFAAWLYWLARLGVIGEEDFPAVGARGFVKYLDLMRKLQLQYWLEPGWAHGVWGPEDYXFLPFIFGGFQVD

SEQ ID NO: 39764 - protein, 157 aa, Zea mays
  misc_feature (111)..(111): Xaa can be any naturally occurring amino acid
MDTHIGSVDGPSPAAVNGAVGCPASAPGCPIMSSHPVVSAGEASLGRHLARRLVQVGVSDVFAVPGDFNLTLLDHLVDEPGLRLVGCCNELNAGYAADGYARARGVGACAXTFTVGGLSVLNSPLQREPSSALEGGLSEPTPATDAVLRGPAALTLV

SEQ ID NO: 39765 - protein, 589 aa, Yarrowia lipolytica CLIB122
MTLTNKLLHLVLCLLLAATICGASPVDLAARDFSDHQNELPSPSASDKYFNWTVDWTIQNPDGVFPRRVISINGEWPLPVINVTKGDRVVIDLYNDLGTQNVSLHFHGLYQKGQNANDGPVWITQCPQTYHNQHTFMRYNFTVDQSGAYWYHSHVDGQYPDGLRQSFLIHDPEDPYKHDFDEHLSFTLSDWYHEEVPDLMVDFLSKYNPDGDEPIPSNLLFNDTQNVSIPVEPNRTYKLTIINVGAFVSQYIQFEDHQVQVIEVDGVATEKSEPTNLLYITTAQRYTVLLRTKDSATRNFAISTAMDSTMLDSLPDGLNLVQTNYLEYNKNAPKQPVKEWYVNGANYNDDAFKKKRFDDMALVPLDRQPLLPDADHTIVLNMTMDNLNDGINYAFFNNITYTHPKVPVLYTVLSSPNGLETNREIYGSNSNVFLLKHNEVVDVVINNQDDGEHPFHLHGRNFQVPYRSPEYDDDNMTAFDPALKKDFSPIPMRRDTVYVRPNGNFVLRYRANNPGVWFFHCHIEWHMSQGLALVMVEAPTEIKQKQTVPENHLQICQAGNVPTAGNAAANSRNWLDLSNQNLQAPGLPH

SEQ ID NO: 39766 - protein, 507 aa, Oryza sativa Indica Group
MADSGDSSPHSAAATDDAHHEGSEAAAAQAAPPPPAPPAKVRLMVSYGGRIQPRPHDHQLSYVNGETKILSLERPLRFADFAARLAGLAGSPGDFCVKYQLPGEDLDALVSVTNDEDLEHLVLEYDRLHLLRPAPGSGGGSSRGGSTPRLRVFLFPVQSPTPPPPPQPSGLLEPKQEQRQWFVDALNSVHQPPPPSPPQPKQESVSVQSPPPAVVPMPQPPPVLTAPTGPDYLFGLDNGFVPPPAVKVKDPAGDPPTVKDNVPVEIPAKNDDRHTTNPVSDHVVVSPVVSPGEFQRQIQGLEKLQFADTAAQQPPPPPAPATAAPPPAALPRNGSDDSLTRAYPPATVTPTPPTATPEYYLPKYQEKPAAPPPSSAPPPTAFLPVPGRYTSVAPGSGADHAPVFFIPAPPHGYFTTAAGPGATSFPAVYAVAQHNGNANASGNGPSPAAASNAQAYAPQVAYDSNGRAIYYTSVLPQYASAVSGVPAAATVLGTDPAKPVAVKPTVS

SEQ ID NO: 39767 - protein, 216 aa, Schizosaccharomyces pombe 972h-
MASHLASIYGTEQDKVNCSFYYKIGACRHGERCSRKHVKPNFSQTILCPNMYKNPIHEPNGKKFTQRELAEQFDAFYEDMFCEFSKYGEVEQLVVCDNVGDHLVGNVYVRFKYEESAQNAIDDLNSRWYSQRPVYAELSPVTDFREACCRQHETSECQRGGLCNFMHAKKPSPQLLRDLVLAQRKYLALNAAEEMKKEPNSDSTNRWVSVTAERKN

SEQ ID NO: 39768 - protein, 287 aa, Yarrowia lipolytica CLIB122
MFVWELSDTSANCDSFWIRRGRLGSDTGTLDQTHRALLPSYSSPLTQSRHEIYSPEGLRTDGRRWNEIRNFDCKINTHPTSADGSSYVEWGHTKVVCTVDGPREPDNRQNTTDRAVISVNVNVASFSTETRIKRQRNDKRLAEMNILIRQLLEEAVLTKLNPRTQIAVNITVIAQDGGLLPACINAACLAMIDAGVPLTDYVSACSSGVYSNNALIDLNTLEEQDVPFLTIGVIGKSDKISMLTLETQLPMASLEPVLATSLSGAHAIQDIMDAAVRKHGKHRLERK

SEQ ID NO: 39769 - protein, 204 aa, Propionibacterium acnes KPA171202
MATKKDRPSSINVPNALTLLRVVAVPIFGWMLLAHAHEGGWRTTTTIVFMVAILTDFVDGKVARKYNLVTNFGKIGDSIADKALTGMAFIGLSIIGELPWWMTIIILLREWGITVMRMKMLKYKVMAANKGGKLKTAMQSLAITLFCLGLWRMPTFVYVIAWAVMIIAFVLTVITGLVYIRDAILIRNRAKMTESRPARKRTLK

SEQ ID NO: 39770 - protein, 659 aa, Vitis vinifera
MLRSDEGEDDVFFDSMDHLSCEESVRAKEELGCGKLDYEIWRNEPRSVRERRESFLRGMGFVEFVPEHDKPFGDPPEMVELGRITECSGAVSSSSVSSINCTEENSVCSGREGDVGANCMVDALNQQQSEKQNIDFEGETRGLLPSAQEFECNEGQACVEGCKNLGMDKKTRSWWKRFISKRKGRDAASASQVSKQTSETPKINQMKVRQNKKRCMEFTALCIGQEIQAHKGFIWTMKFSPDGQYLASGGEDGVVRIWCVTSTDASCKYLTTEGNFGCEVKDGKSSFGRKKPSYAPVVIPDKIFQIEESPLQEFHGHASDVLDLAWSKSNSLLSSSMDKTVRLWQVGHDECLNVFRHNNYVTCIQFNPVDDNYFISGSIDGKVRIWGVSERRVVDWADVRDVITAICYQPDGKGFIVGSVTGTCCFYNASGNHLQLDAKVNFHGRKKTSGNKITGIQFSQEESQKVMITSEDSKLRILDGIDVVYKYKGLRKSGSQMSASFTSTGRHIVSVGEDSRVYVWNYDGFCSQSSKQMKSVQSCEHFFFEGVSVAIPWSDTGAEKKGLGSDSLRQNSERFSLGNWFSMDGSCRGGATWPEEKLPLWGAPEHDHHHHDHQQQQQHNDVQNHNHLALSEAWGLVIATAGWDGTIRTFHNYGLPVRL

SEQ ID NO: 39771 - protein, 849 aa, Oryza sativa Japonica Group
MVLPPRLLLFFLLLIGVHASVSHGSPSLPPTYDPSICSNLDGSKQTPFIQLNGENYTILEIIYDSRTIVLADTDALRGSCPRVRHNVTFGQAYPWLQYTGSRDNLTFFFGCKLNLPPPIDPGLVSLADKHQINCKDFSNWPDSGDSFVFTSGELEAPVESELARCCSQVIVVPVNGSVLNSSNQSALPSGGYGQVLKMGFDLAWNSSKDEQCYKCEQSKGHCSYSQNRAFLGCLCSDGKLAMLLSLCLRLLPLLLVLVAASHGDASGDTYDTSMCLQKPTTCGNVSISYPFYFATKTKDINGSSNSYCGYPGLAIDCDDGKPILQLNGTEKYKVNYINYGSITNVSLADLEVVDDSSGCPRVDHNVTIPQISWLFFSGISVDYLVFFLRCSFTTFAPKPANFNPIACGSFINLTRPSFVFPDELVPPGNWSQLCEETFEVPVLKYQLMEMDSNGNAWNNSGYAQPNLLYPYQYSGYAVMDKTRYSILMPFSVPNFLHANIIAGTSSVLLLCLLSFACLFGLKKSRYRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHGSKRVLIYEYMPNGSLERYAFRNNSEGEHSLTWEKLFDVVVGIARGLEYLHRGCNTRIVHFDIKPHNILLDQEFCPKISDFGMAKLCSNKESIISIAGARGTIGYIAPEVYSKQFGAISSKSDVYSYGMMILEMVGARERNIDANSESSSHYFPQWIYEHLDEYCINSSEIDGETTELVRKMVVVALWCIQVVPTNRPTMTRVVEMLEGSTSGLELPPKVLLSW

SEQ ID NO: 39772 - protein, 237 aa, Aspergillus nidulans FGSC A4
MKLNISYPANGSQKIVEIDDERKLRPFMEKRMGTEVPGDSLGDEFKGYLFKITGGNDKQGFPMKQGVLLPTRTRLLLADGHSCYRPRRTGERKRKSVRGAITGQDLAVLALSIVKQGEGELPGLTDTVVPKRLGPKRATKIRNFFGLDKKDDVRKFVIRRTVTKEGKKDYTKAPKIQRLVTPQRLQRKRHRIALKRRRAEAAREAANDYAKLLASRVHEEKAKKDELRKRRASSMRK

SEQ ID NO: 39773 - protein, 320 aa, Aspergillus nidulans FGSC A4
MATNSIKLLTGNSHPELANLVADRLGIELTKIMVLQYSNQETSVTIGESVRDEDVFILQSTRPNDINDGLMELLIMINACKTASARRITAVIPNFPYARQDKKDKSRAPITAKLMANMLQTAGCNHVITMDLHASQIQGFFNVPVDNLYAEPSMLKWIRENLDVSNCVIVSPDAGGAKRATAIADRLDLQFALIHKERPRPNEVSRMVLVGSVKDKVAIIVDDMADTCGTLVKAADTVMQHGAKEVNAIVVHGILSGKAIDNVNNSCLKRIVVTNTVPHKEKKELCDKIETIDISPTLAEACRRTHNGESVSFLFSHTVA

SEQ ID NO: 39774 - protein, 531 aa, Pseudomonas syringae pv. phaseolicola 1448A
MFDDLDYSQPYASARSPVMGNNMVACSQPLAAQAGLDMLRRGGNAVDAAIAAAMVLTVVEPTGCGIGSDAFAIVWDGSTLQGLNASGRAPQAWTPEYFEGHSQMPQRGWPAVSVPGAVSAWVALSERYGKLPFATLAEPAIGYARDGYQVTPIIAELWKRGSHLLKDQPGFAECFMPGGKAPLAGEKIQLKDHARTLELIARTKGEAFYRGELAQAIIAHANANGSVMSLDDLATHTVDWIDTLSVPYAGAVVHELPPNGQGIATLAGLTMLEALGVGEHPVDSLETVHPVLEAMKMALADLDEHVADSEHMRVPSEDLLSKAYLMERAGLVTDQAANPGHGSPKPGGTVYLSAADESGMMISFIQSNYMGFGSGVVVPGTGISMQNRGAGFSLDPQHVNYVAPRKRPFHTIIPGFVMNSDGTPLMSFGLMGGPMQAQGHLQMMMRILRYKQNPQAAADAPRWRIETGLKVAVERAFDPDVVSALRAKGHDIDVEEPSGVFAFGGAQIIQRTAHGYVGGTDPRKDGVVAAY

SEQ ID NO: 39775 - protein, 647 aa, Oryza sativa Japonica Group
MSGKLCFLASVLLSMSTVVDLAMAASGGVNIAVYWGQNGSEGTLGETCGTGLYAYVNLAFLSTFGAGRAPVLNLADHCDAPSGTCASLAADIASCQAAGVKVLLSIGGGALGYNLSSPSDARDLAAYLWDNFLGGGATGASRPLGDAVLDGVDFDIESPSRFYDDLARNLASLYTRAPRPPRGGKTYLLTAAPQCPYPDASLAAALATGLFDHVWVQFYNNPPCHGFVDADTMASQVLPVVVGAADYGGIMLWSRSYDKDSSFSVKLQAALQNRNKPTGAGASSHTKRRIYIIAGVFAGVLLLFLLLITYFLCHKKHHGQQPPVQELTTPPKAEPSQKKQRAQHLKRYSYSEVERMTKTFAHKIGQGNYGDVYKGNLRDGRQIVVKLLKNCRGNDKEFLNEVASIGTISHVNVIPLLGFCLQGTARALIYEYMPNGSLESYAFSNDDSIEENYSLWIYWEKLYEIAIGVARGLEFLHGSGNANIMHLKIKPRNILLDQELCPKISDFGVANLCLWKESKKSAQNARGRDSYDAPEVVSTKFGAVSSKSDVYSYGVMVLEMIRAKRRINVGADTTTKYFAQWLYDHLDQFCNSISDISDETRESVRRIIIVGLWCIQAAPANRPSMSRVVKMLESSSTKMDLPRKSIE

SEQ ID NO: 39776 - protein, 469 aa, Pseudomonas syringae pv. tomato str. DC3000
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPHIPSWVSAAVFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPKLLAQVDKRGVPVKAIFASAAVTLVAVLLNYFVPQQALELLMSLVVATLVINWAMISYSHLKFRQHMNRTGQVPLFKALWYPYGNYVCLAFVVFILGIMLMIPGIQISVYAIPVWLAVMWVCYRAKNRRSVVVNAETGK

SEQ ID NO: 39777 - protein, 128 aa, Vibrio angustum S14
MKNKSDAYWREKLSEKAYQVCRQQATEPPYSGKLLHNHKTGIYSCACCDSPLFSSSNKYDSGCGWPSFDAPLNDDCISYVEDHSHGMKRIEIRCKHCDSHLGHVFNDGPQTTGERYCVNSISLIFTDK

SEQ ID NO: 39778 - protein, 614 aa, Staphylococcus epidermidis RP62A
MEFLSLVIVVVAAFMTPIIVHRFNINFLPVVVAEILMGIVIGHSFLNLVERDAFLNILSTLGFIFLMFLSGLEIDFNAFKKDSRPRQGEDKHEKDVPGHLKLALTVFAFIMMISVVLAFAFKWLGLVNDVLLMVIIISTISLGVVVPTLKEMNIMRTTIGQFILLVAVLADLFTMILLTVYGAIYGEGGSTIWLTGILVVFTVVFYVIGVLFKRMSFLQKLMDGTTQIGIRAVFALIILLVALAEGVGAEYILGAFLAGVVVSLLKPNEEMVEKLDSFGYGFFIPIFFIMVGVDLDIPSLIKEPSLLLIIPVLIFSFIISKLIPVFYIRRWFDTKTTIASAFLLTSTLSLVIAAAKIAEKLKAISPETSGILILSAVITCVFVPVIFKKMFPIPNEVGRRIEVSMIGKNQLTIPIAQNLTSQLYDVSLYYRKDLSDSRKLSDDITMIEIADYEEDLLKRLGLFERDIVVCSTNDDNINKSVALMAKNHGVKRVICRLESTNEDPTLKHQGIEVFSNYLSNKILLKSLIETPNMLNLLSNVETSLYEIQMLNYQYENIQLRNFPFGGDIIFVRIIRDNDSIVPHGDTQLRYKDRLIVTGTKEYVDELKQELEFYY

SEQ ID NO: 39779 - protein, 110 aa, Arabidopsis thaliana
  misc_feature (60)..(60): Xaa can be any naturally occurring amino acid
MASSMLSSAAVVKSPAQASMVAPFTGLKSSAAFPVTRKTKKEINSIESKGGRVSWMKVWXIGKKKFETLSYLPELTDVELAKAVDYLPPPHKWTPLCRLPLTPGLWVRET

SEQ ID NO: 39780 - protein, 331 aa, Vibrio angustum S14
MTIKVGINGFGRIGRFVFRAAQERNDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYETICAAMKEASEGALKGVLGYTEDQVVSQDFIGETQTSVFDAKAGIALTDNFVKVVSWYDNEIGYSNKVLDLIAHISK

SEQ ID NO: 39781 - protein, 189 aa, Prochlorococcus marinus str. NATL2A
MIDKSNSDTVIGSRQKIFLVILSFFLVVSLFFFRTGFKANEMLNQLAKNSLEPEIALSNGKPTVFEFYADWCEACKEMAPDMVNAEKLNSNKIDIVLLNVDNSRWFDLIDKYDVNGIPKLTFFDDQGEFKGFSLGVRKYSELNEIFLALINNSELPSFTKLSNSSNLISKNNLKVLNNSIKSEGPRDHS

SEQ ID NO: 39782 - protein, 860 aa, Oryza sativa Japonica Group
MAMAAASAMRPLAPLFLFFFFSLAASASDNILANSSLADGQKLVSAGGVFELGFFTPPGSTTAARFLGIWYRDIDPPTVVWVANRDAPVSGTAGSLAVVVNGGGGGGGGRLVLGDGSGRVVWSSAPSNVTASDPVAARLLDSGNFVLAGGGGSGDVIWQSFDYPSDTLLPGMKFGWDLTTGLDRYLTTWRSAGDPSPGDYTFKIDPRGAPEGFIWYNGTSPVYRNGPWDGLQFSGEPEMEPNNTSFRFEFVANRTDVYYTFVVDGGGGGGVLSRFVLNQSSAQRYVWLPQAGGWSLYWSLPRDQCDQYAHCGAYGVCDVGAASMCGCPAGFAPASPRNWELRDSSAGCARRTRLNCTGDGFLPLRGVKLPDTTNATVDAAIAVDQCRARCLANCSCVAYAASDVRGGGSGCIMWSSPLVDIRKFSYGGEDLFMRLAASDLPTNGDDSSRKNTVLAVVLSLSGVVLLALAAFFVWDKLFRNKVANPVRFQSPQRFTSFDSSIPLNQVQDRKMEDETRHSNELNVTLFDFNTIAFSTDNFANLAKLGEGGFGPVYKGELDGGQTVAVKRLSKFSTQGLDEFKNEVMLIARLQHVNLVRLLGCCIHGEERMLVYEYMENKSLDNFIFDKARSAQLNWSKRFNIILGIARGLLYLHQDSRFKIIHRDLKAGNILLDGDMNPKISDFGVARIFGDDTDSHTRKVVGTYGYMSPEYAMDGVFSVKSDVFSFGVLVLELVSGRKNRGMYSSGEQTSLLSHAWRLWREGNALALLDEAVAGGGGGGGYSRSEVLRCVQVGLLCVQERPEDRPHMAAVFMMLGNLSAVVPQPRHPGFCSDRGGGGGSTDGEWSSTCTVNDVTVTIVEGR

SEQ ID NO: 39783 - protein, 413 aa, Salmonella typhimurium LT2
MPQQNYLDELTPGFTPLLAIKEASRCLLCHDAPCSQACPAQTDPGKFIRSIYFRNFKGAAETIRENNALGAVCARVCPTEKLCQRGCTRSGIDKPIDIARLQRFITDFEQQTAMQIYQPGSKTRGKVAIIGAGPAGLQASVTLTHLGYDVTIYEKQPQPGGWLRHGIPAFRLPQSVLDQEIARIVEMGVNIKCNCEVGGSLSLAQLKAEYRAVLMTVGMSCGSGLPLFEQASHVEIAVDFLQRARQADGDISVPRSALIIGGGDVAMDVASTLKILGCPSVTCVAREELAEFPASEKEFTSTQALGVSIIDGFTPVAVSGNKVTFHHVRHSGELTLEAENIILAVGQHARLDTFAEIKAQHNIIDTHNYQTDDPAIFAAGDIVKGDKTVVYAVKTGKEAAQAIHHYLEEACSC

SEQ ID NO: 39784 - protein, 161 aa, Chlamydomonas reinhardtii
SCSPVPPAPQPVHKQTSGSSLGSGDREPIDALEIFEHIRDINDPEHPYTLEQLNVVSEDMIDVDDARGRVSVQFTPTVAHCSMATLIGLSLRVKLWRSLPPRFKVDIKLSPGSHSSEAAVNKQLSDKERVAAALENPNLLAMVNKCLAGPAGAGAGASVAP

SEQ ID NO: 39785 - protein, 251 aa, Dehalococcoides ethenogenes 195
MTIILKTEKEIAIMRRAGHILAAALEEVKKNVRPGVTTRELDEIAERELRRRGTTPSFKGYQGFPASLCASVNEEIVHGIPGGRVLKEGDIISLDIGNILEGFQADMAVTVGVGEISPAATRLLSATQASLVAGIAQARAGGHLGDIGAVVEEYAQSRGYGVVRDYTGHGIGRDMHEDPQIPNFGRRGKGPELKKGMTLAIEPMLNLGTEKTRVAPDCWTVYTADGSLSAHFEHTVAITDGEPEILTVIEG

SEQ ID NO: 39786 - protein, 583 aa, Aspergillus oryzae
MTQTSTSKGTIKVADYLFARLCQLGIQSIFGVPGDYNLRLLDFVEPSGLHWVGTCNELNGAYAADGYARINGLGALITTFGVGELSAINGIAGAYAEKAPVIHIVGTPSRALQDARTLVHHTFADGEYNRFAAMHAQVTVAQANLIDPRTAAEQIDWVLQQCLVHSRPVYIQVPDDMVDVMIPASNLETRKIELPATPSTKNETSVLTTVLERIYSAKRPLIFVDGESRALNILPQVDELIQTTHWPTWTSAYGKGLVNEQYNNVYGFYGASYGTEQEKAYFDSADLVLVLGPHYSNTNTLGFATIPKQEVSISFSGTSIQIGKDLHRDYSIKQFLIQVLESLDRSRIPKIDGAPPKPKGDLSHINKSDPITQDDFYRFVDRLFREGDIVATETGTASYGGRTFTLPPNTRMFCAVTWLSIGYMLPACFGAALAQQETNSFKPSNSTGTGKGRLFLFIGDGSLQMTVQEISSIIREKLDVTIFVINNAGYTIERAIHGRNQAYNDIAPWRHLQALSFFGGSEEDAAKNNFSARTFGELEEVLQSDRIQKGNGLRIVEVHMGREDCQGLLRTLMNNQIAQDAKQ

SEQ ID NO: 39787 - protein, 370 aa, Pseudomonas aeruginosa PAO1
MKHFKLPDLGEGLQEAEIVEWHVKAGDSVRADQRLVSVETAKALVDIPAPYDGVVGKLFGAEGDILHVGEPLVGFEGEEADAGTVVGRLEGGGSALEDRFFIGAAPSTREHLAPRATPAVRQFARQQGVELAGLSGSGPDGLITRADVEAAAQGTRERFGGERLRGVRRSMALNMARSHAEVVPVTIYGDADLHRWKTARDPLIRLAQALAEACRAEPTLNAWFDGASLSLKLHERLDLGIAVDTPDGLFVPVLRDVGARSAEDLRAGMRRLREDVQARSIPPAEMLGATLTLSNFGTLFGRYANPVVVPPQVAILGAGGIRDEVVAWRGEMAIHPILPLSLSFDHRAATGGEAARFLKVLVNALEQPDG

SEQ ID NO: 39788 - protein, 337 aa, Haemophilus somnus 2336
MNDNSPSPTPITVIGAGAYGTALAIAFSRNGYPTYLWGHRPQHCQRLRNERKNQAFLPNIHFPDSLYVEDNLAQAIQHSRELLIVVPSHVFGDVIMQIKPHLRSDQRIAWATKGLERNTGRLLQEVVEEHVGYGYPLAVLSGPTFAKELAAGMPTAITLASNNEQFALEFQERIHCSKFRVYVNQDMIGVQLGGAVKNVIAIAAGISDGMGFGANARTALITRGIAEISRLGISLGANPNTFMGTSGLGDLVLTCTDNQSRNRRFGLMLGQGFDCTTAINELGPVIEGFYNTKETFLLAQQQGVEMPITEQVYQILFCGKKPEDAAITLLGRKRKRE

SEQ ID NO: 39789 - protein, 303 aa, Zea mays
MDEAVPALATGQASTDAVTEQPVNVYIWDMDETLILLKSLLDGSYAGAFDGLKDHEKSTEIGKRWENLILELCDEHFFYEEIENYNEPYLNALNEYDDGRDLTSYDFEADCFSSPYDDANKKKLAYRHRAIGEKYAKGLEKVLDGHMVKVCNDQYSLTDKYTDGWLSSAHKLLEEALGKSASAPSANSSSINCIVTSGSLIPSLAKCLLYHLDDVVSSENVYSSWEVGKLQCFKWIKERFDGPNVRFCAIGDGHEECSAAQVMKWPFIKIEFRPEAHHRFPGLDLPTVQTYMDVIYESSSKDG

SEQ ID NO: 39790 - protein, 703 aa, Schizosaccharomyces pombe 972h-
MSLSRCPTDNSSSRINSSVPLINSSSPATPPESFDPQVFPSSLIHGDNLLPQDDQIASDPRSESNSCNGNTSSSLPCTDSYQYPLKHSCTPSFLRKFNESIENVSYKCLDHSPPDSVPGDFSISLVPQRNFLYSHSSLPPKIISIDRNNRIKLDNSISSNSDNFPPSPKVDTSNTVSPGSKPISEDLEDLNLQSIVQTFEDLPEGIQSYAFFQLLRSCNRQSMRLLLNECEPLLKKDILSNLPFSIVQSILLNLDIHSFLSCRLVSPTWNRILDVHTSYWKHMFSLFGFQINENDWKYANPNLNRPPFLHNDQISDDYFPEIFKRHFLNRKRWLFPSIPPSHLSFPIHVPNFMITSLLLHKDRIITTSGSGTIQIHNAITGVLEARLEGHKEGVWAVKIHENTLVSGSIDKTVRVWNIEKAKCTHIFRGHISIIRCLEILVPSRLIRHGVEIVEPDQPYIVSGSRDHTLRVWKLPKNTDPPYLPDNTNSIDRWEKNPYFVHTLIGHTDSVRTISGYGDILVSGSYDSSIRIWRVSTGECLYHLRGHSLRIYSVLYEPERNICISGSMDKSIRVWDLSTGTCKYVLEGHDAFVTLLNVFQNRLISGSADSTIRIWDLNTGKPLMVLPSNSGYISSFVSDEHKIISGNDGSVKLWDVRTGKLLRFLLTDLTKIWHVDFDAMRCVAAVQRDDQAYLEVINFSGSRP

SEQ ID NO: 39791 - protein, 115 aa, Arabidopsis thaliana
MATKRSVGTLKEADLKGKSVFVRVDLNVPLDDNSNITDDTRIRAAVPTIKYLMGNGSRVVLCSHLGRPKGVTPKLQLKASCAQKLVAGLPEGGVLLLENVRFYAEEEKNDPEFAK

SEQ ID NO: 39792 - protein, 463 aa, Lactobacillus sakei subsp. sakei 23K
MGLGTRLFRKESLERYLQQDQRLAKTLTAKDLIALGVGAVIGTGIFILPGTIAALHSGPAITLSFMIAAVVCAVAAMCYAEFSSALPVAGSAYSYGNIIFGELIGWLLGWALFLEYMLSVAAVSTGWSAYFVSFIEGFGVHIPKAITGSFDPAHGTYINLFAVLIVTLISVLLMSGTRSSTRINNLMVMIKIGVVLLFLVVGIFYVKSSNWQPFMPFGVSGVFKGASLVFFAYLGFDCVSASAAEVKNPQKNLPIGIIGTLVICTLLYILVAFVLTGMVSYRELNVANPVAFALQVVHQNWFAGLLSLGALAGMFTMMLTMTYSSSRLVYSIGRDGLLPKMLGKIETRHQTPINSVRVVTVIIATLGGLVSLDQLTNLVNIGTLIAFFFMSIGVIPLRKRKDIPNKDGFKVPLYPWLPLLSGLLCLFMLFELPAVTWMAAGIWFILGLIIYFSYGLKHSRLND

SEQ ID NO: 39793 - protein, 592 aa, Xanthomonas axonopodis pv. citri str. 306
MSTFSRRFSSRGVLLLAFVLAPAAWCADAAKPATATTATVAAHPPGAAIASGHALATDAGLQILREGGNAFDAAVAVSSTLAVVEPISSGLGGGGFFLLHDAKTGKDVMLDARETAPASATEAQFLDKKGELDRDRSVNGPWSAGIPGLPAALVELAAKHGRLPLKQSLAPSIRIATEGFPVYARMAKGYASRREVMERYPGTRAVYLRGGKPIAEGEIFKQPELAHTLQLLGDKGFDGFYKGETAKKLLAGVKQAGGQWSAAELAGYRVKERAPIQFDYRGWKITTAPPPSSGGIALAAMLQILEGWDLNMLDDVHRTHLVVESMRRAYRDRTFFLGDPDFVDVPQRVLTSKDYAQGLRATINPDKATPSDLLSGNPTPLEDDETTHFSIIDGEGNRVGATQTVNLLYGSGLIPKGTGVLLNNEMDDFALKPGTPNAFGVMGYAANAPKPGKRMLSSMTPTFMESADKAIVLGTPGGSRIITMVLLGILGYDAGLDAQAVSALPRYHHQWLPDVIDAETDAFSAQTAKGLQAMGHALELPGDTAEGGRGSSHVWGNLQTVEWDKRSNVLSGGSDPRNPVGKAQVQLDTAAH

SEQ ID NO: 39794 - protein, 273 aa, Aspergillus nidulans FGSC A4
MSRGWDMVLSRIAIMAPSMVELMFTLTVQSRAVASTHDYSCSLFASLGPQISWRTVFIVEYFGPLVIPILFLYPLRPYLYYNFDNIPQPTDIQRLVCALLVVHFLKREYETVFVHRFSNATMPARNIVKNSGHYWLLAGCNIAYWVFRPDSSAATGRVSPALVYTGLALYVFGELANLNTHLVLRNLRRPGTTERGIPSGFGFSAVTCPNYFFEVVSWVGVYLVSGLSWSVLFFIAVAAGQMALWAKKKERNYRKEFGDKYKRKRYAMIPGLI

SEQ ID NO: 39795 - protein, 251 aa, Agrobacterium tumefaciens str. C58
MGLNLFDLSGRRALITGSSQGIGFALAQGLSEAGAEVVLNGRDEAKLKAAAAGIKGARTLAFDATDHGAVREAIDRFEAEVGAIDILVNNAGMQHRTPLEDFPADAFERLLQTNIASVFHVGQATARHMISRGRGKIINIASVQTALARPGIAPYTATKGAVGNLTKGMATDWAKYGLQCNAIAPGYFDTPLNAALVADETFSAWLEKRTPAGRWGKVEELVGACIFLSSDASSFVNGHILYVDGGITASL

SEQ ID NO: 39796 - protein, 239 aa, Oryza sativa Japonica Group
MAGRGGGGGGGELQLLGTWYSPYAMRAKIALGLKGLSYEYIEQDLFGKSELLLKSNPVHKKVPVLIHAGRPVCESRVVLEYVDEAWPGAAPPLLPADPHDRATARFWATYFDSTFFPPWRALMRATTAEQRAEAFMNAVPQVEVLERAFVECSKGKAFFGGDAVGLVDVVVGGFVVWFKVVDEVAGSSLLDEAKFPGLAAWAERFLAVDAVREAMPDAGKLLEHYKGFLAKLASPAGST

SEQ ID NO: 39797 - protein, 520 aa, Antirrhinum majus
MQHQYYSLITMDDISITSLLVPCTFILGFLLLYSFLNRKVKPLPPGPKPWPIVGNLPHLGPKPHQSMAALARVHGPLIHLKMGFVHVVVASSASVAEKFLKVHDANFSSRPPNSGAKHVAYNYQDLVFAPYGPRWRMLRKICALHLFSAKALNDFTHVRQDEVGILTRVLADAGETPLKLGQMMNTCATNAIARVMLGRRVVGHADSKAEEFKAMVVELMVLAGVFNLGDFIPPLEKLDLQGVIAKMKKLHLRFDSFLSKILEDHKINSSDETKGHSDLLNMLISLKDADDAEGGRLTDVEIKALLLNLFAAGTDTTSSTVEWCIAELVRHPEILAQVQKELDSVVGKNRVVKEADLAGLPFLQAVVKENFRLHPSTPLSLPRIAHESCEVNGYLIPKGSTLLVNVWAIARDPNVWDEPLEFRPERFLKGGEKPNVDVRGNDFELIPFGAGRRICAGMSLGIRMVQLLTATLIHAFDFDLADGQLPESLNMEEAYGLTLQRADPLVVHPKPRLAPHVYQT

SEQ ID NO: 39798 - protein, 293 aa, Zea diploperennis
IIESVGEGVTDVAPGDHVLPVFTGECKECAHCKSAESNMCDLLRINTDRGVMISDGKSRFSINGKPIYHFVGTSTFSEYTVMHVGCVAKINPQAPLDKVCVLSCGISTGLGASINVAKPPKVSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTRPMNFLNERTLKGTFFGNYKPRTDLPNVVELYMKKELEVEKFITHSVPFAEINKAFDLMA

SEQ ID NO: 39799 - protein, 508 aa, Oryza sativa
MEREVCWLLCAALAAAMACYYLTGTTRRRSRRLPPGPKPLPVIGNVLSLRGNMHHALARLAGEHGPVMALKLGLVTAVVVSSAGAAREAFTKHDRRLAARAVPDASRALGFASRSMIWLPSSDPRWKTLRGVVATHVFSPRRLAAARGVRERKVRDIVGHLAGRAGEVVDVGKVVYGGVLNLVSSALFSADVVDVGEESAHGLQEAVEEIILAIAKPNVSDLFPFLRRLDLQGWRRWAEKRYDKVFGIFDSVINSRLADASTGKHADAGAGDFLDSLLDLMSAGKIARDDVTSIMFDLFGAGTDTIAITVEWAMAELLRNPSVMAKARAEMNHALAGKKTIEENDVEKLPYLQAVLREAMRLHPAAPILVPHRAEEDGAEIGGYAVPKGSTVIFNVWAIMRDPAAWERPEEFMPERFMDMAEEVDFRGKDYKFIPFGAGRRLCPGLLMAERVVPFILASLLHSFEWRLPGGMTAESLDLSEKFTTVNVLVTPLKAIPILASKNENIRE

SEQ ID NO: 39800 - protein, 413 aa, Aspergillus oryzae
MATLGPSVLRPNGQIRFPGPPHRTVSHHPSGSKSFRAAGDSHHDQVSGNRRPIPLLLFLPLGVIAALLNWNSVLVSVFNFLAILPLSAIVSDASDTLAEYFGDLVGGLINATFGNAVELSTGILAVTSGDTYFAQSVMIGSILSDILLIMGGCLISASYSTHILYFNMAQTGSLSSLMVVTAVGLILPSVLYATFTSVDLEDQVLSFSRGTSAVLLVLYVGYLYFQLGTHKHLFQQEPNSPQEGESDQDENEQKPDLSKTVLTLIAAGISIILCSHFFLASVPATSATTGISKTFIATILIPITSNCPEGVAVIAASFGGGDVNFAISVIVSSILQIGLFAIPFLVMLGWLIGVPMTLFFETFHTLALFFAILVVNQVLKDAKYTYLHGSMLVGLYVLFPSVLRGLPVTDILA

SEQ ID NO: 39801 - protein, 422 aa, Aspergillus oryzae
MSAASPNNSLLSPIPSTPMRVSRQQWRPFHRAIVSIGSRQYVKSMLATVPIGIITAILGGPPQMVFFLNLTALIPLITLLTISIADLSITTGRVVDELLKATVGNAIELILGIVAMNRGYMHMIHSTLIGSMLCYMLLVPGSCFCFTGYDKEHLYFDRTLISIMSSLMVVACMSLLIPTIMVTFPSLDITSPQASVTRLEIVFVSRGAALVLFILLGVFLLFQLKSHASIFHLAEASSEGSPDRHSLNDRGIAQDRPARIFTPRSAMIALAAGIACLTMCIICIVESANRVAQELGLSAAFPTLVLVPLIGNSARYASIVMVSRQGHVESAVRAIINSILRITLLVTPFLIILGWVLNLPITLQMDTFDATMLFLATMVLIHVIQDGRSNYFEGLMLVGMYIISAAAFYMRPGITGATKPMP

SEQ ID NO: 39802 - protein, 455 aa, Bacillus anthracis str. A2012
MIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 39803 - protein, 379 aa, Aspergillus oryzae
MAGAVQKSAWHAIQVTLFSSYANVLLVFVFLGIWSGARGWDPSAVFMLNFLAIFPLASLLSFATEELSKSVGQTVGGLINATFGNAVEMIVGITAVTQGEINIVQSSMVGSILSGTLLVLGCCFLGGGYGKETLSFNVDVTQIMSSLMIVASTSLIIPSALYSTTLCELPDGDDYILTLSHITSIFLLVFYLVYLYFQLKSHAHLFASTEEESDEKRELEPLPASIILIFATLGVTVCSDYLVEGVDGFVEVYGVSRAFLGMIVVPIVGNAGEFAITVNAAMGGKLDLAIGVIVGSTLQIALFVTPFLVLCGWALGQPMSLRFNTFQTACFSLAVVVMNSLTREGKSNYFEGLLLIGTYLIIAIAFYVHPDVTDHLAIA

SEQ ID NO: 39804 - protein, 546 aa, Hordeum vulgare
MGPDLGALALRYTGLAVSDHDSIVAINIFIALLCGCIVFGHLLEGNRWVNESTTAIVLGLITGGVILLCTKGVNSRILIFSEDIFFIYLLPPIIFNAGFQVKKKQFFRNFATIILFGAVGTLISFVIITLGAMGLFRKLDVGPLELGDYLAIGAIFSATDSVCTLQVLNQDQAPLLYSLVFGEGVVNDATSVVLFNAIQNIDLNHFDVLVLLQLIGKFLYLFLTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSYLSNLSKKESHPKISFNQQVIIWWAGLMRGAVSIALAYNKYTTSGHTAVRVNAVMITSTIIVVLFSTMVFGLLTKPLINLLVPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAENRS

SEQ ID NO: 39805 - protein, 369 aa, Escherichia coli CFT073
  misc_feature (91)..(91): Xaa can be any naturally occurring amino acid
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTEXCGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFELARRFGATDCINPNDYDKPIKDVLLDINKWGIDHTFECIGNVNVMRAALESAHRGWGQSVIIGVAGSGQEISTRPFQLVTGRVWKGSAFGGVKGRSQLPGMVEDAMKGDIDLEPFVTHTMSLDEINDAFDLMHEGKSIRTVIRY

SEQ ID NO: 39806 - protein, 324 aa, Dehalococcoides ethenogenes 195
MLANGNLTDELKIFTGNANPDLAKAVADYLKVQMGKCEVFQFSNENIFVRIQESVRKKDVYVIQPTCSPVNQSIMELLIMMDALKRASSERITAVLPYYGYGRTDKKDQPRVPITARLIADLLTAAGASRILTLDLHAPQIQGFFDMPVDELTAENLLANYFKKKKLEDLVVVATDVGISKKARDFAAKLDAPLAIIEKRRMGNNDITRTINIIGDVEGKNALTFDDEIDTAGSLVGNVNILINKGVKEVYSCATHPVLSGPAIQRIAASPIKELVVTDSIPLTPPKKIDKITVLSIAPLIGEAIYRIHTGNSIGEMYDQMQME

SEQ ID NO: 39807 - protein, 220 aa, Bacillus anthracis str. A2012
MEPTGDPFNSIIKLETTSPSKPLNPMINAGALAITSMLAGKDNEEKMERILHFVREITDNPTINYSSKVANSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 39808 - protein, 456 aa, Synechococcus elongatus PCC 6301
MPVAGPRCSVEGSYMSNDKTPNSPESTPSTPADEVLDGLLAELSPEASAEPNPADDSGNPFTTIFKSVTDKATELGSAATEGLSNLQESATELAAETKEKFGNFAEAHKDDLGQLLTSAQGKAASFGEAVSDRFGELGESATESFGNLQEGAAGFAAGAKEKFGDFAEASQEKLSEIAETTQDKAASFGEAVSDRVEGLRGSAAEKLGNLQEGASELAAGAKEKFGDFAEASQEKLSEIVETTQGKAASFGEAVSDRVEGLRGSAAEKLGNLQEGASELAAGAKEKFGDFAEASQEKLSEIVETTQGKAASFGEAVSDRFGELGESAAEKLSNLQEDASEFAASAQEKLSTFTNARQEELGNLTKSAQSDVQDTANTVSEQLEQAPEAVSTAADSLKGAQEKLEAAVVASQSVAEKLKPAEVQSQSSLQLASESPSPSFFGRLLRKIKGFFRKLFG

SEQ ID NO: 39809 - protein, 340 aa, Bacillus pumilus SAFR-032
MKVKAAINGFGRIGRMVFRKAMLDDQIQIVAVNASYPAETLAHLIKYDTNHGRYECDVIAEDDALIVNGKRVLLLNNRDPKQLPWGELGIDIVIEATGKFNSKDQAMGHIDAGAKKVVLTAPGKNEDVTIVMGVNEDDLDPEKHVVISNASCTTNCLAPVVKLLDDEFGIDNGLMTTVHAYTNDQKNIDNPHKDLRRARACAQSIIPTTTGAAKALSLVLPHMKGKLHGLALRVPVSNVSMVDLVVDLKKDVTAEEVNAAFSNASKTSLSGILDYTDEPLVSTDFNTNPYSAVVDGLTTMVMGDRKVKVLAWYDNEWGYSCRVVDLVKFVGSQMKELSAV

SEQ ID NO: 39810 - protein, 468 aa, Methanosarcina acetivorans C2A
MISRKMNLESLDESKKYRVGAYSARYVPKTKEKGIPKYEFPEEGMSPRAAYQLVHDEQSLDGNPFLNLASFVNTWMEPEADKLVMENISKNIIDIFEYPQTSRVIHHNMVNMLGRLFNGHHTDFVGTSTAGSSEAIMLGLLAHKWSWKKSGRGTDKPNIIFGNDAHVCWDKFARYFDVDTRKVPIDKDRRTITAEAVAERIDENTICVGCVLGTTFTGEIDPVKDINDLLLEYKEEKGWDIPIHIDAASGGFILPFTEPDFEWDFRLERVKSINVSGHKYGLTYPGLGWLIFRNKNALPEDLIFHVNYLGEMEDSYTLNFSGGSAMVAAQYYNFLRFGRAGYTGIMKKILAVSQDLAEKVDRLGRFEMLNKGERLPIIAFRQKEKTGYSLLQLSHKLREKGWIVPAYCLPENAADIEIMRIVVRENLTPDMASIIVEDLEKACQFLENGTEAGAEKPCPSGKDMAHIC

SEQ ID NO: 39811 - protein, 357 aa, Oryza sativa Indica Group
MGGGSGVGDEEAEAEAAAAAEVTGRGGARGDVGGGGGGAGEAAAAVRTGGERRRRCGRVGGVEIPGGVGSQLAANSEVNDAVVPANSEVRLRFQVACLSGSVSTSMPALKGHSRGLLLSPQIPNLSSPKLSPTPMTGRYYTPQTHPPPPPENTLDVFMDGDTIPIHTTITSSHSLAAQFINEIARERPQGGLIVGIDTEWRTDHLPDGKTCYKVAVLQLCVGRRCLVFQIYQAGNMVPHELAEFLADPSVRFVGVAVNNDMQRLANDCNLRVACAVDLRYAAAAVLGQPELARAGLKRLALTVMGAHMEKEKNITKSRWGEPTLTWEQVNYACIDAYVSYEIGRRLLSGEPILAAPL

SEQ ID NO: 39812 - protein, 725 aa, Candida glabrata CBS 138
MLGFKRKRTNTNNNNNNTMNFAPDLLDDLMLDDRYLDENAILDDYDTAEAALDPVRYKKQRTVSLPQLPHSRLSYSYFVNTLDGSNSAAMTHATANLSSANMGTANQGLPHQALGSAYTHHRYPADDNDMSSLLDASLYMGQNAHAALAQPALKSGNWVTPPARIQNDDELLHLTGSSSKTLEGNRSVQLKVAHSVSPFTNENSTGAASGISAGFKNSFKRLLSHEQQPYDDNIPRRSSIASRRRSSVKRVQDAQGSLPNMNYFQTDKDGHYIYQENDVFGSNGQFVVKELLGQGTFGKVLKCVDTYSPNNKFVAVKVIRAVDRYREAAKTELRVLSTILENDPVGQFQCLLLRDCFDYKNHICLVTDLYGRSVYDFMCSNGVARFPGSHIQAIARQLIRSVCFLHDMGIIHTDLKPENILLVDESYVEYDLPQNVIDSMSNRRRAASQGKRKILTNPEIKIIDFGSAVFHKEYHPPVISTRHYRAPEIVLGLGWSFPCDVWSIACVLVELVIGESLYPIHENLEHMAMMQRINGTPFPTKLIDKMFYKVRHKLGNLPSDLNTTVVRHFNRQSLTLQWPEKNKRGEIVTTEKSMKRVMESCDRLDVYISRVLKQDYGERLSINWNLSPDKNWSLVSSKLLWRGHQHYDGNIYEGSHMFPPQHKLDKDSFLFWYWFVDLCRKMFEFDPTKRITARKALDHEWFNLGIFDEGITNFANPRANYRNSI

SEQ ID NO: 39813 - protein, 600 aa, Yarrowia lipolytica CLIB122
MTATSATASTKKDGNVHLGEYLFSRIKQLGIDNILGVPGDFNLHLLDYIYRVPDLNWVGCCNELNAAYAADGYGRVKHLPGVLVTTYGVGELSALNGVSGAFAEQAPLLHIVGTTGRPIQEESWLVHHVLPKENSLQEPDHLVYQGMSEKVRCCSAFLNDKETAAAEIDRVLTTICQKSLPGYLFIPVDMTWQPLDAARLDSKLDYSVKNEDPKLENEIVDSILSEIYASKNATVFADVLTARHRATDLVRELAKKTNFPNYTSPLGKGILNENEDRFVGVYNGQLSLEGVAKSIEASDCVLFTGPLLSDSNTGGFSHNLKDENTIYLSPDYVKVKGKLYEGVHFFPVLKKVVEQLDVEKISAESKTAAMPTISPPPVIDSPLPISQTFLVDSMSKMMRPDDLLIVETGTFQFACSDVKFNTNNSLLTQIFYSCIGFTLPATLGAALAKREDAAAKNDKGRVILVEGDGSAQMTIQELGTMVRQGLNPIIFLLNNDGYSIERAIHGPEQSYNDICPKWKWTKLLEAFGGTEGVDSFSTTVKTREELEALIGDEKFMNSDKAQLVEVIMDVNDYPWRLNEQIKLMGGKNMKVFAEYQKKNP

SEQ ID NO: 39814 - protein, 675 aa, Oryza sativa Japonica Group
MAPMPAPAVALAVLVLLSAVPGYFSDDLNTDAQALQALRSAVGKSALPSWNSSTPTCNWQGVTCESGRVTELRLPGAGLMGTLPSNVLGNLSALRTLSLRYNALTGPIPDDLSRLPELRAIYFQHNSFSGEVPASVFTLKNLVRLDLAGNKFSGEISPDFNKLNRLGTLFLDGNSFTGEIPKLDLPTLSQFNVSYNKLNGSIPRSLRKMPKDSFLGTGLCGGPLGLCPGETALTPAGSPEVQPAGGGAADAGGASSGTKKKLSGGAIAGIAIGCVFGVLLLLALIFLLCRKKSSSSTPATAVEKGRDLQMAPMDMEPKGQNGSAAGNGAHVGAAAAAPAAATSAAVAAAAAAAKTGGATGGSKKLIFFGPMAAAPPFDLEDLLRASAEVLGKGAFGTAYKAVMESGSAVAVKRLKDVDLPEPEFRERIAAIGAVQHELVVPLRAYYFSKDEKLLVYDYMSMGSLSALLHGNRASGRTPLDWETRSAIALAAARGVAHIHSTGPTASHGNIKSSNVLLTKNYEARVSDHGLPTLVGPSFSPTRVSGYRAPEVTDIRRVSQKADVYSFGVLLLELLTGKAPTHAVVNEEGLDLPRWVQSVVREEWTAEVFDQELLRYQNVEEEMVQLLQLAIDCSAQHPDRRPSMSEVAARIDEIRRSSLGDRPATDSAGEGEEPSL

SEQ ID NO: 39815 - protein, 471 aa, Arabidopsis thaliana
MGESSGSSSSLAAINSSNIGFQLLKKHGWKEGTGLGIAEQGILVPLQAEPKHNKRGVGAKQPAKRKVAQPQAKDEEVSKQSKKLSKKMRKMMEHEKHLQEKEFERAFFREFWPDNFPDKLTTVEPRRIRSRLFKSSSFNNDLRPKHISISAAAPKKKSETVTAPTPAAKKNSSVEEETEEEVEEDMPWIQEKALDLVEFTGSVSQAIPGPRVGSSKLPWMLAVPLAYAGVTFVTAFVKTVQKFSSPKAQRKKLVNQNAMLCRSIDELLRKAGTVHSSELKALEQKTEFNMEEILRKYIRYALNEKPFNPDLVADLIHLRKASGLNDSQIPEILNEISRRIVKEKGPVVMKMQGFTEKGFKRKLAVQALFGKIYYLSELPDFCSKDNSLIVKEIFGVTEYVNFILMLLQCSFYLTISTKHFSEDAEKLRIHALAEAGDIEALEKMVEFEKTAESSSDKEEDSNEEDDSNTTS

SEQ ID NO: 39816 - protein, 136 aa, Oryza sativa
  misc_feature (34)..(34): Xaa can be any naturally occurring amino acid
  misc_feature (46)..(46): Xaa can be any naturally occurring amino acid
  misc_feature (54)..(54): Xaa can be any naturally occurring amino acid
  misc_feature (72)..(72): Xaa can be any naturally occurring amino acid
TLWDCGITYIGGHQCCGQVPTSWTPYCGFYRLTXEAKRSGRHIDEXSVDVGDGXSRTLCTWLIYLSGKGMPXESSGQALVVGETVCDDHPGGVFAEFAPVQDWALLYLHGAICMGHEARVLRTNIKYVLRSDVVFA

SEQ ID NO: 39817 - protein, 276 aa, Schizosaccharomyces pombe 972h-
MVKVAAFVCGVASSGKSTFCGALMSYMKSVGRSCHLVNLDPAAENFEWEPTVDIRDLISIDDVMEELDYGPNGGLIYCFEFLMENLDWLNEEIGDYDEDYLIFDMPGQIELYTHVPILPALIRHLQVTLNFRPCAVYLLESQFLVDRTKFFAGVLSAMSAMVMMEVPHINLLSKMDLLKDNNNITKAELKRFLNTDPLLLTGEINETTNPKFHELNRCIVQLIDDFNMVNFLPLESGNEESVSRVLSYIDDATQWYEDQEPKDPDRFEADDLEDDE

SEQ ID NO: 39818 - protein, 503 aa, Triticum aestivum
MDLRVAAPASVAAAARRGVLGCARVRPLQGRRQCRPSVRVSVATTESAAAAAAVAASADEDEETTNPRTVVAVILGGGAGTRLFPLTKRRAKPAVPIGGAYRLIDVPMSNCINSGINKVYVLTQFNSASLNRHLSRAYNFSNGVGFGDGFVEVLAATQRPGSEGKTWFQGTADAVRQFAWLFDDAKSKDIEDVLILSGDHLYRMDYMDFVQSHRQRDAGISICCLPIDGSRASDFGLMKIDDTGRVISFSEKPRGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDMERGDQLAEGKVPIGIGENTSIQNCIIDKNARIGKNVTIANAEGVQESDRASEGFHIRSGITVVLKNSVIADGLVI

SEQ ID NO: 39819 - protein, 208 aa, Oryza sativa
MLPPYGRGISSGRPGRYASLGRRYGMSKSEENIKEGWKRAFSAPWPKTLRYQGDGRPFWRIVVAEATECTNNDYFEEVYEYYAHGDAWRLPAGAYETLRDLKDAGVKLAVVSNFDTRLRKLLKDLHVSDMFDAIVVSSEVGHEKPAPEIFKRALDQIGVEASKAVHVGDDETADKAGANAIGLECWLWGQDVRTFSEIQDRILTRFPQ

SEQ ID NO: 39820 - protein, 432 aa, Prochlorococcus marinus str. MIT 9303
MASSDDAKLRPLPNTAALSGVLEAFAFFRDPAFAQKRFKRHGNVFETSLLGQPMVFIQGGQAISDLLAQPNAVEGWWPESVRKLLGSHSLANRNGASHRARRRVIGQLFSASALQRYSAGIISMVKDLADELQAATTALPLAERMRRFAFSVIATTVLGLEGTDRDELFVDFEIWTRALFSIPIALPGSSFAKALKARERLLKRLQKVLLKASNGNGGLDLLAGGLDEAGIPLTDEDVVEQLLLLLFAGYETTASSLSCLMRELLLNPQVETWLREEIDGLDWPPAPEQATTAYDQVNAPKLDAVVSEIMRLTPAVGGFFRRTKCALVIDGVEVPKNRVVQVALAASNRHGAGDLEAFRPQRHLDDGCSATLLPFGGGERVCLGKPLAELEIRLMVVGLFHQLRLHLIPDQDLTLQMLPSPTPRDGLLTKVL

SEQ ID NO: 39821 - protein, 240 aa, Kineococcus radiotolerans SRS30216
MRGVRPWWISSGEKPLPAVPGGTDGGGDPPDEEDPMSTPTTTTGPFDDQLSQRLLFQRIVVLGQEVDDAVANRICAQLLLLSADDPRSDIALYVNSPGGSISAGLAIYDTMRLIPNDVSTLVMGMAASMGQFLLCAGTAGKRYALPHARVMMHQPSGGIGGTAADIAIQAENLAHTKATMQRLIAEHTGQDVETVELDSQRDRWFTAEEALAYGVVDHVVTGVSDVRLGSATRDARKVGL

SEQ ID NO: 39822 - protein, 225 aa, Solanum tuberosum
MSNLNGAYYGPSIPPPSKSYHRHGRGSSCNPCSCLFGCLCNCIFQIIFTILIVLGVIALVLWLVLRPNKVNFYVTDATLTQFDYSTTNNTLYYDLALNMTIRNPNKRIGIYYDSIEARGMYQGQRFASQNLERFYQGHKNTSYLHPVFKGQNLVLLGDREKTNYNNEKNLGIYEMEMKLYMRIRLKIGWIKTHKIKPRIECDFKVPLESSGRSVNFEETRCHLDW

SEQ ID NO: 39823 - protein, 400 aa, Nostoc punctiforme PCC 73102
MQFAKRLQPLQSNVFADMDRAKAIALAAGQEVIDLSLGSSDLPVEAHVIEAIAQSLHDRSTHGYLLFNGTLGFREAAANWYEQKFGIKVDPQTEVLPLIGSQEGTAHLPLALLNPGDFALLLDPGYPSHAGGVHLASGQIYPMPLRAENAFLPVFADIPAPVLAQSRMMVLSYPHNPTSAIAPLSFFQEAVAFCQQHNLILVHDFPYVDLVFQETGEWADSSPNPKSLVPSILQADPEKSVSIEFFTLSKSYNMGGFRIGYAIGNAELINALRQVKAAVDFNQYRGILNGAIAALTGPQAGVKSAVAIFQQRRDAFITALHSIGWNVPTPKATMYIWAKLPSAWSQNSIEFCTQLVKQTGVAASPGAGFGKSGEGYVRFALVHEPPLLETAVERIAQFLY

SEQ ID NO: 39824 - protein, 497 aa, Spinacia oleracea
MAFPIPARQLFIDGEWREPIKKNRIPVINPSTEEVIGDIPAATAEDVEVAVVAARRAFRRNNWSATSGAHRATYLRAIAAKITEKKDHFVKLETIDSGKPFDEAVLDIDDVASRFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 39825 - protein, 574 aa, Fusobacterium nucleatum subsp. vincentii ATCC 49256
MAFMKIKGIPASPGIAIGKAFLYKENKLEIVEKSNLSKEEEIERLVKGREIAKKQLEEIKENTLKKLGKDKADIFEGHITLLEDEELFSEIDSKISQKKCTAEFALNEAIDEYATMLANLEDTYFKERAGDLRDIGKRWLYGVMNEQIVDLSKLKPETIIVAKELNPSDTAQINLDNVLAFVTEIGGKTAHSSIMARSLELPAVVGVGEVLDKLEDNQILIVDALKGEVIVSPDVETLQIYKEKREKFLKEKEELKALKDKEAISKDGIKVDVWGNIGSPNDVKGIISNGGFGVGLYRTEFLFMEKDSFPSEDEQFEAYKIVAEELKAYPVTIRTMDIGGDKSLPYMELPKEDNPFLGWRAIRVCLDREEILRTQFKALLRASKYGQIKIMLPMIMDIVEVRKARAILEECKKELQEKGIDFDKNIMLGIMVETPAVAFRAKYFAKECDFFSIGTNDLTQYTLAVDRGNEKIANLYDTYNPGVLQAIKMLIDGAHEGGIKISMCGEFAGDENAVALLFGMGLDAFSMSGISIPRVKRIIMKLDRKECENLVEKVLTLSTASEIKEEVKKFMKKI

SEQ ID NO: 39826 - protein, 424 aa, Crocosphaera watsonii WH 8501
MRIKRIIASEMLDSRGNPTVEAQVMLEDGTVGSALVPSGASTGEKEAVEMRDGDKSRYKGKGVLKAVENANNHLAPALIGMDVTQQRAIDQTMIDLDGTPNKAKMGANAILAISLAAARTAANYLKMPLYRYLGGTNASLLPVPCMNVINGGSHADNTVDFQEFMIAPHNAPSFAEAIRMGAETFHTLKGLLKDKGLSTGIGDEGGFAPNLKSNEDAIEFIIEAIEAAGYKPGEDISICLDPATSELWKDGKYLFFKSDNSTKTPSEMVALWQDWMNKYPIVSLEDGMGENDWDGWKELTDKIGDKVELVGDDLFCTNPTILAEGIEKGVANSVLIKVNQIGSLTETLDTIELAKKHNYKCFVSHRSGETEDTTIADLVVATSAGQIKTGSGCRGERIAKFNQLLRIERDLGKAARFAGKAAFL

SEQ ID NO: 39827 - protein, 349 aa, Populus trichocarpa
MEHQHRRSKLLLLLCVALSYYAIIAIAGKSYYEVLQVPKGASDEQIKKAYRKLALKYHPDKNQGNEEANLRFAEINNAYEVLSDSEKRNIYDRYGEEGLKQHMASGGRGGGGGMNFQDIFSQFFGGGSMEEEEKIARGDDVIVELDATLEDLYMGGSLKVWREKNVIKPAPGKRRCNCRNEVYHKQIGPGMFQQMTEQVCEQCQNVKYEREGYFLTVDIEKGMQDGQEVVFYEDGEPIIDGEPGDLKFRIRTAPHDIFRREGNDLHTTVTITLVQALVSFEKNIEHLDEHLVDISSKGITKPKEVRRFKGEGMPLHFSTKNGDLYVTFEVLFPTSLTEDQKKRIKEVLG

SEQ ID NO: 39828 - protein, 354 aa, Oryza sativa
FGECMSTRIFAAYLNKIGVKARQYDAFDIGFITTDDFGNADILEAAYPAVAKRLHGDWIRDPAIPIVTGFLGKGWKSGAVTTLGRGGSDLTATTIGKALGLREIQVWKDVDGVLTCDPNIYPNATTVPYLTFEEAAELAYFGAQVLHPQSMRPAREGDIPVRVKNSYNPKAPGTLITKQREMDKVVLTSIVLKSNVTMLDIVSTRMLGQFGFLAKVFSIFEDLGISVDCVATSEVSISVSLDPSKIWSRELIQQELDHVVEGLEKIAVVHLLQQRAIISLIGNVRRSSLILEKAFQVLRKSGVNVQMISQGASKVNMSLIVHDSEAKQCIKALHQAFFEDDVLTEVEEEALHMS

SEQ ID NO: 39829 - protein, 299 aa, Brassica napus
  misc_feature (120)..(120): Xaa can be any naturally occurring amino acid
GAGAKEDRRRRRREVRKNGACGFGKLNLEEAPPIWGSRSVDCFEKIKLISHGTYGEVYMAKEIETGEIVALKKIRTNDEREGFPVTAIREIKILKKLHHRNVINLKEVVYSSCPDKDLLXDDNNKYKGEIYMVFEYMDHDLAGLAYRPGTRFTAPQIKCCMKQLLTGLHYCHVKHVLHRDIKGSNLLIDKKGNLKLADFTLARTLSLEFTGTLTNQVTTLWYRAPELLLGATEYGPAVDMWSVACLFAELLNGEPIFPGKTEIDQLKKIYDLCGSPDENNWPGVSEMPLYKRFEPSLPL

SEQ ID NO: 39830 - protein, 160 aa, Fusobacterium nucleatum subsp. vincentii ATCC 49256
MLRIGNGYDVHKLVEGRKLMLGGVEVPHTKGVLGHSDGDVLLHAITDAIIGALGLGDIGLHFPDNDENLKDIDSAILLKKINDIMKEKNYKIVNLDSIIVIQKPKLRPYINGIRDNIAKILEINSELVNVKAKTEEKLGFTGDETGVKSYCVVLLEKEKC

SEQ ID NO: 39831 - protein, 440 aa, Coprinopsis cinerea okayama7#130
MANGVHTNGAQKQDRSNLIPFSSRLKEGRALAQDVWSIFAAANLPAECINLGQGYMNFAPPKWVTKAAEDALQDVAPNHYSHPRGRIRLREALKNFYSPLLNRDLDVESEILVTSGANEGQYSVFTAFLEQGDEVIMFEPFFDQYLPSVTFNGGKPVYVPLHPPTSSKLQSSSGEWTIDFDELKCHRRAVTPRTKMIIVNTPHNPVGKVFTKEELEEIAAIAEENNLLVMSDEVYDSLVFDGKEHFRIATLPGMWDRTVTVGSAGKAFAATGWRIGWLLGPPSIIQPTLAATTRIVFCTNSPLQEAAACGLEQAQERKFFETQLAEYAERRAILCDAFDRLGLKYSLPEGSYFVLLDISKVKFPEDYPFPKSVLGRGRDFRACWFIAVEIGVSSIPVSEFYCEEHARIGEAYARFAFCKDIDTLKAAADKLQKLKAYIEN

SEQ ID NO: 39832 - protein, 407 aa, Vitis vinifera
MAIRCTDFGVKSWFASNPRNYASINVRIFTIRCSSGLGERPWKTSDARLVLEDGSVWKAKSFGASGTQVGEVVFNTSLTGYQEILTDPSYAGQFVLMTNPHIGNTGVNFDDEESSQCFLAGLVIRSLSIGTSNWRCAETLDDVDTRAITRRLRQDGSLIGVLSTEDSKTDEELLKISCSWDIVGVDLISGVSCNSPYEWVDKTGSEWDFNSNETAGETFRVIAYDFGIKHNILRRLASYGCKITVVPSTWPASETLKMKPDGVLFSNGPGDPSAVPYAVETVKEILGKVPVFGICMGHQLLGQALGGKTFKMKFGHHGGNHPVRNLRSGRVEISAQNHNYAVDPASLPEGVEVTHVNLNDGSCAGLAYPALNIMSLQYHPEASPGPHDSDPAFREFIQLMKQVKQNA

SEQ ID NO: 39833 - protein, 387 aa, Methylobacillus flagellatus KT
MNLHEYQAKALLQRYGVNVPRSQVAETAQAAVEAARALEGDAWVVKAQVHAGGRGKAGGVKLVRTLDEVQDIAVSLLGKRLVTYQNAPDGQPVEKVLVEATLPIARELYVSMLVDRSLERVVLVASAAGGMEIEEIAKDSPEKILQEVCDPLNGLVDYQARNIAFALGLVGDQVAAFTRLAKGLYRLFKENDLALLEINPLIVTAEGALVALDCKMSVDDNALYRRRELAEQRDWSQDDAKEAEAHNAGLNYIALNGNIGCMVNGAGLAMATMDLIKLHGGAPANFLDVGGGATATTVARAFKIILADPNVKAILVNIFGGIMRCDIIAEGIITAVKEVGIEIPVVVRLEGTNVELGRKMLSESGLSIISAAGLTDAAQQAVAAVKV

SEQ ID NO: 39834 - protein, 199 aa, Triticum aestivum
  misc_feature (194)..(194): Xaa can be any naturally occurring amino acid
HYRTSLYKKAGWYRSGIPGISSTHASDDQELSKLGADALIPAMPGHVVQAFTLLKSSPEAQSVVASLASDKNVWDAVLKNERVMEFYKSHQQTLVNTFPEGTDSTDSVESPEKFEEASPEYALPTASPLSDFVDNAKKTMMEMVDNITNFFQDLFHNPAEAEAGPGSSSKKPSFAEMAAGGSFMALAMAVILVXSVKRA

SEQ ID NO: 39835 - protein, 285 aa, Vitis vinifera
MATKLVQPPVPASHVAPPIPRLTKMMRAHRPVSATHSGSRRRSIFGEFPSGSRPFYAIRVAEQSPGLVGDDQDIVVKEEEEEDEQEGASSDDRTIANVKADLYQAVQGINRGVFGVPSAKKSEIEALVKLLESQNPTPEPTLNLDKVNGWWKLVYSTITILGSKRTKLGLRNFITLGDFLQIIDVEEAKAVNVIKFNARGFNFLNGELKIEASFKIASKSRVDIKYDSSTITPDKLMNVFKQNYDLLLGIFNPEGWLEITYLDDSMRIGRDDKGNLFILERSEAT

SEQ ID NO: 39836 - protein, 489 aa, Salmonella typhimurium LT2
MGSKTKTTEAPALRRELKARHLTMIAIGGSIGTGLFVASGATISQAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 39837 - protein, 469 aa, Oryza sativa Japonica Group
MATATASSLSLLFAHPHSSNPRPFAGGPHLRRPLRAAPHRARCASDAATTATRHRRPAEENIREEAARLRGPGNDFSAWYVPFPPTPEDDPDERYSLDEVVYRSSSGGLLDGNSNLFWAERLGREHLGGMTDLWVKHCGISHTGSFKDLGMTVLVSQVNRLRRAPLSRPINGVGCASTGDTSAALSAYCAAAGIPAIVFLPADRISLQQLIQPIANGATVLSLDTDFDGCMRLIREVTAELPIYLANSLNSLRLEGQKTAAIEILQQFDWQVPDWVIVPGGNLGNIYAFYKGFEMCRVLGLVDRVPRLVCAQAANANPLYRFYKSGWTDFQPRVAETTFASAIQIGDPVSVDRAVVALKATDGIVEEATEEELMDAMSLADRTGMFACPHTGVALAALFKLRDQRIIGPNDRTVVVSTAHGLKFTQSKIDYHDRNIKDMLCQYANPPINVKADFASVMDVLQNKLNGKI

SEQ ID NO: 39838 - protein, 172 aa, Dehalococcoides ethenogenes 195
MLAKVERIDPSELELNDKLIFINRVTKVVKGGKRMGFAALVVTGDGKNHVGIGVGKAKEVPSAISKASANAKRNLSRILLNGTTVPHEIVFKYGAAQVLLKPAAPGTGIIAGGSVRAVLESTGIKDILTKSMGCSNKANVAKATLGGLTAMRDPKTTVTKRRSSLKEEAAGG

SEQ ID NO: 39839 - protein, 189 aa, Mycoplasma gallisepticum R
MTSMNRFIKSATSLKDCINDSKKEVCLIGRSNVGKSTIINGLANAKIAQTSKTPGRTVTMNFYEISNQRIVDLPGYGYARIKKSQKEEISLFLSDYLNHRKNLVGIFLILDLGVITDQDIEIVRLLTTLDVEYYIVFNKIDKYPKSAYINNKEKILDALKVNEDRILLISAKNKQNLNNLMLKIIDVIS

SEQ ID NO: 39840 - protein, 772 aa, Polaromonas sp. JS666
MPTPTAATPDNRDEKRAELRRAALEYHEFPTPGKLAIAATKQLTNQRDLALAYSPGVAAPCEEIVKDPNAAFKYTSRGNLVAVVTNGTAVLGLGDIGPLASKPVMEGKAVLFKKFAGVDVFDIEIDEKDPAKLVDIIAALEPTFGAINLEDIKAPDCFYVERELRKRMKIPVFHDDQHGTAITVGAAVLNALKVVGKDLKQVKLVTSGAGAAALACLGLLIKLGIPRENIYVTDLAGVVYEGRTELMDEDKIQFAQKTSARTLGEIIEGADIFLGLSAGGVLKKEMVKKMAAKPIILALANPNPEISPEDVKSVRDDAIMATGRTDYPNQVNNVLCFPYIFRGALDAGASTITIEMEIAAVHAIAELAQAEQSEVVAAAYVGEKLTFGPDYLIPKPFDPRLMMKIAPAVAKAAADSGVALRPIQDMTAYREKLQSFVYASGTVMKPIFASAKTAARKRVAYAEGEEERVLRACQIVVDENLARPTLIGRPAIIAQRIEKFGLRLKQDLDYDVVNVEQDHRYRDFWQTYHRMMERRGVTVQMAKIEMRRRLTLIAGMLLHKGDVDGLICGTWGTTAHHLDYLDQVIGKREGVCTYACMNGLLLPGRQVFLLDTHVNYDPTAEQLAEITTMAAEEMVRFGIKPKAALLSHSNFGSSSQPSALKMRRTLELLRDKAPWLEVDGEMHGDMALDADTRGVIMPNSTLTGEANLLVLPNIDAANIAYNLLKTAAGGNITIGPVLLGANKPMHILTPTATVRRIVNMTALTVADANAAR

SEQ ID NO: 39841 - protein, 410 aa, Pseudomonas syringae pv. tomato str. DC3000
MALIVQKFGGTSVGSVERIEQVADKVKKFREAGDDLVVVLSAMSGETNRLIELARQISDQPVPRELDVIVSTGEQVTIALLAMALMKRGVPAVSYTGNQVRILTDSAHNKARILQIDDQKIRSDLKAGRVVVVAGFQGVDEHGNITTLGRGGSDTTGVALAAALKADECQIYTDVDGVYTTDPRVVSQAQRLDKITFEEMLEMASLGSKVLQIRAVEFAGKYNVPLRVLHSFKEGPGTLITIDEEESMEQPIISGIAFNRDEAKLTIRGVPDTPGVAFKILGPISAANIEVDMIVQNVSHDNTTDFTFTIHRNDYQAALQVLETTAREISAREVSGDTKIAKVSIVGVGMRSHAGVASRMFEALAKESINIQMISTSEIKVSVVIEEKYLELAVRALHTAFELDAPRQGE

SEQ ID NO: 39842 - protein, 423 aa, Bacillus pumilus SAFR-032
MSQGEKITVTGGVLNVPNNPIIPFIEGDGIGPDIWKAASRVLEAAVEKAYKGEKQITWKEVYAGEKAYNKTGEWLPEQTLEDIREYLIAIKGPLTTPIGGGIRSLNVALRQELDLFTCLRPVRWFKGVPSPVKRPEDTDMVIFRENTEDIYAGIEYAKGSDEVKKLIDFLKNELGVNKIRFPETSGIGIKPVSEEGTSRLVRAAIQYAIDQGRKSVTLVHKGNIMKFTEGAFKNWGYEVAEKEFGDKVFTWAQYDRIVEQDGKDAANKAQSEAEAAGKIIVKDSIADIFLQQILTRPAEFDVVATMNLNGDYISDALAAQVGGIGIAPGANINYETGHAIFEATHGTAPKYAGLDKVNPSSVLLSGVLLLEHLGWQEAADLVIQSVENTIASKVVTYDFARLMDGATEVKCSEFADELIKNLS

SEQ ID NO: 39843 - protein, 387 aa, Schizochytrium limacinum
MPNKPDAPIRLAVGIFYIVLRALDTVEDDMNLSSFDSYVLEEDKKDVEDARSAAKQRLLCQFAQRLSDSVEGNADKHQPLHGFGEGHERELIENMDAIVYGMSVLPPKLRQVVLDITEEMGVGMAGYVSRDLKNGTDDAKDFEQYCHYVAGTVGDGLTRIFASCGYCPADLVSHRELWDAMGSFLQRTNIIRDYLEDLVDGRAWWPRSVWELYVTKDAEFGRSKSLSRLADSASIEAGLSTSCLNHMIADALEMVGSCLSYLEALNDPDVISFCALPQVMAIATLSVRFDNQKVFQGVVKIRKGQAARIMLDMSPMEHPTIFELQQNYLSWFARCAREIQAKARRAATRDPQAQRTDNICGKIIKVVDSKLQCLQESGRPLGQTHSD

SEQ ID NO: 39844 - protein, 237 aa, Synechococcus elongatus PCC 6301
MRRRSLLAALGGSCIGWLGSSQPVWASADWDYSRRRGPRQWAKLDPAYAICQQGRQQSPINLTGQPDRTPLDYRDRPFKGILQQAPHSLRIDCPAGNGFWEAGTFYELLQFHFHTPSEHQHQGQRFPAEIHFVHRSDRDQLAVVGVFLAAGDRPLPILDTLLAVPPSTDNQLLSTAIQPTDLMPRDRTVWRYSGSLTTPPCSEPVLWRVCDRPLFVARQQLRQLRQRLGMNARPLQA

SEQ ID NO: 39845 - protein, 351 aa, Mycoplasma gallisepticum R
MKIKVVKISIIMHVKSNHIIFGLSAAKKLTDSICRRLSMKPGEIVIQKFADDEIFVRPDCTLRNKDVVFIQSTNSPVNDNLMELLIAIDSAKRASAKSITALIPYYGYARQDRKSAGREPITSKLVADLLTKAGVTRATLTDIHSDQTQGFFDIPVDILKASFVLLSHVLVDNKIDDLVVVSPDYGGVKRARKIAESINVPLAIIDKRRPKPNVAESINILGEVKNKCCILVDDMIDTGGTIISAAKLLKKQKAKTVLVMATHGLFNKNAIELFDECYKKKEINKVYIADTIDQTEKNLEKKPQFKVVKLDHFYSLVLDKYINGGSISDVYTIYQEWVKSPNLKKILKEIE

SEQ ID NO: 39846 - protein, 524 aa, Candida glabrata CBS 138
MFRSTTSNVLTRALRTRNAGVSSVMVLRAYSHLPLHVPIKLPNGLEYEQPTGLFINNQFVPSKQHKTFEVINPSTEEEICHIYEGREDDVESAVQAADTAFKNGSWTDIDPFERGQALYKLAELIEKDKEIVASIESLDNGKAINSARGDVQLVINYLKSSAGVADKIDGRLVNTGSNYFNYVKKEPLGVCGQIIPWNFPLLMWAWKIAPALVTGNTVVLKTAESTPLSALYVSKYIPKAGIPPGVINIVSGFGKIVGEALTTHPKIKKIAFTGSTATGKHIYSSAAQTLKKVTLELGGKSPNIVFADADLKKAVQNIILGIYYNSGEVCCAGSRVYVEESIYDEFAQEFKTASEALKVGNPFDESTFQGAQTSQMQLDKILSYVEIGKKEGATLITGGERIGEKGYFIKPTIFGDVTEDMRIVKEEIFGPVVTVTKFKDLDHVVQMANDSEYGLAAGIHTTNINSAVKVADRLKAGTVWVNTYNDFHQNIPFGGFNASGLGREMSKEALDGYLQAKAVRVKLD

SEQ ID NO: 39847 - protein, 151 aa, Zea mays
MKQPTFPSAAAEETKSEQNQTGAKQKSKKFPTATELISHYQKQGGLEAAEASVKVIEDLQNALVRVASSSKNASSKSKLLADARKIDAISGRLAVVDAKLETKPGYVETFALGLASGAALNGISAVWPHVTRGISQVWSAVKSGTDPSAAS

SEQ ID NO: 39848 - protein, 500 aa, Oryza sativa Japonica Group
MAATAAYLPLRAQAQVGLAPLRPSGSAAAGARLPGRTARRRLAARGGPEAAGIRAEAVPGGGGVARRAAMVPPYNVLITGSTKGIGYALAKEFLKAGDNVVICSRSAERVESAVTDLKKEFGEQHVWGIVCDVREGKDVKALVDFARDKMKYIDIWAINMMRNQPRGGHIFNIDGAGSDGRPTPRFAAYGATKRSVVHLTKSLQAELQMNEVNNVMVHNLSPGMVTTDLLMSGATTKQAKFFINILAEPANVVADYLVPNIRAIPTNQSMKPTYIRFLTGLKAYSRIFSRIAFGARRNKIMSNSQPAQEDDCMSSILVSRLIRAMQPTRSYLRWSDDLHKMFVEAVAYHGGPYEAKPTAVKETMQAMGVTSLTTHNIKSHLQKYRESFSSGVGSLHDHDLLRTTSPSKEALDLASEMVRDNDAAMAEIEMLNDLLLDHDIEMVETSFSVDDLQMMERELMSEIKLIEHNFEISESALDEYMDDLANYAFDLTGPANSSSP

SEQ ID NO: 39849 - protein, 586 aa, Bacillus pumilus SAFR-032
MRKTKIVCTIGPASETIEKLTELIEAGMNVARLNFSHGDFEEHGARIENIRKAGKTLGKDIAILLDTKGPEIRTRTVENGSIELVAGADLIVSMEDIVGNTEKISVTYEDLIHDVEVGSTILLDDGLIGLEVKELNMDEKEIVTKVMNTGTLKNKKGVNVPGVSVNLPGITEKDANDILFGIEQGVDFIAASFVRRASDVLEIRELLEKNNAADIQIIPKIENQEGVDNIDEILEVSDGLMVARGDLGVEIPAEEVPLVQKMLIKKCNRLGKPVITATQMLDSMQRNPRPTRAEASDVANAIFDGTDAIMLSGETAAGTYPVEAVQTMHNIASRSEDALNYKAILSRRSEEVDVSITDAIGQSVAHTAMKLDVAAIVTPTESGHTARMISKYRPKAPIVAVTANESVARKLSLVFGVFAKSGSKTTSTDEMLENAVEKSIETGYVRHGDLIVITAGVPVGETGTTNLMKVYVVGDIIAKGQGIGRKSAFGPVVIAQSGKEAEEKMYDGAILVANCTDRDMMSALEKASALITEEGGLTSHAAVVGLSLGIPVIVGLDGATTLLKEGEEITVDPARGAIYKGRASVL

SEQ ID NO: 39850 - protein, 350 aa, Zea mays
MATPRKPIKLTLPSHETTIGKFLTHSGTFTDGDLRVNKDGLRIVSRREGGEAPPIEPLDSQLSLDDLDVIKVIGKGSSGNVQLVRHKFTGQFFALKVIQLNIDESIRKQIAKELKINLSTQCQYVVVFYQCFYFNGAISIVLEYMDGGSLADFLKTVKTIPEAYLAAICTQMLKGLIYLHNEKRVIHRDLKPSNILINHRGEVKISDFGVSAIISSSSSQRDTFIGTRNYMAPERIDGKKHGSMSDIWSLGLVILECATGIFPFPPCESFYELLVAVVDQPPPSAPPDQFSPEFCGFISACLQKDANDRSSAQALLDHPFLSMYDDLHVDLASYFTTAGSPLATFNSRQL

SEQ ID NO: 39851 - protein, 2831 aa, Desulfococcus oleovorans Hxd3
MAKKPAALLTALFVLVFAFSAHAEASSFLDRTVSINWLHFAKSADLFTADAEAQGVLRITNTTPDKSYWGYVVLNGRTYWLNNNDTFVQPVSLKRFNAFFVSLLGAPGTALHIEILPPKPEIISFTIAPNSVVQGSTATLAWATENADTVAIEPGIGPVDPDGSVTVAPDATTTYTLTAANAYGSVSETATVTVLVPPAITIVEPNGLNDIADESFTIQWEDEDPDSDATISLYYDTDNTGADGILIALGLGEDPDGVDDQFTWDISTIMEGDYYIYAVIDDGVTPAVIAYSPGPVTVLHNIPPEITLTSISAFVGDGSYEYVDSRYSNTLLYNWLDITAVGTEILLTGFDDAYSVNLPFEFPFFGDIKSSILISSNGYLTFGNYGTNCNNRPIPEFFDPNDFIAPYWDDIVPDKGGSFHYYYDSGNQIFIVQYTEVLPYADDAPKTFQVILYPNGDILFQYKEMQGNLTSATVGVEDKYGTEGLELAYDKAFIEDNLAILIKRAVSKNAIGWNDEDPDDNAAISLYYDTDNTGADGILIIAGIEEDPDGLTEDQYIWDSSEVAEGTYYVYAVIDDGVNVPVVSYYPEPITIDRSSPRFDELPEQEGMENESLTFTVQAQDPNNDSLTYSASNLPEGAIFNSDTRVFSWTPTSDQTGEYYVEFTVTDGEHTDTMSVRITITLHLPVVSIIASPSTVVPGGSTVLSWSSTYADTCYIEPNIGSVATSGSVTVSPEQITVYTITAVGPGGTTTRSATVSITPPSVSLTANLPVIQYGEEITLTWTSTYAETCTIEPGIGDVPLNGSVTVSPEETTTYTITATGPGGVATRSTTLTVKRPPQVSLNVSQAVINYGESIILTWEAWPAQRAYLNNGIGLVSASGSMTLTPEYTTTYTFTAVNNDQSTCQTISVKVLGHPPEPQPEGTFGGQYNDLIPEDASLESYDPDRFVVATGLVRDMSGIPLPEVAVNVLGHPEYGTVLTDENGRYSIPAEGGGLLKLSFEKQGYLTSHRKIEASVTDILILKTVTLISPDTAETTIFFNGDPSTITVHKSTETLDAELGDRSCTMVFTGEAKAYEVDEFGNQVQELSLITVRASEYATPESMPAILPPNSGYTYCVELEASGFDRVMFDKPVIAYVNNFLGFDVGEIVPSGYYDRGRSAWVPSDNGVVVKLLDTDNDGVVDALDADSDDLPDDLNENGVLEDEVAGLNDPGTYSPGATFWRVPINHFSPWDFNWSFGIPENAISSNAESPPDVDEQKPTVDDCDKDSNSYVNIRSRILHEDIPLPGTGMSLHYASNWVKGASIIIDVPVSGASVPASLKQIIVNMEVAGRMFEQVLAPLPNQAAKFVWDKRDYRGDWVEIPVVAHIHIGFEYGGVYYEAEADYKKAFAQSGADTVTNVPSRQNVILWETHETQITPIPPVDKNVDSQLAEGWTLSSQHSLYMGNIGVLNKGNGEKIERNAVIITTIAGGNGGGYSGDGGPAVDAQLAYPTSVTMDMRGNLYIADSTYEIVGGAISIKDIIRKVDKDGNITTFFEGPIIRSIGNLDIEVAPDGMLYILSRSENQLRRVDLNGIVSIVAGIATSYPPGMKVFAGDGGPAIEARLYHPQGMEIDASGNIYIADTDNHCVRRISPDGIIEAFAGMGVDAGYSGDGGLAVDARLQSPTGLAVDKTGNLFIADSGNFSIRKVDPKGVITTIAGGNGPGYSGDGWPAVDAQLQSISEITLDSSGNLYLTGYDHIRKINQDGIITTIAGGNGSGHSGDGGPAIYAQLGLGLNDIIADPRGNLYILDTSYCGVRKVGPAPVVAGSVGVGEVIFVEENGLGHIMLSNGRHSRTIDTASGVVLKSFTYDTDNRLVSITDQFGNVTTVERSSDGRPTAIISPDGLRTDLSVDPATSHLNRITHPDGGYYDFGYTTGGLMEYEIDPAGNRFDHIFDIEGRLSEVLDEEHGHQYYEQMKYPSGDILTTVTTAEGNVTSYLDRTELSGEYTSIITDAPGGQTTYIRSADGFYAQKDLACGMALDFEYGIDPAYKYKFIKESHEIAPSGISKRNQLDISYEDTDLDEAPDLITRSVTVNGKTTTVQKDVIQSTVTATSPEGRATVSSYDPDTLVTLSTGIAGLYQTNYGYYADGRPKSVMTGTRETSFAYDSYGYLASVTDPRSLTTYFTNDLAGRVTHIARPDGTNLGFEYDANGNMTVLTNPSNVDHLFGYNGVDLKSFYTTPLSGSYSYSYDKDRRLVQKDFPSGQSIYWDYTNPSDATDKSRLWRVITPEGDIDYTYLCGNKVESVSTVTEAIAYGYDGKLVTSETLYGTINKTLSYTYNEDFNVESFTYAGATEGYLYDNDGLLTGAGGFTISRYNDPGVNETGLPYNVTNGAFSLGRTFNGYGETGRESSTVGGYDVYEWNVIDRYADGRIKTKTETIGGVTTTFGYTYDEMGRLETVTKDGSLVESYDHDTIPYGTCTYQMNSLRGIAGRVLDYDAEDHLLSAGGTDYQYDLDGFLTSKTSGTETTYYDYSSRGELLSVDLPDGTDITYVHDPLGRRIAKKVNGTITEKYLWSGLTTLLAVYDGSDNLLMRFVYADGRMPVAVEKGGITYYLAYDQVGSLRAVADAAGNIVKQIDYDSFGFMLNDTYPGFEIPFGFAGGLYDKDTGLVRFGYRDYDPNTGRWTAKDPIGFNGGASDLYGYCLNDPVNMIDGIGLAGFAIDAGGGYGTGWGTNNYSEGGSAGTGLFIGVKPDTGGYAQLGAYTYQSYADEIPGARLGAGFNATYYKGDSADFFKGEMNYTMLTLFIASLTKYSDPCTGKTTGWTVSLGGKGYGLTWFEKGTSKSWSYALQE

SEQ ID NO: 39852 - protein, 681 aa, Brassica oleracea
AIANLTYLQVLDLTSNSFSGEIPSEIGNLTELNQLILYLNYFSGSIPSEIWRLKNIVYLDLRDNLLTGDVPEAICKTISLELVGFENNNLTGTMPECLGDLVHLQIFIAGLNRFSGSIPVSIGTLVNLTDFSLDSNQLTGKISREIGNLSNLQALVLAENLLEGEIPAEIGNCTSLNQLELYSNQLTGAIPAELGNLVQLEALRLYKNKLNSSIPSSLFRLTRLTNLGLSENQLVGPIPEEIGFLTSVKVLTLHSNNLTGEFPQSITNMKNLTVITMGFNLISGELPANLGLLTNLRNLSAHDNLLTGSIPSSISNCTSLKLLDLSHNQMTGEIPRGLGRMNLTFLSLGPNRFAGDIPDDIFNCSYMETLNLARNNLTGTLKPFIGKLQKLRILQLFSNSLTGPIPREIGNLRELSLLQLNTNHFTGRIPSEISNLPLLQGLQLDTNDLEGPIPEEIFGMKQLSELYLSNNKFSGPIPILLANLESLTYLGLHGNKFSGSIPASLKTLSHLNTLDISDNLLTGTIPEELISSMRNLQLTLNFSNNLLSGTIPNELGKLEMVQEIDFSNNLFSGSIPRSLPACKNMLFLDFSRNNLSGQIPDEVFQQGGMDMIKSLNLSRNSLSGGIPQSFGNMTHLVSLDLSYNNLTGEIPESLANISTLKHLKLASNHLKGHVPESESGV

SEQ ID NO: 39853 - protein, 403 aa, Vibrio parahaemolyticus RIMD 2210633
MFDVNAVREQFPALNQDVNQSPLVYLDSAATTQKPQCVIDVISRYYSAQNANVHRGSHSLTANATSQFEAAREAVATFIGANSSKEIIWTRGATEALNLIAQTYARSTLQPGDEILISEMEHHANIVPWQIVAEQTGAKIVKVPMTPECQFDLQAFEQKLSERCKIVACAQITNVTGTRQPIEKITELAHSVGAVVVVDGAQGIVHEQLDLSASDIDFYVFSGHKLYAPAGIGVLYGKLELLEAMPPWHGGGKMVERVSFEKTTFSALPGKFEAGTPNVAGAIALAKAIEWYQGFDHHEVEDHLHALQDKAYQALNALDDIHILGYQPNASVLTFVMDGVHHQDMATLLDQQGIAVRAGHHCAHPLMDALNVKGTVRVSFGIYNTAEDVDRLIAAVEKAVDML

SEQ ID NO: 39854 - protein, 679 aa, Brassica oleracea
AIANLTYLQVLDLTSNSFSGEIPSEIGNLTELNQLILYLNYFSGSIPSEIWRLKNIVYLDLRDNLLTGDVPEAICKTISLELVGFENNNLTGTIPECLGDLVHLQIFIAGLNRFSGSIPISIGNLVNLTDFSLDSNQLTGKIPREIGNLSNLQALVLAENLLEGEIPAEIGNCTSLNQLELYGNQLTGPIPAELGNLVQLEALRLYTNKLNSSIPSSLFRLTRLTNLGLSENQLVGPIPEEIGFLTSVKVLTLHSNNLTGEFPQSITNMKNLTVITMGFNSISGELPANLGLLTNLRNLSAHDNLLTGSIPSSISNCTSLKVLDLSYNQMTGKIPRGLGRMNLTLLSLGPNRFTGDIPDDIFNCSDLGILNLAQNNFTGTIKPFIGKLQKLRILQLSSNSLTGSIPREIGNLRELSLLQLHTNHFTGRIPREISSLTLLQGLELGRNYLQGPIPEEIFGMKQLSELYLSNNNFSGPIPVLFSKLESLTYLGLRGNKFNGSIPASLKSLSHLNTLDISDNLLTGTIPSELISSMRNLQLTLNFSNNLLSGTIPNELGKLEMVQEIDFSNNLFSGSIPRSLQACKNVYYLDFSRNNLSGQIPDEVFQQGGMDMIKSLNLSRNSLSGGIPQSFGNITHLFSLDLSYNNLTGEIPESLTNISTLKHLKLASNHLKGHVPESGV

SEQ ID NO: 39855 - protein, 528 aa, Xanthomonas axonopodis pv. citri str. 306
MTTHAATTQGKFHKRLSLTDLTFIGLGSIFGSGWLFSASHVSSIAGPAGIVSWILGGIAVLLLGLVYCELGAALPRAGGVVRYPEYSHGALLGSLTGFITLIAFSSLIAIEVEAARQYAAAWFPWLSQPNSTHPSVVGWLVQLALLVLFFVLNYFSVKTFALANNIVSIFKFLVPILVIVLLMQHFDAGNLSVHGFAPSGMAGVEAAISAGGIIFAYLGLTPIVSVASEVRDLQRNIPIALILSVALSTAIYVLLQLAFLGSIPAAQLAQGWAGIDKAFSLPYHDIALALGMAWLAALVICDAMVSPSGTGNIYMNATPRVVYGWARSGGFLPVLTRVDPASGIPRPALWLSLGLSIFWTLPFPSWETLIGVVSAALVLSYAVAPITVAALRRSAPDLPRPFFVRGLPVFGPLSFMVAALIVYWSTWPTLSWLLGLQVLAFVLYVLLRLPSRQGRARLVRQVRASLWLIVFFVLVMLVSWAGTFGGHGWIAHPFDTLGVAVIALCIYHWGARSGLRSDELALEEDDGE

SEQ ID NO: 39856 - protein, 158 aa, Desulfitobacterium hafniense Y51
MLRVGIGYDVHALVAGRPLILAGIDIPHEKGLLGHSDADVLTHTLMDALLGALALGDLGKHFPDTDERYRGISSMKLLEQVMKLLEERGYAIGNIDCIIAAQRPKLAPYIPQMRENLARALKTDLENVSVKATTTERLGFEGREEGISSQAIVCLVKV

SEQ ID NO: 39857 - protein, 259 aa, Vitis vinifera
MSKSRVKKSVKEGPSQSPIQSFLVTVGLMIKTLKKLKTSYRDPSHHHNRSSKTSPPFATTHRPSLPLSLYPPESTHLESLPMAEIIPKETALQALNTIIQLHFEKTLEKKRAVDLQKKELWKLFQLFFIFLSLVFLAQTQSPRLQCRHCWVPIILLSFTHLIFYVSVAQTLRCINGFKYQRRCHKLTLGLATERLRQIKMRASSGNDEGDVVGDDFEIHYQEPPEAYFGKFKRNWALHFGFLILMYGFMVASSVVILCY

SEQ ID NO: 39858 - protein, 450 aa, Vitis vinifera
MYQQFSSPADRRLSALARHLEGSSPSSTMDPNHTISASATSGSDFGGSVFDHVVQAPEDPILGVTVAYNKDPSPVKLNLGVGAYRTEEGKPLVLNVVRRAEQLLVNDRSRVKEYLPIVGLAEFNKLSAKLMFGADSPAIQVKRVTTVQCLSGTGSLRVGAEFLARHHHQRTIYIPQPTWGNHGKIFTLAGLSVKTYRYYDPATRGLNFQGLLEDLSLAPSGAIVLLHACAHNPTGVDPTLQQWEQIRQLIRLKGLLPFFDSAYQGFASGSLDADAQSVRMFVADGGECLAAQSYAKNMGLYGERVGALSIVCKTADVASRVESQVKLVIRPMFSNPPIHGASIVAIILKNRDMYNEWTVELKAMADRIISMRQQLFDALRARGTPGDWNHILKQIGMFTFTGLNTAQVAFMTKEYHVYMTSDGRISMAGLSSKTVPHLADAIHAAVTRAI

SEQ ID NO: 39859 - protein, 223 aa, Desulfitobacterium hafniense Y51
MVFGQIKQDIKVIFERDPAAKTIVEVILCYPGLHALIAHRLAHCLYKKNMVLIPRLISQTSRFFTGIEIHPGAKIGQGLFIDHGMGVVIGETAEVGDNVTIYQGVTLGGTGKEKGKRHPTVGNNVFIGSGAKILGSIKIGDNVKIGAGSVVTKPVPSNTTVVGVPGKVVSRHGMPLKELHVVTKSVCNKEIRAEEMPDPVQETLQILMERINYLEKKLGEKES

SEQ ID NO: 39860 - protein, 681 aa, Brassica rapa
AIANLTYLQVLDLTSNSFSGEIPSEIGNLTELNQLILYLNYFSGSIPSEIWRLKNIVYLDLRDNLLTGDVPEAICKTISLELVGFENNNLTGTMPECLGDLVHLQIFIAGLNRFSGSIPVSIGTLVNLTDFSLDSNQLTGKIPREIGNLSNLQALVLAENLLEGEIPAEIGNCTSLNQLELYSNQLTGAIPAELGNLVQLEALRLYKNKLNSSIPSSLFRLTRLTNLGLSENQLVGPIPEEIGFLTSVKVLTLHSNNLTGEFPQSITNMKNLTVITMGFNLISGELPANLGLLTNLRNLSAHDNLLTGSIPSSISNCTSLKLLDLSHNQMTGEIPRGLGRMNLTFLSLGPNRFAGDIPDDIFNCSYMETLNLARNNLTGTLKPFIGKLQKLRILQLFSNSLTGPIPREIGNLRELSLLQLNTNHFTGRIPSEISNLPLLQGLQLDTNDLEGPIPEEIFGMKQLSELYLSNNKFSGPIPILLANLESLTYLGLHGNKFSGSIPASLKTLSHLNTLDISDNLLTGTIPEELISSMRNLQLTLNFSNNLLSGTIPNELGKLEMVQEIDFSNNLFSGSIPRSLPACKNMLFLDFSRNNLSGQIPDEVFQQGGMDMIKSLNLSRNSLSGGIPQSFGNMTHLVSLDLSYNNLTGEIPESLANISTLKHLKLASNHLKGHVPESESGV

SEQ ID NO: 39861 - protein, 679 aa, Brassica rapa
AIANLTYLQVLDLTSNSFSGEIPSEIGNLTELNQLILYLNYFSGSIPSEIWRLKNIVYLDLRDNLLTGDVPEAICKTISLELVGFENNNLTGTIPECLGDLVHLQIFIAGLNRFSGSIPISIGNLVNLTDFSLDSNQLTGKIPREIGNLSNLQALVLAENLLEGEIPAEIGNCTNLNQLELYGNQLTGGIPAELGNLVQLEALRLYTNKLNSSIPSSLFRLTRLTNLGLSENQLVGPIPEEIGFLTSVKVLTLHSNNLTGEFPQSITNMKNLTVITMGFNSISGELPANLGILTNLRNLSAHDNLLTGSIPSSISNCTSLKVLDLSYNQMTGKIPRGLGRMNLTLLSLGPNRFTGEIPDDIFNCSDLGILNLAQNNFTGAIKPFIGKLQKLRILQLSSNSLAGSIPREIGNLRELSLLQLHTNHFTGRIPREISSLTLLQGLELGRNYLQGPIPEEIFGMKQLSELYLSNNNFSGPIPVLFSKLESLTYLGLRGNKFNGSIPASLKSLSHLNTLDISDNLLTGTIPSELISSMRNLQLTLNFSNNLLSGTIPNELGKLEMVQEIDFSNNLFSGSIPRSLQACKNVYYLDFSRNNLSGQIPDEVFQQGGMDMIKSLNLSRNSLSGGIPQSFGNMTHLVSLDLSYNNLTGEIPESLANLSTLKHLKLASNHLKGHVPESGV

SEQ ID NO: 39862 - protein, 239 aa, Triticum aestivum
MKLNVSYPNNGTQKLIEIEDERKLRVFMDRRMGHEVPGDSVGDEFKGYVLRITGGNDKQGFPMKQGVMHPTRVRLLLADGHSCYRPRRTGERKRKSVRGCIVGMDLSVLALSIVKKGDNDIPGLTDVVHPKRLGPKRATKIRRFFGLSKEDDVRKFVIRREVTGKKEGAKPYTKAPKIQRLVTPQRLQHKRHRIALKRRRAEASKDAANEYAQILQKRLGQAKAAHDEARKRRASSMTH

SEQ ID NO: 39863 - protein, 679 aa, Brassica rapa
  misc_feature (87)..(87): Xaa can be any naturally occurring amino acid
AIANLTYLQVLDLTSNSFSGEIPSEIGNLTELNQLILYLNYFSGSIPSEIWRLKNIVYLDLRDNLLTGDVPEAICKTISLELVGFEXNNLTGTIPECLGDLVHLQIFIAGLNRFSGSIPISIGNLVNLTDFSLDSNQLTGKIPREIGNLSNLQALVLAENLLEGEIPAEIGNCTSLNQLELYGNLLTGPIPAELGNLVQLEALRLYTNKLNSSIPSSLFRLTRLTNLGLSENQLVGPIPEEIGFLTSVKVLTLHSNNLTGEFPQSITNMKNLTVITMGFNSISGELPANLGLLTNLRNLSAHDNLLTGSIPSSISNCTSLKVLDLSYNQMTGKIPRGLGRMNLTLLSLGPNRFTGDIPDDIFNCSDLGILNLAQNNFTGTIKPFIGKLQKLRILQLSSNSLTGSIPREIGNLRELSLLQLHTNHFTGRIPREISSLTLLQGLELGRNSLQGPIPEEIFGMKQLSELYLSNNNFSGPIPVLFSKLESLTYLGLRGNKFNGSIPASLKSLSHLNTLDISDNLLTGTIPSELISSMRNLQLTLNFSNNLLSGTIPNELGKLEMVQEIDFSNNLFSGSIPRSLQACKNVYYLDFSRNNLSGQIPDEVFQQGGMDMIKSLNLSRNSLSGGIPQSFGNMTHLVSLDLSSNNLTGEIPEGLANLSTLKHLKLASNHLKGHVPESGV

SEQ ID NO: 39864 - protein, 176 aa, Rhizobium leguminosarum bv. viciae 3841
MPVYALGGLTPKLPAAGLYWIAPDANIIGQIELGENVGIWFGAVLRGDNEKITVGEGTNIQEGVMAHTDMGFPLTTGKDCTIGHHAILHGCTIGDNTLIGMGATILNGAKIGNNCLVGANALVTEGKEFPDNSLIVGAPARGVRTLDEAAIEAIRRSAENYVANWQRFARDLKQIG

SEQ ID NO: 39865 - protein, 475 aa, Fusobacterium nucleatum subsp. vincentii ATCC 49256
MSSLKKTKIVCTIGPVTESVETLKELLNRGMNVMRLNFSHGDYEEHGIRIKNFRQAMSETGIRGGLLLDTKGPEIRTMTLKDGKDVSIKAGQKFTFTTDQSVVGDNERVAVTYENFAKDLKVGNMVLVDDGLLELDVTEIKGNEVICVARNSGDLGQKKGINLPNVSVNLPALSEKDIEDLKFGCQNNVDFVAASFIRKADDVRQVRKVLKENGGERIQIISKIESQEGLDNFDEILAESDGIMVARGDLGVEIPVEEVPCAQKMMIKKCNRAGKVVITATQMLDSMIKNPRPTRAEANDVANAIFDGTDAIMLSGETAKGKYPLAAVEVMNKIAKKVDATIPAFYVDGVINKHDITSAVAEGSADISGRLNAKLIVVGTESGRAARDMRRYFPKANILAITNNEKTANQLVLSRGVISYVDASPKTLEEFFILAEVIAKKLNLVENNDIIIATCGESVFIQGTTNSIKVIQVKA

SEQ ID NO: 39866 - protein, 434 aa, Fusobacterium nucleatum subsp. vincentii ATCC 49256
MTGIVDVIGREILDSRGNPTVEVDVILECGVKGRAAVPSGASTGSHEAVELRDEDKTRYLGKGVLKAVNNVNTEIREALLGMDALNQVEIDRVMLELDGTANKGRLGANAILGVSLAVSKAAAEALGLPLYKYLGGVNAKELPLPMMNILNGGAHADSAVDLQEFMIQPVGAKSFREAMQMGAEVFHHLGKILKANGDSTNVGNEGGYAPSKIQGTEGALSLISEAVKAAGYELGKDITFALDAASSEFCEKVNGEYQYHFKREGGIIRNTDAMIKWYEELINKYPIVSIEDGLGEDDWDGWVKLTKAIGDRVQIVGDDLFVTNTERLKKGIELGAGNSILIKLNQIGSLTETLDAIEMAKRAGYTAVVSHRSGETEDATIADVAVATNAGQIKTGSTSRTDRMAKYNQLLRIEEELGSVAQYKGRDVFYNIKK

SEQ ID NO: 39867 - protein, 101 aa, Oryza sativa
DPRAAGIRHEGISRKALTKYQLIFRLLFHCEHVSRQLCTAWQIQQGFRSVKILGTPVLRSSILCRSMLKFVNSLLHYLTLEVLEPNWHLMHDRLQTARSIA

SEQ ID NO: 39868 - protein, 404 aa, Vibrio angustum S14
MQKFGMSSKLNNVCYDIRGPVLKHAKRMEEEGQKILKLNIGNPAPFGFDAPDEILVDVIRNLPTSQGYCDSKGIYSARKAVVQHYQKRGLLDLDVEDVYIGNGVSELIVMAMQALLNHKDEILVPSPDYPLWTAAVSLSGGTPVHYTCDEQSDWYPDLDDIKKKITPNTRGIVLINPNNPTGAVYSRDFLIEVVEIARQHDLIIFADEIYDKILYDGAQHTSIAPLAEDVVCVTFNGLSKSYRVCGFRAGWMIISGPRHRAKGYIEGLEMLSSMRLCANVPMQHAIQTALGGYQSINELILPGGRLLEQRNKAYDLLTQIPGVSCVKPKGALYLFPKLDQKKFNIQDDQKMAMDFLLQEKVLVVHGTGFNWKQPDHFRIVTLPHVDDLELAMGRLERFLHSYRQ

SEQ ID NO: 39869 - protein, 445 aa, Azoarcus sp. BH72
MTHFDYLVIGGGSGGVATARRAAEYGARVLLIESARLGGTCVNAGCVPKKLMWHAAGIGHALHDAAAFGFRVDGLRFDWAALKRGRDDFVAYLNGVYASLLDKAGVSVVRGHARFVDAHTVEVGGQRYSAPHIVIATGGEPRVPDSPGAALGITSDGFFALDHLPARTIVVGGGYIAVELAGVLAALGSEVTMLVRGEHLLRPFDAMVRDELALQMRDAGIRIVTGSEAGAVRRADDGALRAACGSAEFEGDTLIWAIGRQARTAGLNLAAAGLGTEKDGSIATDAWQDTAVPGIHAIGDVTGRVELTPVAIAAGRRLAARLFGGQPEARLDYENVPSVVFSHPPIGTVGLTEEAARARHADVRVYHTRFTAMYHALKTQRPKTAMKLVCAGPQEQVVGCHIIGEGADEMLQGFAVAIRMGATKADFDDTVAIHPTSAEELVTMR

SEQ ID NO: 39870 - protein, 170 aa, Synechococcus elongatus PCC 6301
MDLSRIPAQPKPGLVNVLIEIPGGSKNKYEFDKDLNAFALDRVLYSSVQYPYDYGFIPNTLADDGDPLDGMVILDQPTFPGCVIAARPIGMLEMIDGGDRDEKLLCVPAKDPRYAEVKTLSDLAPHRLEEIAEFFRSYKNLEKKVTEILGWKGPETVQALVDECIKAYNA

SEQ ID NO: 39871 - protein, 330 aa, Oryza sativa Japonica Group
MELWKTGSGLLPLQPRTPVGATRPASLARPTSDWGAADRWRRRGGGRRRGGGGQVAAAAVVAVEVEVEAPWCGARGGACCCGPRSRRLCSSGFSRACRDVFRGPGTVPAPDDVALIRGILDKIGPGDVNLSAEHNFFKATDAAALPHPLAITRTTIYTCTNFSIVIFFLPPTAVIPLHNHPGMTVFSKLLLGSLHIKSYDWAEPAVFAAGSGDRLRLAEVVRDGGFSAPSDTLVLYPAAGGNMHQFTAATPCALLDVLGPPYSEDRDCTYYQDFPYSHCPSDDIAELRRHGGGMDDEQISRMRQLGWLKETAMPKDLEMYEMPYRGPPIL

SEQ ID NO: 39872 - protein, 483 aa, Rickettsia conorii str. Malish 7
MAEFTPITIAYGDGIGPEIMEAVLYILRKAEARIRLETIEVGEKLYKKHYTSGISEESWESIQRTGIILKAPITTPQGGGYKSLNVTIRKTLQLFANIRPAVSLHPFTRTLHPNLNLTIIRENEEDLYAGIEYRQTHNMYESMKLISHTGCEKIIRYAFEYAVKNNRKKVMCLSKDNIMKFSDGVLHKVFNEIAKEYPQINNAHYIIDIGTARLATKPEIFDVIVTSNLYGDIISDVAAEISGSVGLAGSANIGQHYAMFEAVHGSAPDIAGKDIANPSGLLNAAIMMLVHIGQGDIATLIENAWKKTIEDGVHTADIYNEQSSSKKVGTKEFAEEVTKRLGQLPTKLPKADYPLIAEKQESNIDYKIDTKEVKKLVGTDIFVNMNVSSAHDIADKINKLDLGNFELKTISSKGLKLWPRDTRFETVSDHWCCRFMNKDGTEIKHLDITRLLEALSTANIDFIKVENLFEFDGVAGYSLAQGE

SEQ ID NO: 39873 - protein, 503 aa, Mycoplasma gallisepticum R
MKKALLMILDGYGISSTTHGNAVKNAKTPHLDNLMNNNPTIMLQASGEAVGLPKNQIGNSEVGHLNIGAGRIIYTGLSLINKEIENKKFFTNQALLNAIDHAKKNNSKLHILGLVSNGGVHSHINHIYAIMELANQHNVPAILHIFGDGRDVPPTQLLADLDQLIKKAETTKTKIGTISGRFYAMDRDQRWDRIDLAYNNLLSNTGKSFADLKTYVKDSYQQNITDEFIVPAYNNNYKSDEITIQDNDSVVFANFRPDRARQLSHYVFGSNYYDHHPQLRRKNLYFVIMMQYEGINPSAICYPPKIEKNTLGEVLKNANKKQLRIAETEKYAHVTFFFDGGVEVEYQNEDKVLVPSRKDVKTYDLAPEMSAAAIVDQLLKVYTKYDLTVLNFANPDMVGHTGNYEATLKGLEALDHEIGRLLADAKKNNITVFFTADHGNAEEMIDENNQKVTKHTTNVVPFSITDPNVKFTKKEGILANVAPTILKYLEIQIPEEMDQEPLI

SEQ ID NO: 39874 - protein, 171 aa, Oryza sativa Indica Group
MLRAGGRRLLAPGLRRVLGGGAAAPVAVGGARAYHERVVDHYENPRNVGSFENDDPSVGTGLVGAPACGDVMKLQIRVDESSGKIVDACFKTFGCGSAIASSSVATEWVKGKQMEEVVTIKNTEIAKHLSLPPVKLHCSMLAEDAIKAAVKDYEAKKAKLAQKGEEKAAEA

SEQ ID NO: 39875 - protein, 503 aa, Coprinopsis cinerea okayama7#130
MSSPLTLLVLVLQQDNIEDELKPSFTPGKSILAVYCRSDGYKPGAPPKSAEEYAKLDAEDESLARWKASLGIVPGATSGDTSGPKVTVLTLELVSPTLPPGKKIAFNLADPNAIASLKKTPVVIKEGVEYKSVKPSAAGGQRMLISACSVRITFKVNHSIISGVRYIQVVKRSGIKVDKLEQMLGSYGPNPTGEPYTKNFEPEESPSGMIARSGSYSVRSRVVDDDGEVYAVPTSQLGLLRGSLASRYSCRATPHVLRRPWPTTSVYKAFGVVRLSSTTSTGIEPVKKTWIDSLPPKKNPSPAWSIAMASYALHLPPSVPLTYISLCGIGALVMRGAGCTINDMWDKNLDKSVGLAFNWGALLGWSAVAGTVDWAVCLPLYAGGVCWTLVYDSIYAHQDKLDDVHAGIKSTALLFADKTRSILTGLSLSSMSLVSYAGYLNHQTEPFYAGVALGLAQLGRILYRTDFEDRKSCWEGFASSGWVGFWIWAGAMADYGLSLVALG

SEQ ID NO: 39876 - protein, 252 aa, Mycoplasma gallisepticum R
MNSMKRYIFGNWKTYKTTQEVKEFFSVLNQTKLTKNPDVVFGVAPVFVHLGLANQLERNECLVLAQDANYVMNKANTGTVSYEQLKDIGVNYVIIGHSERRKLFHESDELINQKVKTLLENKMRPILCIGETLEEYEANKTKAVLKDQLEKDLKGIDSSLLKDLIIAYEPVWAIGTGKTASSQTAQDAIAYIRTVLGLLSSKTIANELPILYGGSVTPDNVSELLAQKDINGALVGGASLDPHKFIQLIEAK

SEQ ID NO: 39877 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCNDATQVYKELQEAIKSYPDAFHRVIGFDNIKQTQCVSFIAYKPPGSD

SEQ ID NO: 39878 - protein, 510 aa, Synechococcus elongatus PCC 6301
MALMTLRNVSKDYGLKVLLQSASFSVGDRDRIGLIGRNGSGKSTLLRILAGLETADSGDIQRQSGLRSVYVPQDPQLDPERTVLEQVFADAGEQLQLVRDYEAISEQLATAEGEAAEALMARLTSLSQQLDAQDAWGLETQAKIVLSRLGIHNFQQRVGDLSGGYRKRLGLASALLADPELLLLDEPTNHLDADSVEWLQSFLSKFRGALVLITHDRYFLDRVTNRILDLDRGELSAYDGNYAYYLQKKAEQEASAASSAHKFQGVLRRELAWLQRGPKARSTKQKARIQRIEEMRSQEVRGAAGRVEIAAASQRLGKTVVRLENVSKSFGDRQLIQDFSYEVSPEERLGIIGPNGVGKSTLLNLMTGQLSPDQGKVVQGSTVCFGYVDQQAEGLELAAQKQQRPIDYLREEGEYLPLGNGEKLSASQLLERFLFPPAQQYAPIASLSGGERRRLYLLRILMTAPNVLILDEPTNDLDIQTLAVLEDYLEDFPGDSHYYFPRSLLPRSHS

SEQ ID NO: 39879 - protein, 306 aa, Yarrowia lipolytica CLIB122
MLSVQNRTQEFKSAVAAQARLRQNAVPAPQTRSAKSQFAQDASKIAAEIADTTQMLQRLAQLAQRKTLFDDRPVEINELTHVIKQKVSRVNEQLTQLQQRAKQSTGQKQTMEHSKNVVVLLQEKLSTVTAGFADVLEERTRNIQASKSRHEQFISATSASTQQAASSPLYGSGTASSNPYDMQMQQQDQLSGADPETSDLLTLPQQDTLLLDQQDMYVQQRSTAVEAIESTIQELGGMFSQLATMVAEQRETVARIDQNTDDISLNVSGAQRELMKYYARISSNRWLMVKVFGIVIAFFMLWVLIS

SEQ ID NO: 39880 - protein, 574 aa, Synechococcus elongatus PCC 6301
MLLGQSQLRWLPGLRSLLHYRRAWLRGDVLAGVTVAAYLIPQCMAYGQLAGLPAIVGLWAILIPLFLYTFFGSSPQLSVGPESSTAIMTAVAIAPVAAQTDLSYSLLAAVMALLVGIVFLVAYSLRLGFLADLLSKPILIGYMAGIGLVMISGQLGKTSGIPITATKPLEEFQQFFAGLGQCHWPTVGVSILVLLFLFGVQKKFRTAPGPLLAVLLATLFVALFQLDQQGVQVIGTIPAGLPRWQWPTLPWQQWPTLTASAIGVALVGYSDNILTARAFAVRHRYEIDANQELLALGIANVGNSFFQCFPISGSTSRTVIGDALGSRTQLFSLVSLGTVLLVLWFFRPVLAMFPQAALGAIVIYAATKLIDLREFYRLRRYRPSEFWLALITAAGVLGTNMLIGVGVAVSLSVIDLFARVARPHAAILGEIPGMAGLHDIEDWPQAQTFPGLVIFRYDAQLCFANAEDFKRRVLLAIATAPQPVQWLLLNAEAIINLDVTAAEKLLELLRELQQRGVTLTIARAKQELIAELDRVGLVEQIGGEHFYPTLPTAIAAFQQFRQSQIADEPPLTAS

SEQ ID NO: 39881 - protein, 410 aa, Bacillus pumilus SAFR-032
MSLREEALHMHKENQGKLESKSKVQVKNAKDLSLAYSPGVAEPCKDIYDDTSKVYDYTMKGNMVAVVTDGSAVLGLGNIGAEASLPVMEGKAVLFKSFAGVDAFPIALATNDVDKIVETVKLLEPTFGGVNLEDIAAPNCFIIEERLKKETNIPVFHDDQHGTAIVTVAGLVNALKLSGKSMSSIKVVANGAGAAGIAIIKLLYHFGVRDIIMCDTKGAIYEGRPNGMNAVKNEVAKFTNQDRKEGSLEEVIEGADVFIGVSVAGALTKEMVGKMAKDPVIFAMANPNPEIMPEDAHAAGASVVGTGRSDFPNQVNNVLAFPGIFRGALDVRATHINEEMKIAAVEAIASLVSDDKLSAEYVIPEPFDARVAPAVAKAVAKAAMETGVARIKVDPEEVAEKTRKLTIIGE

SEQ ID NO: 39882 - protein, 114 aa, Solanum chacoense
MGVPSYLIVCVLVGAFFISMAAAGDNGSYDWMVPARSGECKGSIAECMAEEDEFALDSESNRRILATKKYISYGALQKNSVPCSRRGASYYNCKPGAQANPYTRGCSAITRCRS

SEQ ID NO: 39883 - protein, 59 aa, Brassica napus
VGGSMIGVRLGLAEHIQDANAIFSLVLDDEDVNSIKEATKKGKNLLQVIGDCGDEYRRV

SEQ ID NO: 39884 - protein, 553 aa, Oryza sativa Indica Group
MARKMLKDEEVEVAVTDGGSYDYDLFVIGAGSGGVRGSRTSASFGAKVAICELPFHPISSDWQGGHGGTCVIRGCVPKKILVYGSSFRGEFEDAKNFGWEINGDINFNWKKLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKERRSLQMLFCLLQVDDYSRTSVPNIWAVGDVTNRINLTPVALMEATCFSKLCLVASQLNLITEMYLVLFSRRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 39885 - protein, 123 aa, Solanum chacoense
MESPILFFLIIFLFTITNNAIVIEAQVDKFGLEQLVSEDFELPMAMSSLYEETEDDEMQLDGNGRSLLWHKFKYYISYGALSANRIPCPPRSGRSYYTHHCYHATGPAHPYTRGCSAITRCRR

SEQ ID NO: 39886 - protein, 255 aa, Dehalococcoides ethenogenes 195
MSSVNVSVKDPGFESEEAQARKRYMLQLFGFQAKHYDLHDDIIGMGIHRRWGKEMVLEILTYTRNMPQVKMLDLACGTGFVTFNTLRYMNNVDIDAFDITPEMVEVAKGRLKKNYPDRNVKFWVGDAEVPYGDAKYDVIGTCFAFRNFANKNLAASNIFKALKPGGLLVLQDMTKPEKQPFRGIYLFALKNLMPIMARIIGTERKSARYLANSVLAMPSNAEIMSILQNQGFINIKSRYQSGGMGTLTVAYKPEN

SEQ ID NO: 39887 - protein, 453 aa, Pseudomonas putida KT2440
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPDFPTWATAAIFFVVINLINLTQVKVYGEMEFWFALVKVVAIVSMIGFGAWLLGSGHGGPDASVANLWQYGGFFPNGVTGLVMALAVIMFSFGGLELVGITAAEADNPRESIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALAVSAFATGLCVLINYLMPGGAFGLLMALAVSALVINWASISITHLKFRKAKLAAGITPFYKSLGHPLTNYLCLAFIVLILVVMYLTPPIRISVMLIPAWIAVLWVAFKLKKARQAKG

SEQ ID NO: 39888 - protein, 269 aa, Vibrio parahaemolyticus RIMD 2210633
MRELDTPASDSYNQRFGGTRRLYGNSEVDILRAAHVCVIGIGGVGSWAVEALARTGIGELTLIDMDDVCVTNINRQIHAMTGTVGQSKIEVMAERVKLINPECKVNLIDDFITPDNQHEYLSKEFDYVLDAIDSVKAKASLLAYCRSNKIKVITTGGAGGQVDPTQIMVADLTKTIQDPLAKKIKDTLRRHHNFPKNPARKFGIDCVFSTEQLKYPQADGSVCGVKSTAEGPKRMDCASGFGAATVVTASFGFVAVSRIVEKLIQKHKK

SEQ ID NO: 39889 - protein, 938 aa, Prochlorococcus marinus str. MIT 9303
MHVLDRDILLPSYDVLVVGAGIGGLTAAALLAKRGYRVLVVEQHYLPGGCASIFRRQGFTFDVGASLFFGFGEKGYNPHQFVMNELEEDITLVPMDETFTIHLDQKTKVSMYTQRERFWEEMCSCFPHQSEQIKALLREFESFYHDSLDSYGGQFFAPAETPPQHGINLMLTRPFYLARLLNYLLSTQEQLFRRFTRDPQILKLFTLLNQNMTTCGLDQTPAIAGPMIHVESYTGGCYYAQGSPQILANKLEKAIHKYGGQILYRNRIDKILIEKGKAIGCQLENGLKIKAHTVISNTTIWNLYGKLIDPQHISRRKRKWAKKFRPIYSVFGVYLGVKAEAVPPAIKPTQILPYDDKGSSSYLTVYVTSMLDPDASPPGTHTLCIFLPESTPEITVPTDGKDKYHSRTYRDQKQKKASAIIDYLEKNYFPELKKHILVQEIATPQTIQRYTLKSHGSIGGPQVNMSQSYMSRLAARSDWQGLYCVGDSTSQGIGVVSVTVSAISAVNAILKDLRQPQYLPLKHYPQNYVHFAKASLSQEQHSAYLFPDSQIIQTVELEPRACLSPRCVRAGPDSTHQAHIARLVEAGNWLGAAQSLRAVNPLSEITSYLSQSDDFCGPSCSQLLCPDASIPIKSLNRYVCEKVPNYIPDVAPDNGKRISIVGAGPAGLTCAHYLARLGYQIDIYEKQSESGGILKRITLASRIPQSVLHREISNLLLPSIRIYFDQSLGEDITIAELRLQYDAIFLACGLGEKQIQPKDIDQDFNLIHGLKFLDQFTQEPAIVREKILTIVGATYLATDISKLAIQNGAKKVCLIDELSELQSKSQAKRLTEMQELGIEIHSRIDPIAFSELCSSSHQVIMAGLEQQRIQSELRDHLSTSLVVDIDDWVDLETLQVHGQVNVFAGGDIIRGSSSMQESIRDGRKAAVEINHALMKNQS

SEQ ID NO: 39890 - protein, 328 aa, Zea mays
MAGDWQELGQAAAIGLLFAFLVAKLISTVIAFKEDNLRITRSPPTSPTAAAAAAAPPVPSHYGSTDGGSGSDSDWEGVESTELDEEFSAASAFIAASAASGTSVPEEAQLRLYGLYKIATEGPCTAPQPSALKLKARAKWNAWHKLGAMPTEEAMQGYITIVQDLFPNWDAGASAKRKDEDSIASASASKGPMGPVFSSLMYEEDEGNESELGDIHVSAREGATDDIVKLLAAGVEVNVRDTEGRSPLHWAVDRGHLSAVEVLANANADLNAKDNEGQTALHYAAVCEREDIAELLVKHHADLRIKDEDGNTAHDLCPSSWSFMNQAN

SEQ ID NO: 39891 - protein, 399 aa, Xylella fastidiosa Ann-1
MFELSCNLISGGGIGVPGSQSETPPVTEPAILVLEDGTVFEGDAVGANGLSVGEVVFNTALTGYQEILTDPSYAYQLVTLTYPHIGNTGCTDQDDEANKVWAAGLIVRDVPRRPSNWRSQISLSDWLAARGVVAIAGIDTRKLTRILREKGAQHGALMAGEIDVGKAQDAACQFAGIKGMDLAKVVSTKQGYSWYEGQLDLDRNECKRAAPQYKVVAYDYGVKLNILRMLAERGCDLTVVPAQTPADEVLALCPDGVFLSNGPGDPEPCDYAVAAIKTFIMRRIPIFGICLGHQLLAQAVGARVVKMSHGHHGANHPVQDLRSGRVMITSQNHGFAVDEATLPNNVRVTHRSLFDGTNQGIELLDVPAFSFQGHPEASPGPHDVDVLFDRFITMMAAQS

SEQ ID NO: 39892 - protein, 475 aa, Vitis vinifera
MGTASFDEETVKKVIRQVEFYFSDSNLPRDNFLKKTISESEDGLVSLALICSFSRMRSHLNLGDVKPEDVSEDTLKAVAEILRNSTTLKVSEDGKKIGRATELLKPEEVVEQVDIRTIAASPLEYDAKLEDVEAYFGQFAKVNSVRLPRHVAEKRVFCGTALIEYSTEEDAAKVLQQSLVYAGVELELKPKKDFDAERAQQTEEFENSRALLGSNRKNNSNAESTYPKGLIVSFTLKRAGGSTEHNGTHEPVNDNADVGKTNTDIDSKENVTGETEDKASENINNDEENSGEDIEKESEEKVEEKTSLESEGKETEDGQKSSEGCDLKGEEKATGEQKPTAATYKDNMDVVMREDLKSVFQKFGTVKFVDFKIGEESGYIRYDEPEAAQKVRAAAVLSEEGGLTVKNYIANLEPVTGEAEREYWSLLRGNQEKHRGFKGNRGRGGKQNRGGKFGRPRDNDYATGRPNKTQKVGAA

SEQ ID NO: 39893 - protein, 328 aa, Agrobacterium tumefaciens str. C58
MMKKKVLVVGGAGYIGSHTCLLLSERGYEPVVFDNLSNGHEEFVRWGPFEQGDIRDRARLDEVFAKHRPEAVLHFAALIEVGESVKQPVAFYDNNVIGSLNLLSAAIDAGVTSFVFSSTCATYGLPEQVPIDETHRQAPINPYGRTKWVVEQALKDYSTYEGLRSVMLRYFNAAGADFEGRIGEWHKPETHAIPLAIEAALGRRQGFKVFGTDYDTRDGTCVRDYIHILDLADAHVRAVDYLLDGGETVELNLGTGTGTTVKELLAAISEVSGRPFPVEYTGRRDGDSTTLVANNDKAREVLGWEPRYSLSDIIKSAWAWHSSRNAGD

SEQ ID NO: 39894 - protein, 401 aa, Populus tremuloides
MATKKSVSSLKEADLKGKRVFVRVDLNVPLDDNFNITDDTRIRAAVPTIKYLMGHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVVVADKFAPDANSKVVAASEIPDGWMGLDIGPDSIKTFNEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 39895 - protein, 425 aa, Agrobacterium tumefaciens str. C58
MARIVMKFGGTSVANLERIHNVARHVKREVDAGHEVAVVVSAMSGKTNELVDWVQNAAKVAGTNAASFYDAREYDAVVASGEQVTSGLLAITLQSMGINARSWQGWQIPIRTDNAHGAARILEIDGSDIVHRMGEGQVAVVAGFQGIGPDNRIATLGRGGSDTSAVAIAAAVKADRCDIYTDVDGVYTTDPRIEPKARRMKKIAFEEMLEMASLGAKVLQVRSVELAMVHKVRTFVRSSFEDPDAPGMGDLINPPGTLICDEDEIVEQEVVTGIAYAKDEAQISLRRVADRPGVSAAIFGPLAEAHINVDMIVQNISEDGSRTDMTFTVPSGDVAKALRVLDENKGQIGFDVAQNETGLAKVSVIGIGMRSHAGVAASAFKALAEKNINIKAITTSEIKISILIDGAYAELAVRTLHSAYGLDKA

SEQ ID NO: 39896 - protein, 577 aa, Oryza sativa Indica Group
MSEAIPSTRPALRHCVALLRLHLAAPSLAAAKQIHARALRAGVPTSHPLLAKHLLFHLAALRAPPLRYAVAVLSRLLPHGPLDPFPLNTVLRIAAGSPRPRVALELHRRRLALPDTHTYPPLLQACARLLALREGECLHAEAAKNGFVTLVFVQNSLVHLYGACGLFESAHKVFDEMPVRGRNLVSWNSMLNSFAANGRPNEVLTVFWEMLGVDFAPDGFTIVSVLTACAEFGALALGRRVHVYVEKVGLVENSHVSNALIDLYAKCGSVNDARRIFEEMGLGRTVVSWTSLIVGLAANGFGKEALELFSLMEREKLVPTEITMVGVLYACSHCGLVDDGFRYFDRMKEDYGISPRIEHLGCMVDLLGRAGRVEEAYDYIITMPLEPNAVVWRTLLGSCAMHKKLELGKVAWERLVELDPGHSGDYVLLSNLYAAVGMWADVHVLRKTMLRNSVYEFVMGDRSHPESEQIYEMLAEIAERLRREGYIPRTSNVLADIEEEEKETALNYHSERLAIAFALLKSLPGIPIRIIKNLRMCGDCHVAFNLISKVYDREIIVRDRSRFHHFQGGACSCKDYW

SEQ ID NO: 39897 - protein, 394 aa, Cochliobolus heterostrophus
LHSISVLNTGQLPNLPSPGSTRRGPMHPHRPKYNRTHTASPTTLGGGIPSSATSVRPANRPRHDSSASEAKNSAASNNPIPTPPIPADPTPHQQTLQTSTPPTPRISSPQLNTKKKRRKAPVEPPALPAGLLDGSVPPINVLIVEDNIINLRVLGAFMQRLKVRWQRAMNGKEAVTKWKAGGFHLVLMDIQLPVMNGLEATKEIRRLERVNGIGVFSSGSSEAPNTRLGSDSKSQDELREDDKLGDKGMFKSPVIIVALTASSLQSDRHEALAAGCNDFLTKPVNFVWLERKVKEWGCMQALIDFDGWRKWKDFADKSENNDTTSKLSGSFTSVAPNKKAANTSPTTATSETNGVKKDAETERKNKRKSLGVVPQPVLREEAEPQPAEVDSGDN

SEQ ID NO: 39898 - protein, 420 aa, Glomerella cingulata
MASLGADKKHKVTVVGSGNWGSTICKIVAENTKANPDLFEEAVHMWVFEEDVVIDKSSPYYDPAVGDAPQKLTGVINKYHENTKYLPGIKLPDNIIANPSLQDAVKDSTILVFNLPHQFIGNVCKQLRGHIMPFARGISCIKGVNVSDDGISLFSEWIGDGLGIYCGALSGANIASEIAAEKWSETTIAYDPPPMDNSRAPTPRSNSPANGNGIAPLTPVEMQHKDARGRTSKTKLTPVPAEYPPLDHQIFKQLFHRPYFHVRMVSDVAGVSLGGALKNIVALAAGFVDGRGWGDNAKAAIMRVGLLEMVNFGKEFFGQTVHTGTFTEESAGVADLITSCSGGRNFRCAKMAVAEGLSVEEIEKRELNGQLLQGTSTAKEVNSFLKARGLEKDYPLFTAVHGILEGRHSVDDIPSLVSDS

SEQ ID NO: 39899 - protein, 450 aa, Kineococcus radiotolerans SRS30216
MNQRFALPDVGEGLTEAEIVTWKVKPGDTVALNDVLLEIETAKSLVELPSPYAGVVAELLVAEGDTVEVGTDIVVVDDGSGAAAGPADPEPAAEPASEPAEPADEPAEPAAVAEASPQPAPDGGSGATLVGYGSREVAPRRRGARTTREPAPAPGPAPGAPAAHVLAKPPVRKLARDLGVDLARAVPTGPGGTVTRADVLALVPAAPAEPPRRVEQHARERHVPIRGIRKATAAAMVESAFSAPHVTVFTTVDATRTMKLVQRLKTDPEFAGIKVSPLLLVAKALLVAVRRNPDINATWDEENQVIVVKNYVNLGIAVATPRGLLVPNVKDADEMTLKDLAVHLNSVAGTAREGRAAPRDLAGGTITISNVGTFGIDTGTPILNPGEAAILAVGKIAQRPWVHKGKIKPRYLATLGLSFDHRMLDGESGSRALADVAAVLEDPARALTWS

SEQ ID NO: 39900 - protein, 520 aa, Pseudomonas putida
MTHLKITGMTCDSCAAHVKEALEKVPGVQSAIVSYAKGAAQLALDPGTAPDALTAAVAGLGYKAMLADAPPTDNRTGLFDKVRGWMGAADKGSGGERPLQVAVIGSGGAAMAAALKAVEQGAQVTLIERGTIGGTCVNVGCVPSKIMIRAAHIAHLRRESPFDGGMPPTPPTILRERLLAQQQARVEELRHAKYEGILDGNSAITVLHGEARFKDDQSLIVSLNEGGERVVMFDRCLVATGASPAMPPIPGLKESPYWTSTEALVSDTIPERLAVIGSSVVALELAQAFARLGSQVTILARNTLFFRDDPSIGEAVTAAFRAEGIKVLEHTQASQVAHVNGEFVLTTGHGEVRADKLLVATGRTPNTRSLALDAAGVTVNAQGAIVIDKGMRTSTPHIYAAGDCTDQPQFVYVAAAAGTRAAINMTGGDAAINLTAMPAVVFTDPQVATVGYSEAEEHHDGIETDSRTLTLDNVPRALANFDTRGFIKLVIEEGSGRLIGVQVVAPEAGELIQTAVLAIR

SEQ ID NO: 39901 - protein, 384 aa, Oryza sativa Japonica Group
MEEHLLPVVHRDQVYSSRQDRRKSSDVPNRFVTSFHPSTNSKGNPNTPNHPLHTSGNGNIVTAQNFQRVHSSPSMFTSIKETPCADEFNEQSHAAQHVPSFARQAIVSVILYISIGVLVYITNVEGFKGRSTLKLVDGLYFTIISLCTIGYGDIVPCTTFTKVFTCLFLLIGVRFVDIVLNELLTNVLDKQRTVLLSTMDDNKLNRVFDTYMIDAEKKRSRGRMKVLLALGVVVGTISICTIIVHEVEGLNWIDSFYLSVISVTTVGYGDYGFSTPAGRLSATVCLLVSTLAVAKAFLFLTDLRMDRRNRKTTKWILQKKMDNEPLAADLDHDASVSKSDFLIYKLKEIGKIDDKDIAMISDQFDQLGLAKCGKITLADIIGKL

SEQ ID NO: 39902 - protein, 1943 aa, Cochliobolus heterostrophus
MADDKKPTTLAPPAVTALKHEATTSPGHRHGMERTVSQDMRNERADLKEAAEHSLNIIMDLDLEGKIRYVSPSWTDVIGTLPAQVTGKPVLDLICSGADGFAQAIESVRKDDSRSHIARFTIQLGPHSILRQRRPRHSVAQGQESTPRSPTNVPDDEEQFLNVEAQGIMVYDRTTGAESHTMWMVRPSVIREVTIDLPEVLVEALGVGAEVLAHYLTGLAEQSATDPGNCAPPLPVLCRICERQITPWWFEKHSELCLQEHRAEMDVQMAQETLAEHRNAIVKVLDTLESHSQRSRPASIDSVQPLQPAEYKGLIIHSTSTPSSGSPSSTPSGRNSPASPPSRSRERSERPSGFGHHRARSFAVRRPLARIVELVLDLCDTALEINTPAVKDNTRGQSVAEIRTQSPQSENRISQVLQWQSPTTGSADHTEGLKLLCEDTSKLARAKVDAVTRHRRVLEYSERLRIEFDILVQECIEAAILKAARIAAGEDSSSEEDERQEEVQSDANDTDTATDIAPGEEGIFPCSYDPPSSMAHALRSTSDASLPARVGRRESSVAGSNRSSSPRGGCQTPRSHVGAISIATHNKRQSMHFESDTGAESDTSMRSSVLSGPRRADSPATSDVGLGRVASSRERKRKSLILPSVMSSRQQSPARTMVPPPSSPLRTTKPRLPSGVEGIHSPITSPVLQTTEFSSPAMMHTIQHHRRQSSTAGSDGPRPISPRLIASTQPQPRAVPPSIKDFEIIKPISKGAFGSVYLAKKKSTGEYYAIKVLKKADMVAKNQVTNVKAERAIMMWQGESDFVAKLYWTFSSKDYLYLVMEYLNGGDCASLIKVLGALPEDWAKKYLAEVVLGVEHLHSRGIVHRDLKPDNLLIDGKGHLKLTDFGLSRMGMIGRQKRALKSVEPAPDLLKTGPFHRATSVGSSRSASFDLNHSPSQTPAMTPALTGDIGQPSYFSLNRETSQQSRERSRRPSGTRSDSQDSDALQAMFRRFSIVDDSFSHPRGRSPIEEEALSDDGSPDPYAVPVSMSHSGLAQNSVLGPTSTMPPPPMTLFDPEDSDRRFVGTPDYLAPETIAGNGQDEVSDWWSLGCILFESLYGYPPFHADTPDEVFQNILARKIDWPADDDELYDISDEAKDLMNRLMCSDPTERLGANKDEKFASGGEEIRSHPWFADINWDTLRDDEASFIPAPENPEDTEYFDSRGAAMANFNPEFEDQATTPAGTPSTDYPDRPHDALSRVRSQVTVSTMKRGLIPLHIPAHVREGRTRRLSEPMAADDFGNFSYKNLPVLEKANKDVIQKLRAEAMLPQNKPTPPLQSPNVTSPSPSLENSPMLPGSLKRTLSTNRAPGRPSSPSVSGPHSSPSRGSQPSSPLLVQFSTGQHHDRRKTSSSSSTLSHSTSNPSTLQPGVSGMRPSPEGISPIKLPKTPSSTGTSQDKTAAGQRQTFTGSAIADSPRARSQTIGSQEEDLVHNLLPGHYKRRSQVLDVSPSSSDTEDSRAKALLRVQRRRQSSRRLSQISFGDGPFFRPLDVLICEDHPVSRLVMEKLLEKLRCRTLTVTNGSEAIRYAMGEVKFDVIMMEFRLPQVNGADVARMIRDTKNANTHTPIVAVTGYLKELQAPHYFDALIEKPPTVAKLTDTLSRLCQWKAPPPGWTPSQSFPSIMPASGLRQESSRQEDSPSSHSSGFPAVPSASYRGSSREDSISSSFFGDNDSRAGEDIPVRIHNADDWRERDMARAMGGLAIGDDAANADTKNAPSNRGGPPDLPHGDSTQPSLEEATIRRQRSTEQVGAKRRVLETRKHESAESGDDEDDELGHAPIRTRSPKSRPKSTSKLGIEMMRTNSRGSVISVEDPGQPDTTLPSSPPPMITEDRAAEEYEGNLPASGFAPSLLTPPVIFPEQPGDDVEEFVMETPKAQKETASPDPDPTPKAKNTLPKPNNASDD

SEQ ID NO: 39903 - protein, 427 aa, Methylobacillus flagellatus KT
MSAIVDIIAREIIDSRGNPTVEVDVLLESGVIGRAAVPSGASTGTKEAVELRDGDAARYLGKGVLQAVENVNTEITEAIIGLDVEEQSFIDQTLIDLDGTENKSRLGANAILAVSMACARAAAEESGLPLYRYLGGSGFMQLPTPMMNIINGGAHAENSVDMQEFMIIPAGLPTFREALRAGAEVFHALKKILHSEGLATTVGDEGGFAPDLPSNEAAIQYILQAITAAGYEPGRDILLGLDCASSEFYKDGLYHLESEGLQLTSAQFADYLATWVDKYPIVSIEDGMSEHDWDGWKLLTDRIGKKVQLVGDDLFVTNAKILREGIQKGVGNSVLIKVNQIGTLTETFTTIETAKRAGYTAVISHRSGETEDTTIADISVATNALQIKTGSLSRSERIAKYNQLLRIEEELGDATSYAGKEAFYNLK

SEQ ID NO: 39904 - protein, 497 aa, Triticum aestivum
HYRTSLYKKAGWYRSGIPGISSTHASDPIHGRKPPRSSGTVPSHASIAASPARLFHGRSRWLASDASACAAREPSAELVEVPLAQTGEGIAECELLRWFVSEGDQVDEFQQLCEVQSDKATIEITSRFKGTVHQIQFAPGDIVKVGETLLKMIVNGSQVVPHDSLASSPDIPLGVDTSTSPSREGNAPRGSLSTPAVRHLVKQYGLNIDDIQGTGRDGRVLKEDVLNYAASKGLLQEAPSALEENVGQVELPEGGKPLLDPQFYEDKRIPLRGYQRAMVKSMSLAAKVPHFHYLEEINCDALVQLKASFQKENKDHDVKHTFLPFLIKSLSVALSKYPLLNSSFIEEANEVTLKGFHNIGVAMATEQGLVVPTIKKVQSLSILEITKELSRLHEMALQNRLSTNDITGGTITLSNIGAIGGKFGSPVLNLPEVAIIALGRIQKLPRFDDDENVYPSSTINVTVGADHRVVDGATVARFCNEWKSLVEKPELLLLHMR

SEQ ID NO: 39905 - protein, 384 aa, Bordetella parapertussis 12822
MPRLATRTNDFLTFQVVELFKEAQALQAAGRDIISLGIGEPDFTAPPQVVEALERAARAGLSGYSAPAGLSALREAIAAFYESEFGARVDPARIIVTAGASGALALACAALVNPGAQVLMPDPSYPANSNFVLAAGGQPRLIPSTAAKRFQLSAQDVRDHWNDATQGVLIASPSNPTGTSIAHDELAELLAAVRERQGFSIVDEIYLGLSYESQPRSALLLDDDIIVINSFSKYFHMTGWRLGWMIVPESMVAKVEKMAASLAICAPTLAQHAALACFTPDALKIFEHRREAFKQRRDYLLPEFERLGIPVPVRPDGAFYIYADIAALGTTSMAFSHRLLHEGGVAAVPGLDFGPAHGERTMRFSYATGLDRLQEAVARIEKLL

SEQ ID NO: 39906 - protein, 795 aa, Bordetella parapertussis 12822
MRSRPARAGAGSIFPACAAASFTFAAPTYVIAIMDANFRKAALEYHEHGRPGKISVTATKPLVTQRDLSLAYSPGVAAACEEIVEDPANVFRYTGRGKLVGVITNGTAVLGLGNIGALASKPVMEGKAVLFKKFAGLDVFDIEINETDPDKLVEIIAGLEATFGGINLEDIKAPECFTVERKLRERMKIPVFHDDQHGTAITVCAAVVNGLAVAGKRIEDVKLVTSGAGAAALACLDLLVDLGLPLEHIWVTDIEGAVYQGRTALMDPDKARYAQPTEARTLAEVIEGADVFLGLSAGNVLKPEMVATMAANPLILALANPNPEILPEAAHAVRDDIIMATGRSDYPNQVNNVLCFPYIFRGALDVGATTITREMEKAAVLAIASLAREEQNEVVAAAYGTYDISFGRDYLIPKPFDPRLIVRIAPAVAKAAMEGGVATRPIADLDAYAEQLQQFVYHSGAFMKPLFSQAKQIVRDGGRARIVFTEGEDERVLRAVQVIVDEKVAKPILVGRPQVLLSRIEKFGLRLRLGQDVEVCNPEYDERFHQYWTTYWELMCRNGITKEMARVEMRRRLTLIGAMMVHLGDADGMICGAVSGFHDHLRFIDQVIGRKPGATTYAAMNILLLDERTVALVDTHVNEDPSAEQIAEYTVAAAEEMQRLGLAPKVALLSRSNFGSGSSASGAKMRHALELVNRQAPGLEIDGEMHGDCALDESLRLRLLPDSPLKGSANLLVCPNVDSGNIAYNLLKTVAGKNVAVGPILLGANAPVHIVTSSATVRRIVNMAAMAVVNADAVR

SEQ ID NO: 39907 - protein, 536 aa, Ipomoea nil
MGVDVGTLLSKMNMLTTSDHGSVVSINIFVALICACIIIGHLLEESRWMNESITALMIGICTGVVILLTSGGTSSHILVFSEDLFFIYLLPPIIFNAGFQVKKKQFFRNISTIMLFGALGTLISFIIISLGAIGIFKKMNIGSLELGDYLAIGAIFSATDSVCTLQVLNQDETPLLYSLVFGEGVVNDATSIVLFNAVQNFDLSNINSLVVLQLFGNFLYLFILSTLLGVVAGLLSAYVIKKLYFGRHSTDREVAIMICMAYLSYMLSELFSLSAILTVFFSGIVMSHYTWHNVTESSRVTTKHAFATLSFIAEIFIFLYVGMDALDIEKWKFVSDSPGTSVEVSSILLGLVLVGRAAFVFPLSFLSNLIKKSRGEKIGFRQQFIIWWAGLMRGAVSMALAYNQFTRSGYTQLRENAIMITSTITVVLFSTVVFGLITKPLIRVLLPTPKHLNRMVSSEPVTPKSFTVPLLDSEADLDGHVPRPNSLRMLLTTPSHTAHYYWRKFDDAFMRPVFGGRGFVPYVPGSPTEQNEPQWQ

SEQ ID NO: 39908 - protein, 364 aa, Pseudomonas syringae pv. syringae B728a
MSEQELKALRVRIDSLDEKVLELISERARCAQEVARVKMSSLAEGEVPVFYRPEREAAVLRRVMERNRGPLSNEEMARLFREIMSSCLALEQPLKVAYLGPEGTFTQAAAMKHFGHAVISLPMAAIDEVFREVVAGAVNFGVVPVENSTEGAVNHTLDSFLEHDMVICGEVELRIHHHLLVGESTKTESITRIYSHAQSLAQCRKWLDAHYPNVERVAVASNAEAAKRVKGEWNSAAIAGDMAAGLYGLTRLAEKIEDRPDNSTRFLIIGNQEVPPTGDDKTSIIVSMSNKPGALHELLVPFHENGLDLTRIETRPSRSGKWTYVFFIDFVGHHKDPLVKAVLEQISSEAVALKVLGSYPKAVL

SEQ ID NO: 39909 - protein, 78 aa, Escherichia coli
MSTIEERVKKIIGEQLGVKQEEVTNNASFVEDLGADSLDTVELVMALEEEFDTEIPDEEAEKMTTVQAAIDYINGHQA

SEQ ID NO: 39910 - protein, 455 aa, Synechococcus elongatus PCC 6301
MLPPGPSQLALLQTLRIITQPVSFLLSCADRYGDWFTLRVLGPQSPPVVFVSDPEAILAIFSSLADQLELGRIADVFRPLVGNESLIMQNGDRHRQQRQLLMPALQGERLFDYTPAMTAITQAAIAQWPLGQPLDLRRQMSQISLAVILQVVFGLTPGPRYRDLYQRLDQLLEAITDPLYSLQFFWPALQQDWGNWSPWGRFCRQREAIDALITAEIQEGRQSQQPRQDVLELLLAARDRDGNPLSDQELRDQLMTLLLLGHETTASALTWAVFWLLRHPDCLNRLQSELVAIGDNDRAIAKAPYLDAVCREALRLQPIALIAQPRRVASPLSLGGYDFASGTILVPCVLTAHRRAATYPNPDQFQPNRFLERRFSNGEFLPFGGGQRSCIGMALSLIEMKMVLATLLRQCQIAEVSQRPVRPARRGITFVPSQDFRIQVQQWHNPSAQTAIASV

SEQ ID NO: 39911 - protein, 258 aa, Dehalococcoides ethenogenes 195
MSSLAEAPIHDPGFDSEEAHKRKQYMVDLFVVQAKNYDFHDDVFGLYAHRFWMRTVLKIMGRFLKDRKHVDMLDLACGTGFVTFNTARNFDNVDIEAFDISPDMLAVAKERYEKYFKGRNIKFWRGDAEVPFGEEKYDLVTTSFAYRNFANKGIATENVFNALKPGGLFIIQDLTKPERHPMRGLYIFYMKYILPVLTGILGTEKSAARWLYKSAMMMPTNGQIVKLMESKGFEKCQYKSLSLGIACVIWGFKPEKSE

SEQ ID NO: 39912 - protein, 336 aa, Bordetella parapertussis 12822
MTIRVAINGYGRIGRNILRAHYENGKKHDIEIVAINDLGDPKTNAHLTRFDTAHGKFPGTVTVDGDYMVVNGDKIRVLANRNPAELPWGELGVDVVLECTGFFTSKEKAGAHLKGGAKKVIISAPGGKDVDATIVFGVNQNVLKAEHTVISNASCTTNCLAPLVKPLHDKLGVETGLMTTVHAYTNDQVLTDVYHEDLRRARSATMSMIPTKTGAAAAVGLVLPELNGKLDGFAIRVPTINVSLVDLSFVAKRDTTVEEVNSILQAAAEGELKDILTYNTEPLVSVDFNHNPASSNFDATLTKVSGKLVKVSSWYDNEWGFSNRMLDTTVALMSAK

SEQ ID NO: 39913 - protein, 388 aa, Candida glabrata CBS 138
MWFFKKAAEPEDSLMGTEHKSNKPPNTAFRQQRLKSWQPILSPQSVLPLLIFYACIFTPIGVGLILSAKGVQDLTIDYSHCSTKANTGDFTDIPKKYVHHNFKHKVASKARWKLENEDDESKCILEFEIPDDIKDSVYIYYKLTNFYQNHRRYVESFDYKQLLGKALSKDELTTACRPLRAEGDKIVYPCGMIANSMFNDTFDQQLKAVGDSNSDYELTNKKISWSIDRKRFKKTTYNASQIIPPPNWRERFPDGYTEDNIPNIHEWEEFQVWMRTAALPKFYKLALKNETAPLPKGTYSMAIGLHYPISYFGGSKSFVLTTNSVIGGRNMSLGVVYLIVSCLSGLLALIFIIKLFFQPRAMGDHAFLKFDEETDSRDNNDLALREIL

SEQ ID NO: 39914 - protein, 567 aa, Kluyveromyces lactis NRRL Y-1140
MLHKEKDIEESKRFFHHSTSGMEGNPDGFGLLPDGSKLESVKDTRIDKFAVPKKGLHSEHVYNLVKNELKLDGNPVLNLASFVNTFTDQFAQKLIDENLNKNLADNDEYPQLIHMNERCISMLAKLWQSDTDRDTPLGCATTGSSEAIMLGGLAMKRQWEKKMRAANKSTEKPNIIMSSACQVALEKFARYFDVECRLVPVDTEHGYHLNPNKLWDYVNENTIGIFVILGTTYTGHLENIEQVAEVLEHIEAQHPDWSNKDIPIHVDGASGGFIVPFAFTEAQMESYGLGRWGFNHPRVVSINTSGHKFGLTTPGLGWIVWKNDEYLLPELRFKLKYLGGIEETFNLNFSRPGFQVIHQYYNLLTLGQQGYYEKFNQSIFVARAFAWKLLQDPDMRDVFEVVSCLHENLDNSSIAESLDDYWKNPHDYKPGIPLCAFKLSEKFKSEHPEIPQSIISTLLRQKGWIIPNYPLPESTDGSDKKEVLRVVFRIEMKLDMALLLVQDVFEVVQKLLKSYEYLNIRTENDNHAVFKVLSTLSNADVSELEHELTDSQKEKEQHIKKNYRGTC

SEQ ID NO: 39915 - protein, 487 aa, Kadsura japonica
NPTTSGPGVSTLEEKNLGRITQIIGPVLDVAFPRGKMPNIYNSLVVKGRDTVGQQINVTCEVQQLLGNNRVRAVAMSATDGLMRGMEVIDTGAPLSVPVGGSTLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNISRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDGLPEQAFYLVGNIDEATAKAMNL

SEQ ID NO: 39916 - protein, 425 aa, Bordetella parapertussis 12822
MVFPSRGNGSGPFRRQAPDAIHTGTEYSMSNVNTLSALAKSGALSGKRVFIRADLNVPFDDAGRISEDTRIRASVPGIRLALDAGEAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 39917 - protein, 673 aa, Oryza sativa Indica Group
MAMQTMQTEQQQQQRRKVRGGGNSFFVARCFSPGVVGFLVEGGGLMVMGGWRLEIGLVVPRVETILSYMESGDFVQKNDLFPFLSFSWNFGFGCGSPEMDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGLSELTAPLTTEMNLVNGYRLTA

SEQ ID NO: 39918 - protein, 334 aa, Desulfitobacterium hafniense DCB-2
MTIRIGINGFGRIGRNVFRAAFGRENIEIVAVNNRSTGEILPHLLKYDSVHGIFPAQIQHTEDGFTVDGQLVKVVSHTDPGDIPWGELGVDIVIESSGKFNNGPACQKHLNNGARKVIISAPAKEEDITLVMGVNEEIYDPQKHHIISNASCTTNCLAPVAKVIHKNFGLKRGLMTTVHSYTNDQQILDQSHKDLRRARAAGLSIIPTTTGAARAVALVLPELKGKLNGFSMRVPTPNVSVIDLVAEIEKNTTIEELNGVLRHASENKLKGILDYTDLPLVSSDFNGSSASSIVDGLSTMVMEDNLIKVISWYDNEWGYSCRVVDLVEYVSRQI

SEQ ID NO: 39919 - protein, 171 aa, Escherichia coli
VDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 39920 - protein, 674 aa, Desulfococcus oleovorans Hxd3
MDIPFLNDVEIIFGLAVVVLLICHKLRVPTVVGFLVTGVVVGPHALGLVKAVHEVEMIAEVGVVLLLFTIGLEFSLERLLRIKRAVLGGGSLQVAVTSAITAIVAMQFGLTAGQAIFAGFLVALSSTAIVLKLLQQGAQIDSPHGLMSLGILIFQDIIIVPMILLVPILAGTAGNLTTSLLVLLAKGGIIIVLVIVSARWIVPQLLYLIARTRNTEVFLLSVIVICLGIAWLTATAGLSLALGAFLAGLIISESEYSHQALGNLLPFRDVFTTFFFVSIGMLLDLGFLIEQPGRVLLITLAVLVAKTLIAGGVTVVLGFPFRTGILAGLALGQIGEFSFILSRSGVEYGLMNEAAYQLFLAVSVLTMAATPFIIMAAPRLADMVLRLPLPGRLVTGFAPLGHTDAPVKQKDHLVIIGFGINGRNLAKAARTAGIPYIIIETNPETVRTAKADGEPIFYGDATHQAVLEHAGIHQARIAVVAINDPTATRRITDAIRRLNTGICLIVRSRYIQEMKHLYELGADEVIPEEFETSVEIFTRVLTKYLVPREDIERLVSAIRADGYEMFRQISKTSISVSDLRLNLHDVKIQSLRLKADSPLVSMSIGQADLRRCFSVSIVAISKNGQILANPGADTVLQENDVLFVLGNPDNIAQLKGMMVYACPLGDRPKPGATS

SEQ ID NO: 39921 - protein, 123 aa, Cucumis sativus
FDSAYQGFASGSLDQDAQSVRMFVADGGELLMAQSYAKNMGLYGERVGALSIVCGSADVAVRVESQLKLVIRPMYSNPPIHGASIVATILKDSAMFNEWTVELKGMADRIISMRQQLFDALKT

SEQ ID NO: 39922 - protein, 492 aa, Vitis vinifera
  misc_feature (290)..(290): Xaa can be any naturally occurring amino acid
MASLYNSVKLKYIKHCYQYLVNHILTFFLIPILMGFLIKILSLGPDQIYEIGSSLHFDLLQFLGSSLMIIFFATVYFMSKPRSVYLVDYACFKPPASYRVPHATLVEHLRLSNKDNPEIVEFQRRILQRSGLGDETCLAPANLYIPPTPSLEASRVEAELILFSVIDDLLKKTGIKTKDIDILIVNCSIVSPTPSLSAMVINKYKLRSNIKSFNLSGMGCSASLISIDLARELLQVHPNSCAIVVSTEITTPNYYSGNERSMVLINCLFRMGGAAILLSNKKADRSRSKXQLLHLVRTHKGADDKAYRCIHEQEDTQGIQGVSLSKDLMLIAGEALKSNITTIGPLVLPASEQLNFLFTLIGQKILKLKWKPYIPDFKQAFEHFCIHAGGRGVIDELQKKLQLSAKDVEASRMTLHRFGNTSSSSIWYEMNYIESKGRMKKGDRIWQIAFGSGFKCNSAVWKCNRTITTPTDGPWLDCIGRYPVSISQVLDL

SEQ ID NO: 39923 - protein, 429 aa, Erwinia carotovora subsp. atroseptica SCRI1043
MKLYNLKDHNEQVSFAQAIKQGLGSQQGLFFPLELPEFERTEIDALLDLDFVTRSSRILSAYIGDEIATETVFERVKAAFAFPAPIAPVEDDVAALELFHGPTLAFKDFGGRFMAQMLTEVSGNEKITILTATSGDTGAAVAHAFYGLENVRVVILYPQGKISPLQEKLFCTLGGNIHTIAIDSDFDACQALVKKAFDDEELKKAIGLNSANSINISRLLAQICYYFEAVAQLPQEARNQLVVSVPSGNFGDLTAGLLAKSLGLPIKRFIAATNANDTVPRFLSQGNWEPHKTVATLSNAMDVSQPNNWPRVEELFRRKNWQLKTLGFGAVSDDTTKETLLQLDALGYVSEPHAAIAYRLLRDQLQAGEFGLFLGTAHPAKFKESVEEILGKELDLPEALAERADLDLLSHNFPDDFAPLREFLMSLPE

SEQ ID NO: 39924 - protein, 487 aa, Persoonia katerae
NPTTSGPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNL

SEQ ID NO: 39925 - protein, 319 aa, Prochlorococcus marinus str. MIT 9303
MAGSGYRDYFKVLGVERNADSDDIKRAFRKLARQYHPDVNPGDSTAEAKFKEVSEAYEVLSDPDKRSKYEQFGRYWNQASGMGGGGPAGAGFEVDFGRYGNFDDFINDLLGRFGGPQAAAGFGAGFPGGAGFPRGSSRAPVNLDAEATLKVSFAEAFRGTERTLSVNEERVQVRIPQGIKPGSRLRLKGKGNLQPGTGRRGDLFLNIDVQTHPLWRLDGDQLRADLPVALDEFALGGTATVMTPDGEAQVTIPAGTSPGRSLRLKGKGWPSPGGRGDLLLTLNLKLPSEWSADELELLKRLQQSRSTDPRQAWLQMAPL

SEQ ID NO: 39926 - protein, 868 aa, Xylella fastidiosa Ann-1
MSASPTAERWIVLKFGGTSVSRRHRWDTIAMVVRKRLEEHGTRVLIVVSALSGVTNELTAIAQGVVDSAKRVTALEQRHRDFLVELGLDVQAVLGTRFAMLSDLLQDARAVTRSLDWQAELLGQGELLSSTLGAAYLGASGIDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNAVAAVDQCYYAIKANPHPAILRTLIEEGFGLECVSLGELRHAFEVVPHLVPSRVLFTPSFASRVEYEQAFLLGVNVTLDNVEALRLWPEVFRERTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRHLPAATASGDLMLIADAGAYGFSMASTYNLRGLPAEVVLDA

SEQ ID NO: 39927 - protein, 172 aa, Populus tremuloides
MANPKVYFDMTIGGAPAGRIVMELFADTTPRTAENFRALCTGEKGKVRSGKPLHYKGSTFHRVIPGFMCQGGDFTEGNGTGGESIYGAKFADENFVKKHTGPGILSMANSGPGTNGSQFFICTDKTEWLDGKHVVFGRVVEGMNVVKAIEKVGSSGGRTSRPVVVADCGQLS

SEQ ID NO: 39928 - protein, 307 aa, Vitis vinifera
MVVTHLPKLHTHFFISTPPPSLYTHHLSLLRIPKSTLTTAATAATSSTTHPPPISTPDTHIQIPLQNLFVPPETDISATSTPLTARILKGSNIVLSKYANDAQVVQAEFVKSSVRTEDCPSDGLPEFALVGRSNVGKSSLLNSLVRRKRLALTSKKPGKTQCINHFRINDSWYLVDLPGYGYAAAPQELRTDWNKFTKDYFQSRSTLVSVFLLVDASIPAKKIDLEYASWLGENQIPMTLIFTKCDKRKKKKNGGKRPEENVEDFQGLIRDFFQTAPPWIMTSSVSNQGRDEILLHMAQLRNYWLKH

SEQ ID NO: 39929 - protein, 519 aa, Pseudomonas putida
MTHLKITGMTCDSCAAHVKEALEKVPGVQSAIVSYAKGAAQLALDPGTAPDALTAAVAGLGYKAMLADAPPTDNRTGLFDKVRGWMGAADKGSGGERPLQVAVIGSGGAAMAAALKAVEQGAQVTLIERGTIGGTCVNVGCVPSKIMIRAAHIAHLRRESPFDGGIAATVPAIDRSKLLAQQQARVDELRHAKYEGILDGNPAITVLHGEARFKDDQSLVVRLNEGGEREVTFDRCLVATGASPAVPPIPGLKESPYWTSTEALVSDTIPARLAVIGSSVVALELAQAFARLGSQVTILARSTLFFREDPAIGEAVTAAFRAEGIEVLEHTQASQVAHVNGEFVLTTGHGELRADKLLVATGRAPNTRSLALDAAGVTVNAQGAIVIDQGMRTSNPNIYAAGDCTDQPQFVYVAAAAGTRAAINMTGGDAALNLTAIPAVVFTDPQVATVGYSEAEAHHDGIETDSRTLTLDNVPRALANFDTRGFIKLVIEEGSGRLIGVQAVAPEAGELIQTAVLAI

SEQ ID NO: 39930 - protein, 367 aa, Rosa hybrid cultivar
MERLNSFRHLNQKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIINDCKGVFEGLESLVDVGGGTGTLAKAIADAFPHIECTVLDLPHVVADLQGSKNLKYTGGDMFEAVPPADTVLLKWILHDWSDEECIKILERSRVAITGKEKKGKVIIIDMMMENQKGDEESIETQLFFDMLMMALVGGKERNEKEWAKLFTDAGFSDYKITPISGLRSLIEVYP

SEQ ID NO: 39931 - protein, 464 aa, Crocosphaera watsonii WH 8501
MLKTDSIDIVIRKQRDFFSSGTTQDINFRKQQLKNLRNLIDDNENEILEALHKDLKKTEFEGCLTAVIGAKIEIDYALKNINKWTKAKKVSVPIDQLPGKAFIQPQAKGVVLIISPWNYPFHLAIVPLVGAIAAGNCAIIKPSELTPNTSKVIAKIINNNFDENYIRVIEGAKETSQKLLEQKFDHIFFTGGSSIGKIVMEAAAKHLTPVTLELGGKSPCIIDTNINVKETAKRIAWGKFLNNGQTCVAPDYLLVNRQIKKELLEAIIEATKNLYGDDPATSPDYGRIVNHHHFNRLCALLEPGKIVLGGQVIPEENYISPTIIDEVSPDFPIMEDEIFGPILPILEYDRLEEAIAFINERPRPLALYLFSNDKKQQKIIVQKTISGGVCINHTIMHLGVLDLPFGGVGNSGMGSYHGKASFDTFSHQKSVLKRSFFLGTDLLFPPYKDKLKWIKLGLCIKNNC

SEQ ID NO: 39932 - protein, 527 aa, Pseudomonas putida
MTHLKITGMTCDSCAAHVKEALEKVPGVQSALVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNVGCVPSKIMIRAAHIAHLRRESPFDGGIAATVSTIYRRKLLAQQQARVDELRHAKYEGILDGNPAITVVHGEARFKDDQSLTVRLNEGGERVVMFDRCLVATGASPAVPPIPGLKESPYWTSTEALVSDTIPERLAVIGSSVVALELAQAFARLGSKVTVLARNTLFFREDPAIGEAVTAAFRAEGIEVLEHTQASQVAHMNGEFVLTTGHGELRADKLLVATGRAPNTRSLALDAAGVTVNAQGAIVIDQGMRTSNPNIYAAGDCTDQPQFVYVAAPAGTRAAINMTGGDAALNLTAMPAVVFTDPQVATVGYSEAEAHHDGIETDSRTLTLDNVPRALANFDTRGFIKLVIEEGSGRLIGVQAVAPEAGELIQTAALAMRNRMTVQE

SEQ ID NO: 39933 - protein, 540 aa, Oceanobacillus iheyensis HTE831
MINVTNVSLRYGDKKLFEDVNLKFTPGNCYGVIGANGAGKSTFLKVLSGEVEPQSGNVSMAPGQRLTVLKQDHFAYEEHPVLETVLMGHERLYKVKQEKDAIYMKEDFSEEDGIRAAELEGDFAEMNGWEAESDAAVLLKGLGIDESIHDKLMSDIPEDQKVKVLLAQALFGNPDILLLDEPTNGLDIQAIQWLEEFLINFENTVIVVSHDRHFLNKVCTHIADVDYGKIQIYVGNYDFWYESSQLASRMAQEANKKKEEKMNELKEFIARFSANASKSKQATSRKKMLDNITLEDIKPSSRKYPYIAFTPEREIGNDLLQVQGLTKSINGVKVLDNINFTLNPNDKVALIGKNDIANTTLLQILAGELEPDEGSFKWGITTSQSYFPKDNSEYFEGSDLPLVDWLRQYSPEDETETFLRGFLGRMLFSGEEAKKKANVLSGGEKVRCMLSKMMLSHANVLLLDEPTNHLDLESIQSLNNGLIRFKGSIIFTSHDHEFINSIANRLIEITPSGIIDKEISYDEYARDKELQDRIQKMYAS

SEQ ID NO: 39934 - protein, 181 aa, Populus tremuloides
MGLSFTKLLGRLFSEKEMRILMVGLDAAGKTTILYKLKLGEIVTTIPTIGFNVETVEYKNISFTVWDVGGQDKIRPLWRHYFQNTQGLIFVVDSNDRDRVGEAREELHRMLNEDELRDAVLLVFANKQDLPNAMNAAEITDKLGLHSLRQRHWYIQSTCATSGEGLYEGLDWLSNNIASKA

SEQ ID NO: 39935 - protein, 366 aa, Rosa hybrid cultivar
MERLNSFKHLNQKWSNGEHSNELLHAQAHIWNHIFSFINSMSLKSAIQLGIPDIINKHGPMTLSELTSALPIHPTKSHSVYRLMRILVHSGFFAKKKLSKTDEEGYTLTDASQLLLKDHPLSLTPFLTAMLDPVLTTPWNYLSTWFQNEDPTPFDTAHGMTFWDYGNHQPSIAHLFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECIKILKRSRVAITSKDKKGKVIIIDMMMENQKGDEESIETQLFFDMLMMALVRGQERNEKEWAKLFTDAGFSDYKITPILGLRSLIEVYP

SEQ ID NO: 39936 - protein, 321 aa, Zea mays
MELFARAKVVRLKSHHDKGLYADEDEAHVTQERDGSSANARWAVEPAPHNPGAIRLRSRYGHYLTASGEPFLLGMTGRKVTQTAPAAPRPANASVDWEPVRDGFQARLRTRAGHFLRANGGLPPWRNSVTHDVPHRTATQDWVLWDVEVVQLLTPAPPDRAGSAPLAKLPDSPPAPELANPPQPHHRPSKSYAAPPPPPTLEPEAPPPRLSKLESSDSFSAPLHKVEGRAIHYHIADDLGNVQDGTVGHSFTFNGSNLEELAHKLQEETGLDNIIICTRSPINGKLTPLRLQLPPNNAAMHIVLVQESSKVARSFARPYGS

SEQ ID NO: 39937 - protein, 638 aa, Xanthomonas axonopodis pv. citri str. 306
MIDTTRYPRLSRIQTPDDLRRFDEAELTAIAEELRSYLIESVGKSGGHFAAGLGVIELTVALHYLYQTPVDQLVWDVGHQTYPHKILTGRRDQIHTVKQKDGVAPFPKREESIYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLQTLKGPQLLHVITTKGKGYELAEGDQIGYHAVGPFDPSKGLVAKTGAKKPTYTDVFSDWVCDMAAAEPKLLVITPAMREGSGLVRFSKQYPQRYFDVAIAEQHAVTLAAGMATQGAKPVVAIYSTFLQRGYDQLVHDVAVQQLDVLFAIDRGGVVGPDGATHAGNLDLSFLRCVPHMVVMAPADEAECRQMLSTGVQYQGPAAVRYPRGTGPGAALDASLATLPIGKAQLRHSGTRIALLGFGATVDAAEAVGRELGLTVVNMRFVKPLDKALLLELAKTHDGFVTIEDNVVAGGAGSGVSELLNAEAITMPLLHLGLPDSFQHHASREDLLAEAGIDQAGIRAALLKRWPQLMISLPPALNAATG

SEQ ID NO: 39938 - protein, 353 aa, Crocosphaera watsonii WH 8501
MTQPLIPVILAGGKGERFWPLSRRQRPKQFLSLDGSGESLLQATANRLLPLADNWDNLWVITASPIADGVREQLPNLPSNNLLVEPQGKDTAPAVAWTTLEIAKRYGKDAVIGFFPADHWIKETDEFEKTLNAASQLAIAEDAIVTLGIKPNYPSTGYGYIEQGNLTNNFNDLPVYKVTRFTEKPDLETAKSFLETGRFSWNSGMFIFRAGVVLQELEKHTPQVLKPLQEKGEAAYEELEKTSIDYALMEKTDLTYVLPANFGWDDLGNWNSLERLVDSNGDNVELGNHVTLDSKGAIIYNSDEQEVIATIGLEDVVIVRDKNVTLVVNKNRTQDIKKLLKELQKDSQLDKLL

SEQ ID NO: 39939 - protein, 280 aa, Kineococcus radiotolerans SRS30216
MRGTGCGGGPRRARCGDRGDDGAVPSTFVKRAPGAPPGALAAEAAGLRWLAAAGGVRVCPVLEVAPDHLVLERVEPVRPAAADAEAFGRHLAATHAAGAPRFGAPPPGVEGDAWIAAAPLPMTTAPTPWGAFYAEHRLRPYLRRAVDAGTLDAGDARVVDRVCERLAAEDPALVAGVQRPARLHGDLWSGNVLWSAAGAVLIDPAAHGGHPETDLAMLALFGLPHLETVLGAYAEAAGTAPGRRERVPLHQLHPLLVHTVLFGGAYAAPALAAARAAVAL

SEQ ID NO: 39940 - protein, 369 aa, Nostoc punctiforme PCC 73102
MQVKAAVAYSAGKPLTIETVQLSGPQAGEVLVEVKASGICHTDAFTLSGDDPEGLFPAILGHEGAGVVVEVGAGVTSLKPGDRVIPLYTPECRQCEYCLSFKTNLCQAIRLTQGRGVMPDGTSRFSIDGQMIHHYMGTSTFANYTVLPEIAVAKIREDAPFEKVCYIGCGVTTGIGAVINTAKVEPGANVVVFGLGGIGLNVIQAARMVGANMIVGVDINPSKRALAEKFGMTHFVNPQEVEGDLVPYLVDLTKGGADYSFECIGNVKIMRQALECCHKGWGVSVIIGVAGAGQEISTRPFQLVTGRVWKGSAFGGARGRTDVPKIVDWYMQGKINIDDLITHVMPIEQINDAFELMHKGESIRSVVTF

SEQ ID NO: 39941 - protein, 301 aa, Vibrio angustum S14
MNTSLVRKAVIPVAGLGTRMLPATKAIPKEMLPIVDKPLIQHVVNECVAAGIKEIILVTHSSKNSIENHFDTSFELEATLEARVKRQLLDEVQAICPPDVTIMHVRQGQAKGLGHAVLCAHPLVGDAPFAVVLPDVILDDVASDLRCDNMATMVKMFNETKVSQVMVEPVPMSEVSNYGVADINGVELHAGESAPMTKVVEKPSVEDAPSNLAIVGRYILPAEIWALLARTPVGAGDEIQLTDAIDMLMQSQQVNAFHMSGISHDCGSKIGYMKAFVEYGMRHNQFGEEFTAYLKQLAKSL

SEQ ID NO: 39942 - protein, 194 aa, Fusobacterium nucleatum subsp. vincentii ATCC 49256
MKIKKADFVKSAVYEKDYPEQLDKMEFAFVGRSNVGKSSLINSLTSRLKLARTSKTPGRTQLINYFLINDEFYIVDLPGYGFAKVPKEMKKQWGQTMERYIASKRKKLVFVLLDIRRVPSDEDIEMLEWLEYNDMDYKIIFTKIDKLSNNERAKQLKAIKTRLVFDNEDVFFHSSLTNKGRDEILNFMEEKLNN

SEQ ID NO: 39943 - protein, 577 aa, Bacillus cereus ATCC 10987
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVRAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMKDLLDFQMPYARKEAEVSEWKQNGVIGLAEVVKHVKPTILIGTSTVAGAFKEEIVKEMASHVERPIILPMSNPTPLAEAKPADLIKWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENLSDNDIKIAVKEAIWEPEYRQIKAVEKVRI

SEQ ID NO: 39944 - protein, 572 aa, Aspergillus nidulans FGSC A4
MASSVVPVALQNKLLGYGRAPSAQLAVLNLDLVRNIVFALFLFRYVRKTFYSLRGYGFFGSIHNVYLAIRLFLYSIFLRFPGVRGQVDKQVTAAIEGLESKLVANGPGVTRYLTLPKEGWTHEQVRAELAKLGNMEHTRWEDGRVSGAVYHGGKDLLKIQAEAFEQFGVANPIHPDVFPGVRKMEAEVVAMVLAMFHGPSDGAGVTTSGGTESILMACLAARNKARAERGVTEPEMIIPDTAHAAFIKASSYFGIKLHRVPCPAPDHKVDIAKVRRLINSNTVLLVGSAPNFPHGIVDDIPALSRLATHYKIPLHVDCCLGSFVIALLKKAGFPSPYEEEGGFDFRQPGVTSISVDTHKYGFAPKGNSVLLYRNKTYRSHQYFIYPDWSGGVYASPSVAGSRPGALIAGCWASLMSVGESGYIKSCLDIVNAAKKFESAINEDARLSPNLQVVGQPMVSVIAFESKNDAVDIYDIADDLSAKGWHLNALQSPPAMHVAFTIPTAAAVDTLISDLVAVVEKELEKAEERKRQGKSYVVKRGDTSALYGVAGSMPDKSIVSRLAEGFLDTLYKA

SEQ ID NO: 39945 - protein, 250 aa, Escherichia coli
GAHMGGSMSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGT

SEQ ID NO: 39946 - protein, 303 aa, Rhizobium leguminosarum bv. viciae 3841
MARSYSVYDVFTDRKLAGNPLAVIFDGDDLSDEAMQAITREINLSETVFVQPSTNPAYAARLRIFTPGRELPFAGHPTVGTAVALAERAHGAATRDLVTVLEENVGPVRCAVRLREGEASFAEFDLPRKSQPAIMPLDKLGIADALSLKVTEIGFENHVPSIWSAGVPFLLIPVHDVGATQRVEFDPQLWEKIVPFVDGALASAYVYCRGGVNHVAKFHARMFASGMGIVEDPATGSAAAALSGAIHHFDRLTDGHHPIMIEQGVEMGRPSFIHLHIDVDGGAISNARIGGQAVRLASGTLDL

SEQ ID NO: 39947 - protein, 193 aa, Fusobacterium nucleatum subsp. vincentii ATCC 49256
MYNPTVIDNNGKSERAYDIYSRLLKDRIIFVGTAIDETVANSIIAQLLYLEAEDPEKDIIMYINSPGGSVTDGMAIYDTMNYIKPDVQTVCVGQAASMGAFLLAAGAKGKRFALENSRIMIHQPLISGGLKGQATDISIHANELLKIKDRLAELLAKNTGKTKEQILRDTERDNYLSSEEAVNYGLIDSVFKR

SEQ ID NO: 39948 - protein, 362 aa, Oryza sativa Japonica Group
MGIYLSTPKTDKFSEDGENDKLKLGLSSMQGWRANMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSDSNNGQDDWSFEEGPHSDFAGPTCGCTACVALIRNNQLVVANAGDSRCVISRAGQAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKPITQNKKADVGEQSVKGVEEAEINAAEENGS

SEQ ID NO: 39949 - protein, 651 aa, Vitis vinifera
MAMGTSEAVLQVFSGAVPCLFGSDPCFSKSDSMSPFKSHIKSVKKRGSRYMLKCSYMIRSHIMTHRLHGVGGGLYGNTSIHRSQLQSCKCQRADSVSGIASEAGNGTWFVDNAKKRNPINGVMDTPNVLEFQDVQELKPEMEGSISNGAVETARDTFVKVRVDSIEDEAWDLLRESMVYYCGSPIGTIAAKDPTSSNVLNYDQVFIRDFIPSGIAFLLKGEYDIVRNFILHTLQLQSWEKTMDCHSPGQGLMPASFKVRTVPLDGDDSATEEVLDPDFGEAAIGRVAPVDSGLWWIILLRAYGKCSGDLSVQERIDVQTGIKMILRLCLADGFDMFPTLLVTDGSCMIDRRMGIHGHPLEIQALFYSALLCAREMLAPEDGSADLIRALNNRLVALSFHIREYYWIDMKKLNEIYRYKTEEYSYDAVNKFNIYPDQISPWLVEWMPNKGGYLIGNLQPAHMDFRFFSLGNLWSIISSLATMDQSHAILDLVEAKWGDLVADMPLKICYPALEGQEWQIITGSDPKNTPWSYHNAGSWPTLLWQLTVACIKMDRPQIAAKAVEIAERRIARDKWPEYYDTKKARFIGKQACLFQTWSIAGYLVAKLLLSDPTAAKILITEEDSELVNAFSCMISANPRRKRGRKSSTQTFIV

SEQ ID NO: 39950 - protein, 117 aa, Coprinopsis cinerea okayama7#130
MAPKQQSSNSSPLLSLWKAYNEQTSDRLKFIDSFLVFLMLSGIIQFVYCVLVTSYPYNAFLAGFASTVGQFVLASSLRSQVNPANKDEFKEVSPERAFADFALGSIVLHFFVYNFLG

SEQ ID NO: 39951 - protein, 250 aa, Vitis vinifera
  misc_feature (199)..(199): Xaa can be any naturally occurring amino acid
MAAITRLHLHHHHHHHHAFPIIKPSLLLSKLSHSPSFFPNFHFTPLRKFSLSPLLCSISDQPLQSSSGAGSPSIVGDLLDYLNESWTQFHATAEAKRQLIAAGFQLLNENDEWDLRPGGRYLFTRNMSSLVAFAIGEKYSVGNGFHVIAAHTDSPCLKLKPKSAASKSGYLMVNVQTYGGGLWHTWFDRDLSVAGRVIXKGSDGSFLHKLVKVKRPLLRVPTLAIHLDRFVACSFKDMIFLIIFNELNVT

SEQ ID NO: 39952 - protein, 99 aa, Lactobacillus delbrueckii subsp. lactis
GAVHDVISEFVFNTAMTGYVEVLTDPSYAGQSVVMTYPLIGNYGVPLDDQEAAHPFVEAFVVSELSRLGSNFRMNMSLNDYMIENNIPGIQGVDTRAIT

SEQ ID NO: 39953 - protein, 392 aa, Oryza sativa Indica Group
MPTLDARLRLPLAGLSPATTSFPGSTPKPGSLSFALRPPSASLSSSASAPAAAAPPIVVVGSANADIYVEVDRLPLVGETVAARAGRSLAGGKGANQAACGGRLAAGPTYLVARVGDDANGRLLEGALADAGGVRLDRVARAPGAPSGHAVVMLMPGGQNSIIIVGGANMEGWASGVGSDDLDLIRRAGVLLLQREIPDWVNVQVAQAAKGAGVPVILDAGGMDAPVPGELLSLVDIFSPNETELARLTGMPTETFEQISRAAGACHKMDNCNMRNCIKGVKEVLVKLGSQGSALFIEGGEPIRQPIIPATEVVDTTGAGDTFTSAFAVALVEGKPKEECMRFAAAAASLCVQVKGAIPSMPDRKSVMDLLESVQPPFILNNGARGQIRRIQ

SEQ ID NO: 39954 - protein, 438 aa, Pseudomonas syringae pv. phaseolicola 1448A
MRISIFGLGYVGAVCAGCLSARGHDVVGVDISSTKIDLINNGKSPIVEPGLEELLQKGISTGKLRGTTDFAEAIRATDLSMICVGTPSKKNGDLELDYIESVCREIGYVLRDKATRHTIVVRSTVLPGTVANVVIPILEDCSGKKAGVDFGVAVNPEFLRESTAIKDYDLPPMTVIGEFDKASGDVLQSLYEELDAPIIRKDIAVAEMIKYTCNVWHATKVTFANEIGNIAKAVGVDGREVMDVVCQDKALNLSQYYMRPGFAFGGSCLPKDVRALTYRASSLDVEAPLLNSLMRSNTSQVQNAFDMVASYDTRKVALLGLSFKAGTDDLRESPLVELAEMLIGKGFDLSIFDSNVEYARVHGANKDYIESKIPHVSSLLNSDFDQVINDSDVIILGNRDERFRALANKTPEGKRVIDLVGFMTNATSEDGRAEGICW

SEQ ID NO: 39955 - protein, 411 aa, Pseudomonas syringae pv. tomato str. DC3000
MRALTYHGANSVKVDSVPDPELQEADDIILRVTATAICGSDLHLYRGKIPTVEHGDIFGHEFMGIVEETGSAVTAVQKGDRVVIPFVIACGSCFFCNIDLFAACETTNTGRGAIMNKKSIPPGAALFGFSHLYGGIPGGQAEYVRVPKANVGPFKVPGTLADEKVLFLSDILPTAWQAVTNAGIGPGSSVAIYGAGPVGLMSAACAKMLGAERIFMVDHHPYRLAYAQKTYGVIPINFDDDDDPADTIIRQTPGMRGVDGVVDAVGFEAKGSTTETILATLKLEGSSGKALRQCIAAVRRGGVVSVPGVYAGFIHGFMFGDAFDKGLTFKMGQTHVHRFMPELLEHIEAGRLAPEAIISHRMSLEDAAKGYKLFDKKEEDCRKVILTPGDNTIVVPDTQTEALVGGVVPAM

SEQ ID NO: 39956 - protein, 756 aa, Oryza sativa Japonica Group
MAATDMSPKAGKPLVENDAGSYLAWSGKDQPAVAGEKLGCGLLVLKPLGFALPHYADSGKFGYVLGGSAVVGVLPAGVDARERVVRLEAGDVIAMRAGEVTWWYNDTDGEDVTIVFMGDTAGAVSPGDISYFVLAGPMGVLGGLDAGLLAKASGLTSPEQAATAFRSQPAALLTRLNGKLHGVRPREHDRHGLVVNAARVPADSNTGGAAPRDEDGHRGAPASAGAARVQRRAHASRRGRCGSRALGAPRRRGAGGVRRQGERARPGRRRRRRVDAARRGGRGGEPARRAPVRRVARGRGRRRRHGAGVADQKPQAGDGALHREGIGDRRPDGGDRAGGAQRVAGICGTAQDQVLNAGFDESGTGVEKRIGKSTVLPPLPYHLEDNDSSSCVLHTIKKNLKGGPVLDRAKPSPLKSLVVLVSWKAMHLILDMAALPKAGKPLVENDAGSYLAWSGKNQPALAGEKLGCGLLVLKPLGFALPHYADSGKFGYVLGGSAVVGVLPVGLDARERVVRLEAGDVIAMRAGEVTWWYNDADGEDVTIVFMGDTARAASPGDISYFVLAGPMGVLGGLDAGLLATASGLTSPEQAATAFRSQPAVLLTRLSRKLQDVRPREHDRHGIVVNAARMPADSSTGGAAAGTKIVTAAHLPVLGQLGFSVGLTPLDAGAAVAGAGGASTLLDAEAAAGSLLVVPRYAVALVGVDAGGMELVSLIKSPRPAMKQFTGKGSVIGGLTPEIVQAALNVSPELVEQLRMTK

SEQ ID NO: 39957 - protein, 511 aa, Azoarcus sp. BH72
MHDIIRQLDEKRAAARLGGGQKRIDSQHAKGKLTARERIELLLDPDSFEEWDMFKEHRCVDFGMDKAEKTPGDGVVTGYGTINGRLVFVFSQDFTVFGGSLSETHAEKICKVMDHAMKVGAPVIGLNDSGGARIQEGVASLGGYADVFQRNVMASGVIPQISMIMGPCAGGAVYSPSMTDFIFMVKDSSYMFVTGPEVVKTVTHEDVTAEELGGAVTHTSKSGVADLAFENDVEALTMLRRFMNYLPSSNREKPPVQPTNDPADRQDFSLDTLVPDNPNKPYDMKELIIKVVDDCDFFELQPDYAKNIIIGMARMDGQPVGIVANQPLVLAGCLDIKSAIKAARFVRFCDAFNIPVVTFVDVPGFMPGTAQEYGGIIKHGAKLLYAYAECTVPKVTVITRKAYGGAYDVMASKHLRGDVNLAWPSAEIAVMGPKGAVEIIFREEKNNPEKLAEREAEYKAKFANPFVAASRGFIDDVVMPHNTRKRICRSLAMLADKQLDNPWRKHGNIPL

SEQ ID NO: 39958 - protein, 396 aa, Archaeoglobus fulgidus DSM 4304
MYRLKCIECGKEWGDENYTCECGGLLEVEIDLDEVEIDFRLDGSNITVWKYRSLLPVKIDPVTLKEGGTPLYRAERLEKEVGVRRVYVKHEGLNPSGSFKDRGMTVGVTKALELGRKAVACASTGNTSASMAMYAAKAGLKAYVLLPAGKVALGKVAQALMHGAKVIGIDGNFDDALRIVREVCSREPIYLLNSINPFRPEGQKTIAYEIADEIGVPDRVVLPVGNAGNISAIYKGFKELREVGLTDSMPKMTGIQAEGAAPIYRAFKEGKEDITPMENPETIATAIRIGNPVSAKKALRAIYSTNGLAEVVSDSEIIEAQKFLAAKEGIGVEPASAASVAGLRKLAANGMLDPDETIVCVVTGNLLKDPETVVRVCGEPVKVEASVEAVIRAMRA

SEQ ID NO: 39959 - protein, 358 aa, Leptospira interrogans serovar Lai str. 56601
MFKRIVIFLFILIFLSLSFLIFLFLRSSKNTNESITDSPFDPGKNNYLLESEWIHKENLNQPYAIAIDARGYVYTGTADHKVVQIRTNEKIETFAVLSGRPLGMVFDSHGNLLVCVEEVGIVKIRKDGSQKTIISKLPDGSPLRFPHGIDISKDGKIYFTVSSQSYSLQESFLEELFSRPNGMIVTADKNLTLEILNQDLYYPTGIALSSNEEFLLVSEPFRHRISSIPIFGSQRGTEKFFLTNIPGIPALISGNGGFFWVGIPYHRNEILDKTQEYPEIKNLLTGLPVFLFGKNIPRGLVFALNDFGDITANYQGFSDSSVAGITAVLNHAGNIYLVSSTIGKIAKMKPIIEEIQFF

SEQ ID NO: 39960 - protein, 490 aa, Leptospira interrogans serovar Lai str. 56601
MIRGRIPGGRLTSEQYLVWDELGDKFGGGAIRLTTRQSVQLHTLRIFHLRDVMKAIHEVNLSSMGACGDVVRNVTQAVNPLGKKELQLLDGVSQILSDHFKYKTNAYAEVWLGDKQLNKDEEDPIYGKTYLPRKFKIAVTLAGNNTVDIYANDMGFAATLSSDGNRIDGYFVFAGGGFGMTHNKPETFARAASLLGWVPENALIPVAEAIVTAHRDFGDRTNRKHARLKYVLAEKGVEWFQSEVESRSNVKLDKDKPLPNWETPSYLGWNERQDGTLSLGFHTLAGRIKDFPGKPLKSALKEIIGAYKLSVQITADQDLILIGIQKSDQEKVEKRLEELNVSWKSPSRLYDRALACPALPTCALALTESERSFPEVLNGIQKVLDKLGLSDRAPVVRMTGCPNGCARPYSAEVGIVGQQAGGKYSLFFGADSEGTKVGEYVAKKIALADIPAQLEKAFVLWKNEGDSDEKFGDFVNRFPLERFREALGSM

SEQ ID NO: 39961 - protein, 455 aa, Pseudomonas aeruginosa PAO1
MPDAPASAAERLERLPLSPYHRLVFVIIALAFFFDSMDLAMMTFLLGSIKAEFGLDSAQAGLLASSSFFGMVIGAALSGMLADRFGRKPVFQASIVLWGLASYLCSTAGDLDSLTFYRVLLGIGMGMEFPIAQSLLSEMIPASRRGKYIALMDGFWPLGFVAAGCLSYFLLPLTGWRSIFLVLALPAVFVLAIRFLIPESPRWLEQAGRREQADRVLRDIEARVMRSLGLTELPPPLRQPQRERSRPGFFSAFAELWSPAYRRRTLTVWGLWFFALLGFYGLTSWLSALLQQSGFAVTQSVYYTVLISLAGIPGFLCAAWLVESWGRKPSCVLMLLGGGAMAYAYGQTAVFGGSLALLIGFGLAMQFFLFGMWAVLYTYTPELYPTSARATGSGFASAVGRIGSLLGPLVTGLVLPLTGQGGVFTLGALCFGVAALVVWAFGIETRGRTLEELAG

SEQ ID NO: 39962 - protein, 474 aa, Kluyveromyces lactis NRRL Y-1140
MAKRRTKNRTHVKPSPEELKKIPKSMVIRVGQTSLASHSLNQLVKDFRTIMQPHTAIKLRERKSNKLKDFVVMCGPLGVSHLFIFTQSEKTGNVSLKIARTPQGPTITFQVQDYSLGKDIKKFLKRPKSLSKDDILNPPLLVLNGFQIKGNEDEEKANVEKVIVSMFQNVFPPLNPAKIQLNSINRVFMINKDQTTGEISLRHYAIDIREVDLSKNLKKLYKSKQKLSKAVPNLHRKDDIASLILDHDVAAYTSESEIEEDAIVKVMDKEHKHIKHIPHRSVNKDTGEKPARLSADGDDDIEMDDEDEEEDLNVKEEQEEEEQHSTQQPKKKAIKLTEIGPRLTLKLVKIEEGICAGKVLHHEYVKKSDSEIKALEKRHAQKMRLKEQRKKEQEENIAKKKAAKEAKKQRKLERRKAREEAAANGEDGEEAESGQDNSDSDSSDSEESSSEDNYSDVPEDLDSDLYSDIDEGTD

SEQ ID NO: 39963 - protein, 141 aa, Candida glabrata CBS 138
MLLFRTARCQVPTLGRFATHPRIAPSIAMRFQSSGGYASIKQVKTLEEVQKLMKDSNLSVIDFYATWCGPCKAMVPFLSKFVDQYKDVKFYKVDVDESPDVAEYYGVSAMPTFVFTKDDDILHKIRGANPKGLAKAIEEFK

SEQ ID NO: 39964 - protein, 183 aa, Archaeoglobus fulgidus DSM 4304
MKIYVIYNYGQYNHLIHRTLRDLGVETKLVENTTPVEQLKDVDGLVIGGGPSLDRTGNCELYLKELDVPMIGICLGHQLMAKVFGGEVGKGSMGGYSEVKVRIVEDDELFEGIPREITVWASHMDEVKKLPEGFKRLAESDICKIEAMRHEKKPLYGVQWHPEVYHSQFGVELYRNFIEICKK

SEQ ID NO: 39965 - protein, 519 aa, Vibrio parahaemolyticus RIMD 2210633
MSIQKNTSTTSSSTLLDLIVIGGGINGAGIAADAAGRGLSVGLYEANDFASATSSASSKLIHGGLRYLEHYEFRLVSEALAEREVILRKAPHVALPMRFRLPHRPFLRPAWMIRCGLFLYDNLGKRTTLPGSKTVNLAKSGLLKPEMKTGFEYSDCWVDDARLVLLNVMAARENHAEVRNYCRVEKAHRENGVWHVTIHDVTTDQRFERKAKALVNAAGPWVKQFFDEGLEQTSPRNIRLIKGSHIVVPRIHNEPQAYILQNKDNRIVFMIPYLDKFSIIGTTDVEYKGDPREVAISDDEVDYLIDIVNQHFVHQLTREDVVWTYSGVRPLCDDESDSPQAITRDYTLELDAEYDQAPLLSVFGGKLTTYRKLGEAAMKKLEPYLPQMGGNWTANQTLPGGNFSCTREQLAKQIHAKYSWAPQALILRYVTQFGTQTWDLMEGASSEADLGQAFSEQAGGVYQREIDYLMNHEMALTDEDILWRRTKLGLYMNDEEKQALADYLKEKLQQKVVNLSQVS

SEQ ID NO: 39966 - protein, 564 aa, Pseudomonas aeruginosa PAO1
MTETAKRPLYVPHAGPSLLEMPLLNKGSAFSTQERIDFNLQGLLPHNIETIEEQTERAYSQYNLCNTDLDRHIFLRSIQDNNETLFFRLLEEHLEEMMPIIYTPTVGQACQEFSKIYRTHRGLFISYPDRERIDDILRSATKNNVKIVVVTDSERILGLGDQGIGGMGIPIGKLSLYTACGGISPAYTLPVVLDVGTNNPDLLNDPMYMGWRHERVSGAQYEEFVDLFIQAIKRRWPNVLLQFEDFAQTNAMPLLERYKDELCCFNDDIQGTAAVAVGTLLAACKAKGEKLSEQTVTFVGAGSAGCGIAEQIIAAMQLEGLDEAQARRRIFMVDRWGLLTDDMSNLLDFQHRLAQKRADLGAWGGQQGDDLALLEVIRNARPTVLIGVSGQRGLFSEEVIRELHSHCKQPLVMPLSNPTSRVEATPQEILNWTDGQALVATGSPFQPVQVGDKRIPIAQCNNAYIFPGIGLGVIAARANRVTEGMLMAAANALANCSPIVTQGEGAVLPALGDIREVSKRIAVAVAKQAQAEGKALHTSDEVLNDAIEANFWFPRYRAYRRTSF

SEQ ID NO: 39967 - protein, 342 aa, Kineococcus radiotolerans SRS30216
MRAVLVEEFGAAPRLADVADPAPAPHGVVVAVQATGVCRSDWHAWQGHDDDVTLPHVPGHELAGTVVAVGADVRGRRVGDRVTTPFVTACGTCPECAAGQQQVCRRQTQPGFTGWGSFAELVALDHADVNLVALPEGFPSAAAAALGCRVATAFRAVTDVARVRAGESVAVHGAGGVGLSAIAIAAAAGARVVAVDPSPGARDLALAFGAEHAVAADGAVDAVRELTGGGAHVSIDAVGLPATCEASVRSLRRRGRHVQIGLLPAATGAPLVPMDLVIAGELQVLGSHGMAAHDYPRLLALVGSGRFPLAGLVTRELPLEAGPRALAEVGAATTAGITVLRP

SEQ ID NO: 39968 - protein, 626 aa, Kineococcus radiotolerans SRS30216
MEIAIALVALTVGVCVVSALCDRLRWPTPLVLVVVGAAVSLVPVVPEFSLGPELVLNGLLPPLLYATTARASLVDFNRNKTATLLLSVVLVVFTTLVVGWTTSWLLPGVALAACMALGAVVAPPDAVAASAIGQRLGLPRRVATLLEEESLLNDATALIALAAATSALTSELSPLHIGGEFVLAVVGAVLIGGVVAAVLALVRTRIRNPVLDTAVSFVAPYLAFLPAEALHVSGVLSVVVAGLALAHVSPKVQTAASRVAEALNWRTVAFLLENAVFLLIGLQFPLLVRGAADSGFGGGRILLVCAGVLVATVAARFAFVFAVAGILTAVPPWRRKAWPGAVSVLVSWAGMRGVVTLAAAQLIPEDVPGRDVLLLAAFAVVVGTLLVQGLSLPWVVRRVGLPAPDPAQDALQAAALGDAASAAGLRRLDELLTGDEPRHVVGQLRKRSKSRSHAAWERLGRPEADVSTPSAVYTRLRLEMLAAERAVVVEARDRGTAEPEVLQRALADVDFEEALLDRLDDLEPLAADRRLGGASDGGCAHLRTAGTRDDATARWGGPPTECAECVAVGATWVHLRTCLACGHTGCCDSSELRHSRAHFAGTAHPAIVSAEPGEAWRWCWVDEELG

SEQ ID NO: 39969 - protein, 164 aa, Vitis vinifera
MPIKAILIEGQDIIPSLVSLALICSFSRMRSHLNLGDVKPEDVSEDTLKAVAEILRNSTTLKVSEDGKKIGRATELLKPEEVVEQVNIRTIAASPLEYDAKLEDVEAYFGQIAKVNSVRLPRHVAEKRVFCGTALIQYSTEEDAAKVLQQSLVYAGVELELKPK

SEQ ID NO: 39970 - protein, 338 aa, Pseudomonas putida
MNLNRFERYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAEEVRQQEKELGFKFDYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPDGSKVLYAHLGGAPALNAYSFLFRNG

SEQ ID NO: 39971 - protein, 348 aa, Populus trichocarpa
MAYNILVTGGAGYIGSHTVLQLLLGGYNTVVVDNLDNASDIALKRVKELAGDFGKNLVFHQVDLRDKPALENVFAETKFDAVIHFAGLKAVGESMQKPLLYFNNNLIGTITLLEVMAAHGCKQLVFSSSATVYGWPKEVPCTEEFPLSAANPYGRTKLFIEEICRDIYSSDSEWKITLLRYFNPVGAHPSGYIGEDPRGIPNNLMPYVQQVAVGRRPHLTVFGTDYPTKDGTGVRDYIHVVDLADGHIAALRKLSEANIGCEVYNLGTGKGTSVLEMVAAFEKASGKKIPLVMADRRPGDAETVYAATEKAERDLSWKANYGVDEMCRDQWNWASKNPYGYGSPDGTN

SEQ ID NO: 39972 - protein, 239 aa, Arabidopsis thaliana
MEIDREDGRTPNQLRPLACSRNILHRPHGSASWSQGDTKVLAAVYGPKAGTKKNENAEKACFEVIWKPKSGQIGKVEKEYEMILKRTIQSICVLTVNPNTTTSVIIQVVHDDGSLLPCAINAACAALVDAGIPMKHLAVAICCCLAENGYLVLDPNKLEEKKMTAFAYLVFPNTTLSVLPEGSSVAEGEPVEHGIITSITHGVMSVDDYFLCVENGRAATASLSAFFRKNFQQSSSKAG

SEQ ID NO: 39973 - protein, 219 aa, Erwinia carotovora subsp. atroseptica SCRI1043
MTQDELKKAVGWAALDYVRPDTIVGVGTGSTAAHFIDALGSIKHQIKGAVSSSDASTEKLKSLGIPVFDANDVDSLDVYVDGADEINGHMQMIKGGGAALTREKIISALSRQFICIVDASKQVDVLGKFPLPVEVIPMARSYVARELVKLGGQPEYRQGVVTDNGNVILDVHNLNIMDAVAVENHINGIAGVVTVGLFANRGADVALVGTADGVKTVTK

SEQ ID NO: 39974 - protein, 363 aa, Neptuniibacter caesariensis
MSEQEKELRVLRDQIDTIDRNIHELLNKRASCAQNVAEVKEKYQGEQSAVFYRPEREAQVLRTVMERNEGPLADKEIARLFREIMSVCLALEEPMRVAFLGPEGTFTQQAAMKHFGHSAHNMPMQSLKDVFREVQSGAAHYGVVPIENSSEGVVNHTLDLFKQFNLKICGEVEVPIHLHLLLNKGDSMDEIAKIYSHEQSLAQSRGWLDARYPHIDKVAVSSNAEAARLVMQEGHGYAAVAGDMAAELYDLDAVVKNIEDQADNTTRFLIIGDQDVGPSGDDKTSILVSVPDAPGALYQLLEPFHRYELSLTRVETRTSAKHSLFYIDFEGHSEDKLVQKALAELTKESVELKVLGSYPKAVL

SEQ ID NO: 39975 - protein, 429 aa, Aspergillus nidulans FGSC A4
MLSTLKVASRQAASRNASVRSVFAGARCASTWSNVPQGPPDAILGITEAYKADSFKEKINLGVGAYRDDQGKPYVLPSVRAAEDKVVASRFDKEYAGITGIPSFTKAAAQLAYGADSPVLKEDRLVITQSISGTGALRIGGAFLQRFYPGAKKIYLPTPSWANHNAVFKDSGLEVEKYRYYNKDTIGLDFEGLVEDLKAAPNNSIILLHACAHNPTGVDPTQDQWRQISNVMKEKGHFAFFDMAYQGFASGNADTDAFAPRHFVEQGHNIALCQSFAKNMGLYGERVGAFSLVCESAEEKKRVDSQIKILIRPFYSNPPVHGARVASTIMNDPALNKQWLGEVKGMADRIIEMRALLKKNLEELGSKHDWTHITSQIGMFAYTGLKPEQMEALAKEHSVYATKDGRISVAGITTGNVKRLAESIYKVTG

SEQ ID NO: 39976 - protein, 217 aa, Clostridium perfringens ATCC 13124
MVKIAPSILSADFSILGEQVKRVEKGGAEFLHIDVMDGHFVPNISFGFPIMKAIRNLSNLVFDVHLMIEEPGRYVDEFISAGADLITVHYEADRHIDRTINYIKSKGCKAGIALNPGTPVSMLKNLIPSVDMVLIMSVNPGFGGQSFIPYSLNKIKEVKEMAKACGKEDLLIQVDGGVGANNIKEIVEAGANVLVAGSAVFKEDKIEENIKALREAL

SEQ ID NO: 39977 - protein, 409 aa, Bacillus cereus ATCC 10987
METIVQKFGGTSVGSVERIQHVANLIIEEYERGHSIVSVVSAMGKSTDELVALANAITENPSKREMDMLLSTGEQVTISLLTMALQAKGYNAISLTGWQAGITTESVHSSARITEINTDRIQSYLTKGTIVIVAGFQGVSEDFEITTLGRGGSDTTAVALAAALNAKKCDIYTDVTGVYTTDPRVVKDAYKLDEISYDEMLELANLGAGVLHPRAVEFAKNHNVILEVRSSMEQENGTIVKGECNMEQQSIVKGIAFEDNITRITVKGLEQGSLSTVFSTLAAAHINVDIIIQSITNEGTVHLSFSIHSNDLRETLEVLEQNQEALHYEAVEYENHLAKVSIVGSGMVSNPGVAANMFTTLKEENIHIKMVSTSEIKVSVVIDRLHLVTGVEALHQSFMAKIVPLVQMS

SEQ ID NO: 39978 - protein, 93 aa, Nostoc punctiforme PCC 73102
MSVETIQKPSTTRKLAPRYRVLLHNDDYNSMEHVVQSLIATVPSLTQPQAVSIMMEAHTNGLALVITCALEHAEFYCETLISHGLSSTIEPDE

SEQ ID NO: 39979 - protein, 188 aa, Fusobacterium nucleatum subsp. vincentii ATCC 49256
MSLIGRKVPEFKATAFKKGEKDFITVTDKDLLGKWSVFVFYPADFTFVCPTELEDLQDNYEAFKKEGAEVYSVSCDTAFVHKAWADHSERIKKVTYPMVADPTGFLARAFEVMIEEEGLALRGSFVINPEGKIVAYEVHDNGIGREAKELLRKLQGAKFVAEHGEVCPAKWQPGSETLKPSLDLIGEL

SEQ ID NO: 39980 - protein, 569 aa, Coprinopsis cinerea okayama7#130
MAKSDKKVEKKAAAAKDSKATKKGTKSSKEVVTQVSEKPAKAVASDKKDKKKKVVETKKPQPKANGKAKDDSSDESSESSSEDEKPKAAQVKAKQAAKASSSDGESEDESSSSESESDSSEDSSDSSDSSSDSEDDEPAVKKPVAKVNDKTSPKKAEAASSSSSSDSESDSDSDDSESEDEKPAVKKTAAPEKDDSSSDDSSDDSSDSSSEDEAPTKKAAPADAKAKKDASSSSEEDSDDDSDTSDSEDEKPAAKKAASPDSSSDSSDSDSSESEDEDGDVKMAEDKPAPAKSGKRKAADDDEPSTKKVKLENGSAAPAGGDAQQSKAVFVGQLSWNVDNDWLASEFASCGEIESATVQMDRNTGKSRGFGYVHFTTVEAAQKALELNGKEIDNRPIKVDISTPRNPDAARQKRAQTFGDVTSPPSNTLFVGNLSFNTSEDSVWSLFNDYGVKSVRLPTDRESGRPKGFGYVEFEDVEGAKKAFEANNGADLDGRPIRLDYSQPRDNSGGGFGGRGGFGGGRGGDRGGRGGGRGRGGDRGRGGRGGRGAPRGGARHGGIASFEGKKTTF

SEQ ID NO: 39981 - protein, 488 aa, Agrobacterium tumefaciens str. C58
MRRFQCYIDGRFEDGEASFSSLDPATGQPWAEMPESREADIGRVVEAAHRALYEDTVWSKLTATQRGKLLYRLADLVAENAKTLAELETRDTGKIIRETSAQIAYVADYYRYYAGLADKIEGAYLPIDKPDMDVWLRREPVGVVAAIVPWNSQLFLAAVKIGPALAAGCTIVVKASEDGPAPLLEFARLVHEAGFPAGVVNVVTGFGASCGNALTTHPKVAHIAFTGGPETARHIVRNSAENLASTSLELGGKSPILVFADADLESAANAQVAGIFAATGQSCVAGSRLIIEKSVKDRFLQILAAKAEAIRIGSPLDMATEVGPLATERQRKHIVSLVSASVDAGAKVVTGGEPVEGEGYFYRPTILDCDGIRSPSLEKEFFGPVLSVVSFETEAEAISLANDTVYGLASGVFTQNLTRAHRLMKAIRAGIVWVNTYRAVSPIAPFGGFGLSGDGREGGLAAALDYTRTKTIWLRTSDDPIPDPFVMR

SEQ ID NO: 39982 - protein, 388 aa, Vibrio angustum S14
MKITVVGTGYVGLSNAVLLAQHNEVVALDIVEEKVSLINQGLSPIVDKEIEDFLKNKDLNLNATTDASNAYDGAEFVIIATPTDYDPITNYFNTSSVEAVIKDVIEKNPSAIMVIKSTVPVGYTESIKKQFGNINIMFSPEFLREGRALYDNLHPSRIIVGERSERAEVFAGLLKQGAEKQDIAVLFTDSTEAEAVKLFSNTYLAMRVAYFNELDSYAEALGLDSRQIIEGVGLDPRIGSHYNNPSFGYGGYCLPKDTKQLRANYRDVPNNIIGAIVDANTTRKDFIADSIIAKQPKVVGVYRLIMKSGSDNFRASSIQGIMKRIKAKGIEVVVFEPVLEGDEFFNSKVIKDLEAFKAMSDVIVSNRMDIELQDVQEKVYTRDLFGAD

SEQ ID NO: 39983 - protein, 335 aa, Candida albicans SC5314
MSSIFPKLSFQEWYQVLYGLWPSNPQFTEKDISSNTLKDKVVVITGGNSGIGYETAKVLAGNTEARIYIWARNRQKSIEAIEKIKLEVAEKHSKDVGDRLQFIQIDLSDLNSIEPAVKEFLQREQRLDIIYHNAGVMESPSDQRTKQDYQMELGVNCIGPQLLQTLLDPLFIKTAEKNPPNLSRIVWVSSTAHMFSPIGGMYLRDPEFKSIDVELKTKYDQSKAINLIQARQWNIHHPGANAISLSLCPGYLKTGIQRHVTGLTKLAYNLFFHDQKMGVYTLLFAGLSPEITTKNKGDHVISFGKLGLIRPDLKDDENGKKVWDYLQDKIKSYVR

SEQ ID NO: 39984 - protein, 513 aa, Vitis vinifera
  misc_feature (6)..(6): Xaa can be any naturally occurring amino acid
  misc_feature (112)..(113): Xaa can be any naturally occurring amino acid
  misc_feature (222)..(222): Xaa can be any naturally occurring amino acid
  misc_feature (365)..(365): Xaa can be any naturally occurring amino acid
  misc_feature (400)..(400): Xaa can be any naturally occurring amino acid
MTVWVXLYFKPSGLRCEMTVTPLEWVLGRDRVVSEPIPDPGVRGYGSKLLASASPQHSASSLPLGLGLGFQIVVSARMGRRQKPKAKIDHQEDEEGANSSRSVIYLSSSDBXXANEBLSLKIVEKAMKRASKTDHNDAVLAGRSAVIDLGSSPSEEAEVITDRSGPTTDDDAEVKSKKKKSRKEKRANKNIENQEKTDEILMEEKKGESDKALEILKMVEPXPVEGSDNIVLRKLLRGPRYFDPPDSGWGACYNCGEEGHNAVNCASVKRKKPCFVCGSLEHNAKQCMKEIQCYICKSFGHLCCINYVDTGPIEPSCYKCGQLGHTGLACARLNAETADVQTPSSCYRCGEQGHFARECKSSTKXSKRYSEVSTQSRRFLKEDKDKLGFKSAPKDLGMGXKRKKPWYEERGNITPRKPKQRGGWITEDPGDSPQRKAKVKSWRSPATPTNKNHKRPMLTAGHYTSSQSSKNTQKFYSRNSTWQGSAKASQHRFSASRFGSSSSDAVRRHYDWW

SEQ ID NO: 39985 - protein, 107 aa, Phaseolus vulgaris
QRGKHGSDTGAYDTEGRFVPSKFEAIFSKHAHTNPNYLTYDELKEMIKANREPKDLAGRIGSFVEWTVLYKVAKDKNGLLQKDAIRAVYDGTLFEQLKKQRSSTKNN

SEQ ID NO: 39986 - protein, 505 aa, Pseudomonas syringae pv. tomato str. DC3000
MSTATILELMRPYWGDRSVIASYVGGAFIEGHGAPVEVRNAHNDSLLLSFPDADESLVEVADKAAKAAQQQWWAMTAQARGRAMYQVGNLIREEQENLAQIESLTANKPIRDARVEVLKVAEMFEYYAGWADKLHGEVIPVPTTHLNYVTYEPLGTVLQITPWNAPIFTCGWQIAPAIAAGNAVILKPSELTPLSSLVVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQQSIFEKFTNALAVAATQFKVGDPGDPETQIGPINNAKQYNHVKSMVERALKDGAKLVGEQADPIPDRPGYYINPTVLAGTNELHCAQEEIFGPVVVAIAFKDEEDAIRIANDSRFGLAGGVWTRDVGRAHRVAKQVRAGTFWVNGYKTIHVSSPFGGYGESGYGRSSGLDALREYSEVKSVWVETAAKPAASFGYGASLE

SEQ ID NO: 39987 - protein, 473 aa, Triticum aestivum
MDVPLASKTFPSPSPSKREQCNVDGHKSSSKHADLNPHANDSVLGIILGGGAGTRLYPLTKKRAKPAVPLGANYRLIDIPVSNCLNSNIPKIYVLTQFNSASLNRHLSRAYGSNIGGYKNEGFVEVLAAQQSPDNPDWFQGTADAVRQYLWLFEEHNVMEYLILAGDHLYRMDYEKFIQAHRESDADITVAALPVDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 39988 - protein, 488 aa, Archaeoglobus fulgidus DSM 4304
MDSSSVDIVLNKGGHNKSFEVKIYRIHTTKIMSFPNGSDAEGVLKRLEDYAKNDFEPHSRRMWGHIYYAGLKDVVELARKAYLMYMDKTMLDFTCFPSLLRMEREVVRMASSLLNGDEEVVGNFTYGGTESIMLALKAAREKFRKEEGGNVVPEIVLPATAHPAFWKSAEYLGMRCLRAKLDDELRADVETVKELVGDKTAMIVGSAPNYPFGVVDDIKALSDIAVDGKLWLHVDACLGGFHLPFFRELGEKIPDFDFSVEGVHSISADFHKYGLSPRGASVILYRNAKLREGQIFVMASWPGYPLVNTAVLSTRSAGTLAAAWAVMSYLGFDGYLKLAKKTLYAKKRLIDGLTELGLELLGSPEGAVLAFTSERHNLFKVSTLMAEKGWYVQSQPGSKKLGFPRSLHFSVIPGHAEVVDEFLEDMREVLPECECSYPEMSSFDVSKLKFGEDGLPEDSELISELIHSMPPEIVESVFKQFINELIFR

SEQ ID NO: 39989 - protein, 382 aa, Zea mays
MAHGGGGGRAKVTPNLAVDGEGTRTLNLTVLQRLDHAVEDILITAAHVTLYDFDTDINQWSRKDVEGSLFVVKRNAQPRFQFIVMNRRNTDNLVEDLLGDFEYQLQAPYIMYRNAAQEVIGIWFYNSQECQEVANLFSRILNAFSKVPPKPKIPPVQSEFEEVEAAPVLVDGPLEPQTSNIMSTTTHIQEDPLSAFFSAAANAGGNSAVAVARQPIQLFGATPVATHAATSITTIQSPGLHYLLPSQASSVSGMPADAHGSIGRSTNLVNPSLFSPLTSSQTTMVCTNSVVAIAPPQHPQTAQQPQSAPLLQPFLLPTASPSPPYGTPLLQPFPPPNPSPSLASAPVLSPTLSRDKVRDALLRLVENDEFIDLVYGEIMNRQ

SEQ ID NO: 39990 - protein, 95 aa, Vitis vinifera
  misc_feature (82)..(82): Xaa can be any naturally occurring amino acid
MASQKERSQLDAKARQGETVVPGGTGGKSLEAQEHLAEGRSRGGQTRKEQLGTEGYHEMGRKGGLSTGDQSGGERAEEEGIXIDESKSRTKSEIK

SEQ ID NO: 39991 - protein, 641 aa, Bradyrhizobium sp. ORS278
MTTFSKTPLLDTIKTPEDLRRLKVEQVRQVADELRQETIDAVSVTGGHFGAGLGVVELTTAIHYVFDTPRDRLIWDVGHQAYPHKILTGRRDRIRTLRTGGGLSGFTKRAESDYDPFGAAHSSTSISAGLGMAVARDLSGGKNNVIAVIGDGAMSAGMAYEAMNNAGAMNSRLIVILNDNDMSIAPPVGAMSAYLSRLYSGKTYRTLRDAAKQLGQHLPKVIANRASRVEEYSRGFMMDGGTLFEELGFYYVGPIDGHNLDHLLPVLKNVRDMETGPILVHVVTQKGKGYSPAEAAADKYHAVAKFDIATGTQAKAKPNAPAYQNVFGQSLVKEAEKDEKIVGITAAMPSGTGIDIFAKAFPKRTFDVGIAEQHAVTFAAGLAAEGYKPFCAIYSTFLQRGYDQIVHDVCIQSLPVRFAIDRAGLVGADGATHAGSFDNAYLGCLPNMVIMAASDEAELVHMVATQVAIDDRPSSVRYPRGEGRGVEMPEVGVALPIGKGRMIRQGKQVALLSFGTRLAECEKAADELAAHGLSASIADARFMKPLDEELVLKLARDHEILITIEEGSIGGFGSHVMQYLADQGMLDGGLKMRSMVLPDEFQDHDTPAAMYARAGLDAKGIVRKVFEVLGKDYAAEAVKLA

SEQ ID NO: 39992 - protein, 386 aa, Vibrio parahaemolyticus RIMD 2210633
MSELIQNVKASFEQVLGYAPSHIIQAPGRVNLIGEHTDYNDGFVLPCAINYQTVVAAAKREDNIVRVVSVDYGNAVDEFDITQAITFQQDKMWANYIRGVVKCLLARGYQFTGADISVSGNVPQGAGLSSSAALEVVIGQTFKVLFNLEISQAEIALNGQQAENEFVGCNCGIMDQMISAEGRENHAMLLDCRSLETEAVSMPEDMAVVIINSNKKRGLVDSEYNTRRQQCEEAARIFGVKALRDVTIEQFNEKVAELDEMVAKRARHVITENDRTVEAAQALRAHDMKRMGELMAESHASMRDDFEITVKEIDTLVEIVKEVIGDQGGVRMTGGGFGGCIVALVPPALVDDVKAEVEAKYQAATGLKESIYVCQAQNGAGLVEVL

SEQ ID NO: 39993 - protein, 190 aa, Ustilago maydis 521
MSATVEEIADDVQDLNVQEFDSDDAGADVHASDKVASRAERKSRKALQGIGLKKVGGITRVTMRRPRGHLYVIAQPEVYKSSHSDVYIVFGEAKAEDMSQLAQAQAAQQMAQAEAQERLLAESLQNSSASGAEKKVEEEEEDDDSPIDEEGVDAKDIDLVMQQVSCSRRKAVKALKESNGDLINAIMNAS

SEQ ID NO: 39994 - protein, 339 aa, Vibrio parahaemolyticus RIMD 2210633
MKVLVTGGMGYIGSHTCVQMIEAGIEPIIVDNLCNAKLEVLNRIEALTGKQPAFHQGDIRDEAFLDTVFAQHDIQAVIHFAGLKAVGESVAKPLEYYDNNVNGSLVLARSMRKSGVKSIVFSSSATVYGDPEIVPITEDSPTGATTNPYGRSKYMVEQCFSDLFHAENDWSITLLRYFNPVGAHSSGSMGEDPQGIPNNLMPFIAQVAVGRREKLAVFGSDYPTPDGTGVRDYIHVMDLADGHIAALKSVGKTSGLHIYNLGTGKGSSVLEMVDAFAAACGKPVPYELCPRRPGDIAECWASTEKAERELGWKATRTVAEMTADTWNWQSKNPNGYSPA

SEQ ID NO: 39995 - protein, 523 aa, Nocardioides sp. JS614
MTGPTTTSRITPGLAGVPTEVDLVVIGLGITGAGVALDAASRGLSVLAVDAHDLAFGTSRWSSKMVHGGLRYLAKGQVGVAHESAVERGILMEVTAPHLTHPMPMLVPLSSSVTRLQTWLTRSGMWAGDLLRRGARTDAETLPKPRHLTVTEARSLVPALRPAGLRGAVLGWDGQLEDDARLVITIARTAASYGAQVRTHARVLEATGTSVRLRDETRSAEGDETTTVTARSVVNAAGVWAGGLVDGITLRPSRGTHLVLREETLPGLTVSVFCPVPGETNRFVMVLPQPDGTVYVGLTDEPVDGEIPDVPEASETEVGFLLDVVSAAFSHQLHRTDVVGTFAGLRPLLDLGGDGDGARTADLSRRHAVLTSSTGVITVVGGKLTTYRRMAEDAVDAAVAQAGLAASPCRTRELPLLGAAPRAELASLELPSRLVRRYGTDAALVLESAREVSGLADEELLAAVAPHVPVTLAELLFGVTHEGAADVDDLLDRRTRVGLVPADRELAVPAARRALEIAAPAVR

SEQ ID NO: 39996 - protein, 256 aa, Xanthomonas campestris pv. vesicatoria str. 85-10
MSIQILDHGRLREIRLARPPVNALDSALCQALSVAVQQAGEEVDGIVLSGSERIFSGGMDVPHLLAHGTDRAALLASWTAFFDAAQALANSRVPVVAAIGGHAPAGGCVLALCCDYRVMARSADTARPYTIGLNEVQVGLAAPEGIQRLLRRVVGAHRAERLLISGQLLPAEQAVAIGLVDELVDGELVTARAVAWLQELQQLPRQPMLTTRAIARADLRAALAPELIQLERFIDGWYAPDAQAALHGLVARLQKA

SEQ ID NO: 39997 - protein, 387 aa, Erwinia carotovora subsp. atroseptica SCRI1043
MSVIKMTDLDLAGKRVLIRADLNVPVKEGKVTSDARIRASLPTIEIALKQGARVMVTSHLGRPTEGEYNEDFSLLPVVDYLKEKLSSPVRLAKDYLDGVDVAEGELVVLENVRFNKGEKKDDEVLSKKYAALCDVFVMDAFGTAHRAQASTHGVGKFATIACAGPLLSGELEALGKALSKPARPMVAIVGGSKVSTKLTVLDSLSKIADQLIVGGGIANTFVAAQGHNVGKSLYEADLISEAKKLLETCDIPVPSDVRVASEFSETAAATLKSVTEIKDEEQILDLGDVSAERLAEILKNAKTILWNGPVGVFEFPNFRKGTEIIARAIADSDAFSIAGGGDTLAAIDLFGIADKISYISTGGGAFLEFVEGKKLPAVVMLEERAKQ

SEQ ID NO: 39998 - protein, 338 aa, Erwinia carotovora subsp. atroseptica SCRI1043
MTIRIAINGFGRIGRSVLRALYESGRRAEITVVAINELASAEGMAHLLKYDSSHGRFSWDVRQECDQLYVGDDDIRLLHQVEIQQLPWRELSVDIVLDCSGVYGSREDGEAHLAAGAKKVLFSHPGTTDLDATVVFGVNHDRLESGHRIVSNASCTTNCIIPVIKLLDDAFGIENGTVTTIHSSMNDQPVIDAYHHDLRRTRAASQSIIPVDTKLSAGITRIFPQFVDRFEAISVRVPTINVTAIDLSVSVRKAVNVNEINALLQKSAHESFRGIVDYTELPLVSADFNHDPHSAIVDGTQTRVSGQHLIKTLVWCDNEWGFANRMLDTTRAMAACGF

SEQ ID NO: 39999 - protein, 490 aa, Arabidopsis thaliana
  misc_feature (469)..(469): Xaa can be any naturally occurring amino acid
MAEKITRETSLPKERSSPQALILGRYEMGKLLGHGTFAKVYLARNVKTNESVAIKVIDKEKVLKGGLIAHIKREISILRRVRHPNIVQLFEVMATKAKIYFVMEYVRGGELFNKVAKGRLKEEVARKYFQQLISAVTFCHARGVYHRDLKPENLLLDENGNLKVSDFGLSAVSDQIRQDGLFHTFCGTPAYVAPEVLARKGYDAAKVDIWSCGVILFVLMAGYLPFHDRNVMAMYKKIYRGEFRCPRWFSTELTRLLSKLLETNPEKRFTFPEIMENSWFKKGFKHIKFYVEDDKLCNVVDDDELESDSVESDRDSAASESEIEYLEPRRRVGGLPRPASLNAFDIISFSQGFDLSGLFDDDGEGSRFVSGAPVSKIISKLEEIAKVVSFTVRKKDCRVSLEGSRQGVKGPLTIAAEIFELTPSLVVVEVKKKGGDKTEYEDFCNNELKPKLQNLTADDVVAEPVAVSXAVDETAIPNSPTISFLPSDTE

SEQ ID NO: 40000 - protein, 315 aa, Cryptococcus neoformans var. neoformans B-3501A
MAGGIQNITSAAEFDGIVRSLPPSRLLVADFYAQWCGPCHAIAPVLEQLAGAYKHVTFVESRQKIDVDQQRELASRFRITAMPTFKLLKGGREVDQLRGASPPQLSQLVSRHAGTAPPPTATASSGSKSQVATGEITESLLKQVISKGLNCLNEAKEHPLSSILGPEKGPRGNSYLESDVDPELLISIPFQDAVKLKAISIFSGISPSQAPKTVKLFINQPNIGFDDAENEAPAQELILTPEQVKGDRIPLRYVRFQNVRSLHILVKDNQEDEETTRIDSIDVYGAQGEKLDAGVTSQSSAGTGSMLEKLLASGK

SEQ ID NO: 40001 - protein, 338 aa, Populus trichocarpa
MGKIKIGINGFGRIGRLVARVALQRDDVELVAVNDPFITTEYMTYMFKYDTVHGPWKHHELKVKDSKTLLFGERPVTVFGSRNPEEIPWGETGAEYIVESTGVFTDKEKAAAHLKGGAKKVIISAPSKDAPMFVMGVNEKSYTPDLNIISNASCTTNCLAPLAKVIHDRFGIVEGLMTTVHSITATQKTVDGPSSKDWRGGRAASFNIIPSSTGAAKAVGKVLPALNGKLTGMAFRVPTVDVSVVDLTVRLEKSAKYDEIKAAIKEESEGKMKGILGYTDEDLVSSDFIGDCRSSIFDAKAGIALNDNYVKLVAWYDNEWGYSTRVVDLICYIASVSS

SEQ ID NO: 40002 - protein, 275 aa, Crocosphaera watsonii WH 8501
MESNFLSAVFLPLALFFIMMGMGLGLKIVDFKRVLVEPKGVILGLVAQLIVLPLVGFVLASIFPLTPELAVGVIILGACPGGATSNVISYLVRGNVALPITLTAISSLVTIISIPLVINLGMQMFMGADTTLQLPILTTITQIAVITLLPISLGMFINKSQPRLAAKLENIVKWLSLFFLGLIIFGLLLKERANLLPFFLQVGGVTLSLNLITMFLGYAIATFAKLDDKSRKTITVEPEFLTKSAIAKHRSLTGSGFEQSDRRFPQPTVCCQILS

SEQ ID NO: 40003 - protein, 266 aa, Ehrlichia chaffeensis str. Arkansas
MGNLGRSITIHSKEDFKYMHNAGRLAAEVLDFITPYVKPGVSSNELNDLCHDFIINAGAIPAPLGYRGYPKSICTSKNFVVCHGIPDDLPLKEGDIVNIDVTVILDGWHGDTSRMYWVGEPSIKAKRLCEAAYRALTVAIEQVIPGQKLNQIGLAIEKEMKKYGYSIVRDYCGHGLGRVFHASPNVVHYYDPDDPVIIREGMFFTIEPMINAGRCDTVLSKKDGWTVTTRDLSLSAQFEHSLGVTENGVEIFTLSPQNMHYPPYVC

SEQ ID NO: 40004 - protein, 276 aa, Populus trichocarpa
MAETRLMSVYRTTNTVFDTSIKSPFISITSKPIKVVFSTSFPSWVSLKTSNFSTFNTIPLVAQTSDWAQQDEEDTVTLGEESFGDGSEETFPEPPEEAKLYVGNLPYDVNSENLAQLFDQAGTVEVAEIIYNRETDQSRGFGFVTMSTVDEAEKAIEKFHRYDLNGRFLTVNKAAPRGSRPERPSVFKIAYRIYVGNLPWQVDDARLEQVFSEHGQVVNARVVCDRETGRSRGFGFVTMSSETELNDAIAALDGQSLDGRAITVNIAQERPRRGSF

SEQ ID NO: 40005 - protein, 695 aa, Candida albicans SC5314
MTGVLEVVKSITSNEGFVSEVPHLYGGEEHHKVKSHEFDSNSINNTNYNSNVFVPAYDEREVTVKEWFQYIFANPLKMIADYLISLFPILKWILHYNIRWLYGDLVAGITVGVVLVPQSMSYAQLAGLEAQYGLYSSFVGVFIYSFFATSKDVSIGPVAVMSLQVSKVIAHVQDKFGDKYAAPEIATFLSLICGGIALGIGLLRLGFILEFISIPAVMGFMTGSAFNIITGQVPGLMGYNSKVNTRDSTYLVVVNTLKHLPDSTVDAAFGLIPLFILYLWKFSTDYAQKRYPRHKMYFFYFQQLRNAIVIIVATAISWGIVHPKKVAFNGPSSKFKPPIKTIGDVPSGLRHVGVMSIPDGIISAMASEIPVSTVILLLEHIAISKSFGRINDYKVVPDQEVIAIGVNNLIGTFFNAYPATGSFSRSALKAKCGVRTPLAGIFTGAVVLLALYALTKAFYYIPKATLSAVIIHAVSDLIANYKITWSFWKMSPIDCGIFLIAVILTVFVTIEAGIYFAIAASVVVLLVRVAIPHGQFLGKIQIAEVVNPIIEQTGSHDEHNASASDGTSYSSDLEIHQVLSEGTNYKSTDEAGKLKAKEDIKPVEGVTTSALQRNNPQVKFHTRWVPLNNENINAGIKVQPPPPGVLVFKPVETFTYPNASRQVDKVSDEAKRLTRRGKPFDYSKMGQDLGMIQAH

SEQ ID NO: 40006 - protein, 471 aa, Nostoc punctiforme PCC 73102
MAFQSSGLSKVKDSFTQKIFLGNEPNAELIAILTVYFVQGILGLSRLAVSFFLKDELLLSPVQVSALLGIVFLPWMIKPVFGFISDGLPIFGYRRRPYLILSGILGTASWMSLATIVHTSWAATLAIAIGSLSVAMSDVIVDSLVVERARGESQAKAGSLQSVCWGASAIGGLITAYFSGLLLQYFTTRTVFGITALFPLIVSGVAWLIAESPVSKGTNESNQTNPLPIKHQLKQLRQAITQKTIWLPTAFVFIWQATPNAESAFFYFSTNELHFEPEFLGRVNLVTSFASLAGVWIFQRFLKSIPFRVIFAWSTVLSSMLGMTMLLLVTHTNRLLGIDDHWFSLGDSLILTVMGKIAFMQVMVLAARLCPSGVEATLFALLMSVFNSAGTVSQALGALITYWLGITATNFESLWLLVIITNLSTLLPLPFINWLPAAEEQAETSKDGEQAFLPDLMSELVLTEPESEIVE

SEQ ID NO: 40007 - protein, 281 aa, Myxococcus xanthus DK 1622
MDDSNARLVAALLEARQRHCFPADVRRAAPEFVGQVLGLLFPHFAERLECTAAAVHRDVTTVEASLHRIRDTLAPLYPGIERDLPARFMERLPGLYDWLRQDADAIFEADPAARTVDEVILTYPGFTAIAIYRVANALHALGFPLLPRLLTEYAHQRTGVDIHPGATIGRRFVIDHGTGVVIGETTLIGDNVKIYQGVTLGALVVEKGLTDKKRHPTIEDDVVVYANATILGGETVVGRGSIIAGNAWLTQSIPSQSVVTRRSEVRQRGENGSLDALEFHI

SEQ ID NO: 40008 - protein, 415 aa, Pseudomonas syringae pv. tomato str. DC3000
MSEHISESISFVHSMTLSHGRNAEVWDTTGKRYIDFVGGIGVLNLGHCNPQVVKAIQDQAARLTHYCFNATPHDPYIQFMRQLTQFVPVSYPLSGMLTNSGAEAAENALKIVRGATGRSAVIAFDGGFHGRTLATLNLNGKVSPYKQKVGVLPGPVFHIPFPSKDNGVSTEQALKALERLFSVEIDVNDVACIIFEPVQGEGGFLAMQADFAQALRAFCDEHGIVLIADEIQSGFGRTGQRFAFTRLGIEPDLILLGKSIAGGIPLGAVVGRKALIDSLPKGGLGGTYSGNPIGCAAGLASLAQMTDENLSTWGEQQESAIVSRYNAWQASNLSPYLGRLTGVGCMRGIELITPDGNPGTRQLAELLGAARDAGLLLMPSGKSRHIIRLLIPLTIEPDVLHEGLDIFERCLAALA

SEQ ID NO: 40009 - protein, 68 aa, Lactobacillus delbrueckii subsp. lactis
ESPYDYYAVGHTSTSISLATGMAKARDLLGGSERIMAVIGDGSLTGGMAYEGLNNAALEKGNLVIVIN

SEQ ID NO: 40010 - protein, 511 aa, Pseudomonas syringae pv. phaseolicola 1448A
MSQGQHDLLNHYARKILTSRVYDVAIETPLHGARQLSERLGNQVLLKREDLQPVFSFKIRGAYNKLAQLTAEEAARGVVTASAGNHAQGLALAARELGILATIVMPRTTPEIKVEGVRSRGATVVLHGDSFPEALAYSLKLVDEQGFVYIHPYDDPDTIAGQGTVAMEILRQQPGQLDAIFVPVGGGGLIAGIAAYVKYLRPEIKVIGVEPDDSNCLQAAMAAGERVVLSQVGLFADGVAVAQIGHHTFEVCRHYVDEVITVSTDEICAAIKDIYDDTRSITEPAGALGVAGIKKYVEQRGISGQTLVAIDSGANVNFDRLRHVAERAELGEGREAIIAVTIPEQPGSFKAFCEAIGKRQITEFNYRYHTDREAHIFVGVQTHPENDPRSALITSLTGQGFPVLDLTDNELAKLHIRHMVGGHAERVNDEVVLRFEFPERPGALFNFLNRLGGRWTISMFHYRNHGAADGRVVAGLVVSEEERHLVGTALDEIGYPYWDESENPAYRLFLG

SEQ ID NO: 40011 - protein, 263 aa, Oryza sativa Indica Group
MAEHLASIFGTEKDRVNCPFYFKIGACRHGDRCSRLHNRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQLGLGRDLRKKLFGHYRKPQRGRSRSPSPSPRHRRERHDRDDYRGRDDYSGGGGRRGGSSRHERHDDGGRRRHGGSPPRRARSPVRESSEERRAKIEQWNRERDEKQG

SEQ ID NO: 40012 - protein, 402 aa, Desulfitobacterium hafniense DCB-2
MEFRFNTIEEAIEDIRQGKIIVVVDDEERENEGDLLMAAEKATPEAINFMATHGRGLICVPMTAERIQALNLEPMVTHNTDPHGTAFTVSVDGCDCTTGISAFERANTVKVLLDPHSRPENLRRPGHIFPLKAREGGVLVRAGHTEGAVDLARLAGFQPAGVICEILKDDGTMARVPDLMEFVKKHDLKMVTIKDLIHFRRQKEKLVERVVGIELPTDFGDFKAVGYRSLLDGQEHIALVKGDVDDGEPVLVRVHSECLTGDVFHSRRCDCGEQLSAALESIQKEGRGVLLYMRQEGRGIGLLNKLKAYKLQEEGKDTVEANLALGFPADLRDYGVGAQILVDLGIRKVRLMTNNPRKIVGLEGYGLEIQERVSMEMPVKPENQHYLHTKKIKLGHYLPGVR

SEQ ID NO: 40013 - protein, 574 aa, Zea mays
  misc_feature (219)..(219): Xaa can be any naturally occurring amino acid
MALATLLAHLTAGRFGRVLALTSGGAPTASAAHRVLHLLLRTSPPPPLPRLVAIARWSRAHFRAPLPLRLHALLLARLASDGSLHSLLRSELHVLAAGRLHSPASILRALPASSGPLVADMLVLALARASQPLAAYEAFLLAGADCPRYRPSAFSVNALLAALVRADRVDLADRAFRAALRRRVSPDLFTFNIVISGFCKTGQLRKAGDVAKNISAWGXAPSVATYNTLIDGYCKRGQVGKMYHVDALLKEMIQAGISPDVVTFNVLINGYCKEPNITAAIKVFQEMRQQGIPANVVTYNSLVSGLCREGKVEDSIKLVEEMEELGLACILSTMNSVLNGFCKKGMMVEAEGWVDGIAQRGMKPNVITYNTLVDGYRRLGKMKEAAAAKDAMAGKGISPNVKTYNCLITGFTTSRDWRSVSGLLDEMKEKGVKADVVTYNVLIGALCCKGEVRKAVKLLDEMVEVGLEPKHMTYNTIINGFCEKGDAQGAHEIRLRMEKRKKRANVVTYNVFLKYFCKMGKMDEANVVLNEMLEKGLVPNRITYEIINSGMIEKGYVPDISGYAADVSKNLTSS

SEQ ID NO: 40014 - protein, 174 aa, Brassica napus
  misc_feature (18)..(18): Xaa can be any naturally occurring amino acid
MGGSSETKILQELILYAXSAGLSCLVLFAGLKHLDPNREASKKALENKKEISKRLGRPLIHTNPYEDVIACDVINPDHIDVEFGSIGGLETIKQSLYELVILPLKRPELFAYGKLLGPQKGVLLYGPPGTGKTMLAKAIAKESGAVFINVRVSNLMSKWFGDAQKLAAAVFSLA

SEQ ID NO: 40015 - protein, 265 aa, Oryza sativa Indica Group
MAEHLASIFGTEKDRVNCPFYFKIGACRHGDRCSRLHNRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQLGLGRDLRKKLFGHYRKPQRGRSRSPSPSPSPRHRRERHDRDDYRGRDDYSGGGGRRGGSSRHERHDDGGRRRHGGSPPRRARSPVRESSEERRAKIEQWNRERDEKQG

SEQ ID NO: 40016 - protein, 304 aa, Staphylococcus aureus subsp. aureus MRSA252
MTNKVVILGSTNVDQFLTVERYAQPGETLHVEEAQKAFGGGKGANQAIATARMQADTTFITKIGTDGVADFILEDFKAAHIDTSYIIKTAEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 40017 - protein, 485 aa, Nocardioides sp. JS614
MNGLDLLGPTQRGLLIGGTWRDAEGGKRLDVIDPADGSVLTDVADGSVADAVDALDAAVAAQADWAATPPRQRGELLRTAFELIIERSEQFAHLMSLEMGKTVAEAAGEVTYGAEFFRWYAEEAVRIHGRWMQAPGGGSRLLTIKKPVGPCLFITPWNFPLAMGTRKIGPAVAAGCTMVVKPASQTPLSMLALAAVLEEAGLPAGVLNVVTTSHTGEFSETLQADDRLRKVSFTGSTGVGRVLVRQSADRLQRVSMELGGNAPFLVFEDADVDAAVDGAMVAKMRNMGEACTAANRFLVHASVADDFAEKLGKRMGALSLGRGQDDGVDVGPLIDERAVESVSQLVTDAVHDGATVVTGGRPVDGPGYFYPPTVLLGVPADSEINVQEIFGPVAPITTFDSEADAIRMANDTEYGLASYVYTRDLARTIRLAEALEFGMVGVNTGLISNPAAPFGGVKSSGFGREGGFEGIEEYLETTYVALPAG

SEQ ID NO: 40018 - protein, 125 aa, Zea mays
MAGRLSGVASRIMGGNGVVARSNASSLRQRAGMGLPVGKHIVPDKPLSVNDELMWDNGTAFPEPCIDRIADTVGKYEALGWLCGGLGFFATLGLLAVVNDKASKVPFAPRVYPYDNLRVELGGEP

SEQ ID NO: 40019 - protein, 589 aa, Nocardioides sp. JS614
MSSDEQDDTTTPEVTFADLGLSDQVLKALADVGYEKPSAIQAATIPPLLAGRDVVGLAQTGTGKTAAFALPILSRLDLTQTTPQALVLAPTRELALQVCEAFERYAAHVKGVHVLPVYGGQGYGVQLSALRRGVHVVVGTPGRIMDHLEKGTLDLSELRFLVLDEADEMLNMGFAEDVETILADTPDDKNVALFSATMPAQIRRISKKYLDDPAEITVKGKTATASNITQRYLTVSYPQKVDALTRILEVENFEGMIVFVRTKNETETLAEKLRARGLSAMAINGDVAQAQRERTVNQLKSGKLDILVATDVAARGLDVERISHVVNYDIPTDTESYVHRIGRTGRAGRSGDAISFVTPRERYLLKHIEKATRQPLTQMQLPTVEDVNSTRLSRFDDAITEALSQTQRIDAFRDIVAHYVREHDVPEADVAAALAVVAQGETPLLLDPADRANELRAPREERAGQGTRRDRHDHGGPGGHGGPPRERRPRGRSDVPMATYRIAVGKRHKVEPRQIVGAIANEGGLSRQDFGHIDIRGDHSLVELPADLPAGAWDSLRSTRISGKLIELTRDGGGPAADTRHKKPRHKTR

SEQ ID NO: 40020 - protein, 526 aa, Neptuniibacter caesariensis
MTKDIHAQRILILDFGSQYTQLIARRVREIGVYCEIHAWDMSEEDIREFAPKGVILAGGPESVTEGDSPRAPEVVFDLDVPVLGICYGMQTMAAQMGGEVSTSDKREFGYAQVRLESSPSRLLEGIEDHVANNGSLSLDVWMSHGDKVTALPEGFTVIASTESAPIAAMCHPEKQFFGVQFHPEVTHTKQGGRILERFVVEICGTEALWNSANIIKDQIEKVREQVGNQKVLLGLSGGVDSSVVAALLHKAIGDQLTCVFVDNGLLRKQEGDQVMDMFAKNMGVRVIRADAEDLFLGRLEGENDPEKKRKIIGNTFIEVFDDEATKLSDVNFLAQGTIYPDVIESAAAKTGKAHVIKSHHNVGGLPEDMQFELVEPLRELFKDEVRKLGLELGLPYDMVYRHPFPGPGLGVRILGEVKKEYADILREADAIFIEELHKADWYHKTSQAFAVFLPVKSVGVVGDGRRYEYVIAIRAVETIDFMTARWAHLPYELLETVSSRIINEIPKVSRVTYDVSSKPPATIEWE

SEQ ID NO: 40021 - protein, 165 aa, Alteromonadales bacterium TW-7
MRRILSILLENEPGALSRIVGLFSQRAYNIDSLTVGTTDDQSLSRITITTMGDDRIVEQITKQVNKLVDVLKIIDLTEMSHIERELLLVKVFAQDETTRAAVTRVVDVFKGDILDMGRQSYSLQLVSSTDKIESFLDTLRHETDIIEVVRSGAVGIGRGDKALKA

SEQ ID NO: 40022 - protein, 334 aa, Erwinia carotovora subsp. atroseptica SCRI1043
MKTLGEFIVEKQHDFSHATGELTALLSAIKLGAKIIHRDINKAGLVDILGASGISNVQGEVQMKLDLYANEKLKAALKARGEVAGIASEEEDEIVIFEGDKAENAKYVVLMDPLDGSSNIDVNVSVGTIFSIYRRITPLGTSVTEADFLQPGSQQVAAGYIVYGSSTMLVYTTGHGVHAFTYDPSLGVFCLSHEKVCFPEKGNMYSINEGNYIKFPSGVKKYIKYCQEQDEETQRPYTSRYIGSLVADFHRNLLKGGIYLYPSTASYPKGKLRLLYECNPMAFLAEQAGGKASDGKHRILDITPEKLHQRSPFFVGTESMVDDVERFIREFPDA

SEQ ID NO: 40023 - protein, 611 aa, Photobacterium profundum SS9
MSKPTLLTSPTLSQINVFPVKSIAGLSQSQVWVEKQGISFDRRFMVAKKDGSMITARKHPEMVKVMATIQSHGITLSYPGRMPLILKYADFLMEDTNAEVWGDEFSAYTTTIKADIWFSLLLGQEVQLLYTGEQSNRLRPKINQNVSFADGFPLLVISEASLEALNARSSQRSTMDQFRTNLVVSGTEAFAEDSWKRIRIGEVEFLSVKPCSRCILTTVNPKTAEFNALKEPLATMSKFRADASGDVYFGQNLVALNEGKIKAGDIIEVLETKPKEVYADNSELNLTLTCVEREDIAQDFCTFWLEPTKEQTLPTYQPGQHLPLQLEINGEYISRRYTLSSSPSRPGRYAISVKRVNDGRVSNWLHDHLAVGDTLVAEKPDGTFHLGAHTDKLLLLSAGSGITPMLSMLRYLADHNQVHDVVFYHQCSTQNDIPCLDELELLQEAHPHLTVHVVLSRKDKAWKGLSGRLSAELLSHIPTLAERQVFVCGPDAFMKEAKSLLLAKALPESQYHQEAFGPIQIETGEEKSVTISIDGNIFEGNNQQTVLEQAENAGLKMANSCRAGLCGACKVTLASGEVEQPDVPALFSGEKEEGKVLACCCIPKTDIELVS

SEQ ID NO: 40024 - protein, 451 aa, Cryptococcus neoformans var. neoformans JEC21
MSNYPSEPEFQQAVAEITQTLEPFLAKNPEYRRALDVVQVPERIVQFRVTWERDDGTIAINRGYRVQFNSALGPYKGGLRLHPTVNLSILKFLGFEQIFKNALTGLMMGGGKGGSDFDPKGKTDSEIRRFCYAFMQELSRHIGTDTDVPAGDIGTGGREIGFMFGAYKKYRNENAGILTGKGADWGGSHIRPEATGYGLVYYVTEMLRDLDNTDWKGKRVLISGAGNVAQYAALKVIELGGTVLSLSDSTGALVATGDEGFTPEEIMNIADIKLQRKSLTAFATGSKFQWHEGKRPWTLVSNADIALPSASQNELNDEEAKALIKAGVRYVAEGSNMGCTLDAIKIFEESRTAAKNATDAGVCFYAPGKAANCGGVAVSGLEMAQNSQRLKWTHEEVDAKLKAIMINCYQTCWETGKQYAEAGVVPSLVAGANIAGFVKVANAMREQGDWW

SEQ ID NO: 40025 - protein, 335 aa, Alteromonadales bacterium TW-7
MAKQTITVIKGDGIGPSIIDSALEILKAAGCDFDYEFVDAGLAALEKTGELLPQETIDTIAKNKITLKGPLTTPVGEGFTSINVTLRKQFGLYANVRPVKSFVGTKARYDDIDIITIRENTQGMYSGAGQVVSEDGNEAEAKSVITREGAEKIVTFAYELAVREGRKKVTAVHKANILKSTSGLFLKVAREVAERYPQIESTEMIVDATCMKLVMTPEEFDVVVTTNLFGDILSDLCAGLVGGLGMAPGANIGEDAAIFEAVHGSAPDIAGKNLANPTSVILASIQMLEHLNMGDTAERIRSAVADVIKSGDRTTRDLGGSHGTTDFTQSVIDRL

SEQ ID NO: 40026 - protein, 401 aa, Agrobacterium tumefaciens str. C58
MPSTADRLKNVSISASAAMTQRARELAAKGIKVVSLSSGEPDFPTPAHAIEAAHAAALNGETKYPPMDGTVAMKAAISRKFKRDNNLTYDASQIVVSAGGKQVIFNAMLATCNPGDEVVIPAPSWVSYADIVKFAGGVPVPVPCFEQAGFKLRAEDLEAAITPRTKWLFLNFPSNPTGAACSRKEMAAIAEVMLRHPHVWILTDDIYEHLVYDGFEFGTIADVEPRLYDRVLTMNGVSKAYAMTGWRLGYCASGSKELITAISNVNGQNGGGITTVTQAAAIAALDGPQDLLKERAAIYRERRDFVLGQLAEIDGLRCHKPEGAFYIYPNISGLIGKTTKGGRKIESDVDFVMALVDEHHVATVQGAAYGMSPYFRLSYATSMEMLGEGCARIAQFCRDIR

SEQ ID NO: 40027 - protein, 393 aa, Fusobacterium nucleatum subsp. vincentii ATCC 49256
MAKRDYYEVLGIDKNASEDDIKKAFKKAAMKYHPDRFANASDAEKKDAEEKFKEINEAYQVLSDAQKKQQYDQFGHAAFEQGGAGFGGGFNAGGFDFGDIFGDIFGGGGSFGGFEGFSGFGGSSRRSYVEPGNDLRYNLEITLEEAAKGVEKTIKYKRTGKCEYCHGTGGEDDKMKTCPTCNGQGTIKTQQRTILGVMQSQSVCPDCHGTGKVPEKKCKHCRGTGTAKETVEKKINVPAGIDDGQKLKYAGLGEASQSGGPNGDLYIVIRIKPHDIFIRQGDNLYCEVPISYSTAVLGGEVEVPTLNGKKTVKVPEGTESGKLLKVSGEGIKSLRGYGKGDIIVKLTIETPKKLTDKQKELLQKFEESLNDKNYEQKSSFMKKVKKFFKDIID

SEQ ID NO: 40028 - protein, 506 aa, Photobacterium profundum SS9
MIYAQPGTDNAVITFKSHYDNYIGGEWVKPVSGEYFDNISPVNGQMYCQVARSTEADINLALDAAHNIRATWAATSVTERSNILLKIADRIEQNLEYLAVAETWENGKPVRETLVADLPLIVDHFRYFAGCIRAQEGSAAELDQNTASYHFPEPVGVVGQIIPWNFPMLMAAWKLAPALAAGCCVVLKPAEQTPTSILVLMELVGDLLPPGVLNVVNGYGSEAGQALATSNRVAKLAFTGSTDVGHHILKCAAESLIPSTVELGGKSPNIFFADIFDHEDAYLDKCIEGMLLAFFNQGEVCTCPSRVLIHESVYDKFIAKVIERAAVIQQGNPLDTNTQVGAQASQEQFDKILGYLDIGRAEGAQVLIGGQAATLNDELDNGFYIQPTMLKGHNKMRVFQEEIFGPVIAITTFKDEAEALEIANDTEYGLGAGVWTRDANLAYRMGRNIEAGRIWVNCYHAYPAHAAFGGYKKSGIGRETHKMMLDHYQNTKNLLVSYDINPLGFF

SEQ ID NO: 40029 - protein, 475 aa, Oryza sativa
MKPRELLERIARPFSSSSSRRGGGAERRRREEEEADLEAIAAREQRAFRYEALSAATRGFSERQKLGQGGFGPVYRGRLADGREVAVKRLGAGSRQGAREFRNEATLLSRVQHRNVVNLIGYCAHGPDDKLLVYEYVPNESLDKILFSSPPPPPRNFHWLHTVGGLPGGWIRGSTAEKAAPGSSSDGERRRRREELTWARRHEVVVGVARGLLYLHEDAHTPIIHRDIKASNILLDDRWVPKIADFGMARLFPEAGDGRSHVQTRVAGTNGYMAPEYLMHGALSAKADVFSFGVVVLEIVSGHKNSSFVPPPDSDADNLLDHAWRLYKKGRSIELLDPAVKSAAATEQVELLVRIGLLCVQADPRMRPDMKRVVIILSKKQSTLEEPTRPGVPGSRYRRRSYGTRGGGGGSHFSVGSTSGTSSPSTSTTASHATTSAASNAMTTTTSSTHTMRSQGLPLHREERGVELKKDDESG

SEQ ID NO: 40030 - protein, 221 aa, Pseudomonas syringae pv. phaseolicola 1448A
MRILRISSLHTDQEHTVPVVFVAASKLPTPFAEFAMHGFIESATGREHVVLSLGDVADGAPVLGRVHSECLTGDALFSQRCDCGSQLEAALRAIATEGRGVLLYLRQEGRGIGLMNKIRAYELQDGGADTVEANERLGFAADQRDYAICLPMLQHLGVQSLRLMTNNPRKVKALTDMGITVAERVPLHTGQNPHNRLYLATKAGKLGHMMGNEHQSEVGPA

SEQ ID NO: 40031 - protein, 85 aa, Zea mays
  misc_feature (34)..(34): Xaa can be any naturally occurring amino acid
  misc_feature (77)..(77): Xaa can be any naturally occurring amino acid
  misc_feature (84)..(84): Xaa can be any naturally occurring amino acid
MAGRSFLIRSPKEEESNAAVREAVLLGAKNAAIXLVGCRVLPWAKANLNYTAQALIISAACIAGFFITADKTILRNXRQNTIGXA

SEQ ID NO: 40032 - protein, 192 aa, Nostoc punctiforme PCC 73102
MAVFEGTFTQTEPLRFAVVIGRFNDLVTGKLLEGCQDCLKRHGVDPNPQGNQVDYVWVPGSFEVPLVARQLALSHRYDAVICLGAVIRGQTPHFDYVSAEVSKGIAAASFQTGVPVIFGILTVDTMQQALERAGIKGNHGWDYALNALEMASLMRQLRSNLAEPYSRNSQALPASFQSASIGNLTAESEELG

SEQ ID NO: 40033 - protein, 71 aa, Oryza sativa
RLSWENVKKSSDQAVDRYIDKYIETSSPEPLFHVIYGLMAFSYLINLPKERRHLAHLEELERQGAAGAAHH

SEQ ID NO: 40034 - protein, 220 aa, Oryza sativa Japonica Group
MGQQSLIYAFVARGTVVLAEYTEFTGNFTTIAAQCLQKLPASNNKFTYNCDGHTFNYLVEDGFTYCVVAVESVGRQIPIAFLDRVKEDFTKRYGGGKAATAAANSLNREFGSKLKEHMQYCVDHPEEISKLAKVKAQVSEVKGVMMENIEKVLDRGEKIELLVDKTENLRSQAQDFRQQGTKVRRKMWLQNMKIKLIVLGIIIALILIIILSVCHGFKCK

SEQ ID NO: 40035 - protein, 388 aa, Arabidopsis thaliana
MTTISDLSDDLVGDILSRVPFTSLISVRSTCKKWNALSKNQIFGRKTAARNQFLEFMILDSRVCSLRLDLQGIRNEDKEDFVDPSMKLISIPSNDDQVEISQVYHCDGLLLCIAKENSNVFVWNPYLGQTKWIRPRNTFHRYDRFALGYDNNRNHKILRFLYDEESNESSRRTHIDVYDFSSDSWRVLDVNPDCDIPFYQTGVSLKGNTYFFGQEVTQATKVTEIETCLLCFDFTTERFGPCLPLLFYPPCPSFETVTLSWVRDEKLAVLYNHYVTAEIIEIRISTKIEPNAVSWSSFLTVDMSLVNGLPDHFSMYFEAKSFFIDEEKKVVVLFDSKEIKTCRYQMAYIVGDDGYFKSVNIGVSPNSQRKPGRLVCSSYVPSLVQLQD

SEQ ID NO: 40036 - protein, 414 aa, Candida glabrata
VFYWMPWVGSAIPYGTKPYEFFEDCQKKYGDIFSFMLLGRIMTVYLGPKGHEFIFNAKLADVSAEAAYSHLTTPVFGKGVIYDCPNHRLMEQKKFVKGALTKEAFVRYVPLIAEEIYKYFRNSKNFKINENNSGIVDVMVSQPEMTIFTASRSLLGKEMRDKLDTDFAYLYSDLDKGFTPINFVFPNLPLEHYRKRDHAQQAISGTYMSLIKERREKNDIQNRDLIDELMKNSTYKDGTKMTDQEIANLLIGVLMGGQHTSAATSAWCLLHLAERPDVQEELYQEQMRVLNNDTKELTYDDLQNMPLLNQMIKETLRLHHPLHSLFRKVMRDVAIPNTSYVVPRDYHVLVSPGYTHLQEEFFPKPNEFNIHRWDGDAASSSAAGGDEVDYGFGAISKGVSSPYLPFGGGRHRCT

SEQ ID NO: 40037 - protein, 273 aa, Leptospira interrogans serovar Lai str. 56601
MKRSMSFIITFLLSFIFLILFLIWWNQERLIFFPEKLSENFIFHFPNEFKEIKLTTPDGEKSYGLFFPSKNNLSKKTILFFHGNAGSLRTWGRIYEDFLPIGWNLLITDYRGYGKNSGSISEESMNSDAELWLSYLLNEIKIPRNEIVIYGRSIGTGVAIDLVSKNPDLNLFLETPFIDLFTLARNYYPFIQAWMLKFQFQNLAKLKNIRSKIRIFHGTQDPIIPYSNSEIIFKKLKEQNQDVILFTISNGSHNDLTIYPEYHRALKNSLDEL

SEQ ID NO: 40038 - protein, 218 aa, Candida glabrata CBS 138
MDVDKDVDMKEDEVLDEFDDNEDEMPVDNAALFGRAEAAAGTGGDAGAGAGADAEPSEGNAGNAEEKAYIDDGTGKLFQLPEFTRKDKTLGEVLDMMKENPPIIPDAVIDYYLTKNGFECADIRVKRLLALATQKFVSDIASDAYEYSRIRSNVAVQNANNGQTKARQLMNGQQSQLTQQQQQQMEKNSASKVVLTVNDLSSAVAEYGLNIGRPDFYR

SEQ ID NO: 40039 - protein, 592 aa, Desulfovibrio desulfuricans G20
MARLILHGIPVSAGISIGKAFFAWRDNISTLPRGIVTPGAAQSEVERLESAVEAVQNELTQARNRVPAELKDHAAIIDSHLLIAADPKLIKDAARRIQEQNITAEWALEQAVEAIALAFSSIEDDYIRERVQDVRVVADRISKRLMGASGCLKRPLQERMVLMAHDLAPADTMELPLDKIMSFATSEGGKTSHTGILARSMLIPAVVGVSNLEEHVNDGDLVIVDALRGFIIVDPNEDELADYTELKFQFEAYQKALHKECRLPAETVDGYRVEVVANIEMTEEVAQVLDSGGEGVGLYRTEYAYLSRPALPTEDQLYEEYSELASIMAPGKVIFRTLDVGADKMLTEQTLMREPNPALGLRAIRYCLRNIDVFKTQLRAILRASVHGNVALMFPMISGLQELRQAKVLLNEVRMELDRARQPYNPNMPVGIMIELPSAVLIADSLAQEVDFFSIGTNDLIQYSLGIDRGNKHVSYLYQPLHPAIVRSIKFVVDAAHREGIEVSVCGEVAADPYCIPILLGMQIDAISIAPQSIPGIKRIIRRTNMEECKTLLNEVLRTATVARINRVVKDTIFKQFPEELTFYSSLIDHDD

SEQ ID NO: 40040 - protein, 89 aa, Triticum aestivum
MEMNAATSLEPRAKATLVLGGESFAVSSESGALSEQLAAMREKSMVILKEYITKHNVPNDVPDESIEGPSDEEGEVLAKNPPKKSKKQK

SEQ ID NO: 40041 - protein, 404 aa, Vitis vinifera
  misc_feature (214)..(214): Xaa can be any naturally occurring amino acid
MASATLSVAKPSLQANGKGFAEFSGLRNSSACLSFNRKTSDDFLSVVAFQTSAVGSNSGGYRKGVTEAKLKVAINGFGRIGRNFLRCWHGRKDSPLDVIVVNDTGGVKQASHLLKYDSILGTFEADVKAVGDDAISVDGKVIKIVSSRNPLDLPWGDLDIDLVIEGTGVFVDRDGAGKHIQAGAKKVLITAPGKGDIPTYVVGVNADEYNHDEXIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAGFRDSAEKELQGILSVCDEPLVSVDFRCSDVSSTVDSSLTMVMGDDMVKVIAWYDNEWGYSQRVVDLADIVANKWK

SEQ ID NO: 40042 - protein, 858 aa, Oryza sativa
MAEKRLLLPVALTMTQKHGGGEKVWARPWRSSSRAGDASFVEAIVAQARVFDFRSSLVDLLTVSAARALLILCEQSTPAPLRAAPTPPASVASPPAAMDDDSGLLALPVALPVGSSSSVLCDEAAAPRCSPLLLNLNLPALSPSSSDDRWSSVSQHQSISSTSAAAAADGDEAGRFRLNSSGKQRGTAASSAAPKTPSSQSTEDEELMGSATGRARRPPSSSMGVGGEATETGGIGGGPPAPTSSSSPPPPPPHRPSPHHTPHFFDRSIDRSAPLLLQDVDGGCTVSFGSAAIDTTVTSDAAAADEWVRRVRASAATTPRGGGGLLVGLDCEWKPCDHLWPAVAPTVAILQLCAGDSCLILQLLHVAGARRVPPLVGDLLADPSVRLVGIGIGENAAKLADGYGVRCAAPVDLEDVCDRRLGRLPGARRLGLKGYVREVLGLTMEKPMDVTRSDWERRHLDAAQWGRRLASAAARAARRSGAAVGTRRCRWQWGRQLASAAAGTARTTAVGSSGGYGGGERRRWGAAVVGTRQRGVERRRWCKHEHEHGGGPVVAQTRAPPRRTSYSSSALLRRASSRKSPLPSSPPPTAAAAAAAPHRRRSTPPRPHRRSPPPQPPPLPDLRRRHSPTSASTPQQSPPLATATAATTPLRLVPTVTAAGPPPLPRTPVSVPRAAVVPPSLSLLLLLLPPPAKTPWNDLIAMKDDHHIPCCSSRSQDFAVKSGEDRTSDGEMKVGLLDKSMGEKEKKKRSKKPPRPPRPPSASPLDAADQKLISELSELASLKRARIERMKALKKMKNTKPASSIGNLVALIITIIFCLVILWQGRSHGSLFSIQFYKKNETATSPRSSSSAPKCDSL

SEQ ID NO: 40043 - protein, 462 aa, Vitis vinifera
  misc_feature (418)..(451): Xaa can be any naturally occurring amino acid
MNKENIISAKIEEPTVRITRARAKAATKSGGLLPPKPPIKLDQMQRRAALKDVTNVVSENSYMNCISTTKVEARILSFFEVKRAKRGPSNKSSKVALTVLVETPQVQEDAKTKVTGETSNIRTVETQDKTSIKPAQHQILSEEEEDNLFKAQGSPNGPCIADIDSDHKDPQMCSLYASDIYDNFLCRELDRRPSANFMDSVQRDITPNMRGILVDWLVEVSEEYKLVPDTLYLTVNLIDRFLSKNYIEKQRLQLLGVTCMLIASKYEEICAPHVEEFCFITDNTYTREEVLKMESQVLNFLGFQLSVPTTKKFLRRFIQAAQTSYKVPCVELEFLANYIAELTLVDYSFLKYLHSLIAASAVFLARWTLNQSDHPWNATLEHYTTYKASDLKNVVLAMQDLQLNTNGSSLNAIRDKYXXXXXXXXXXXXXXXXXXXXXXXXXXXXXXXXXXDKYKLKKVTMY

SEQ ID NO: 40044 - protein, 252 aa, Kineococcus radiotolerans SRS30216
MSAPTGVGSHATGLYGSRAGENLLRSGAAELLGTFVLVLAGGAVAVGAGTTDPPVYDLLAIVLAFGLALTALVAALGHVSGCHLNPAVTLGLAVTRKFPWRAVPVYVVAQLVGAVLASLATWAVHTGRGREVANLSTTLPAPGVSDGRAFFVEALITFVLVLVVISVATDDRVPAAAAPLAVGAALAVCIFIAAPVTGGAVNPARAFGPAVVSGNLDALWLYLLAPVVGGVLAAVVYDRLLAPAQAPTPEDD

SEQ ID NO: 40045 - protein, 255 aa, Neptuniibacter caesariensis
MGLHVERVGGEGKPELVMLHGWGMNSSIWSGVVENLASNYSITLIDLPGLGRSVSYPEPYTSDGVIQMLADAAPEKASWIGWSMGGQLAIQFADRYPERVERLVTIASNPCFVQKPDWRSAMDEETHNAFEISLSENVAKTLSRFAMLQTQGAEAARDTLKQLKAALKVAEPSAPVESLGLLREDVRSQLSALKMPLLQMFGEKDLLVPVSAALECDALTSRASIVYPGAGHLPFISHQAELVSDLTRFLQEPLA

SEQ ID NO: 40046 - protein, 329 aa, Nocardia farcinica IFM 10152
MTTTTPQLKTSAMIASFVDPGQRTAPAPFGHALVAAARENDKIVGLSADLAKYTDMHIFAEAFPDRFFQMGMAEQLLFGAAAGMAETGLVPFASTYAVFAARRAYDFLCLDIAEPKLNVNIVGGLPGLTTGYGPSHQATEDIAIFRGMPNLTIVDPCDSVDIEQAVPQLAASPGPTYLRLLRGKVATVLDEYDYTFELGRAKVLRDGSDVVFVSSGLMTMRALQAADALAEHHVDVAVVHTPTIKPFDTATVLAAIDTPRLAVTLENHTVIGGLFETVAAAAVTEGLNRRVVSIALPDEFLGAGALPTLHERYGLSTDRVVARVLAELG

SEQ ID NO: 40047 - protein, 380 aa, Populus trichocarpa
MSSTVGKVIRCKAAVAWEAAKPLSIEEVEVAPPQANEVRLRILFTSLCHTDVYFWEAKGQTPLFPRIFGHEAGGIVESVGPGVTDLQPGDHVLPVFTGECGDCRHCKSEESNMCDLLRINTDRGVMLTDGKSRFSINGKPIYHFVGGSTFSEYTVCHIGSVAKINPAAPLDKVCILSCGISTGLGAALNVAKPKKGHTVAVFGLGAVGLAAAEGARLSGASRIIGVDLNPSRFNEAKKFGVTELVNPKDHDKPVQQVIIEMTDGGVDRSIECTGNVQAMISAFECVHDGWGVAVLVGVPGKDDEFKTHPMNLLNERTLKGTFFGNYKPRTDLPGVVEKYMNKELEVEKFITHSIPFSEINKAFDYMLKGEGLRCIIRMEG

SEQ ID NO: 40048 - protein, 788 aa, Oryza sativa Japonica Group
MAAAAILPELAAQVVIPVAAAVGIAFAVLQWALVSKVKLTAEPRRGEAGGAAGGKSGPSDYLIEEEEGLNDHNVVSKCAEIQTAISEGATSFLFTEYKYVGLFMSIFAVLIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVSEIEPALKKQLIISTAFMTVGIALVSWLGLPYTFTIFNFGAQKTVQSWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQDYNCIQWSVLLIRFTFSQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 40049 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGMDEKLLALPIDKVDPTHSYVKDIDDLSKHTLDKIKHFFETYKDLEPNKWVKVKGFEN

SEQ ID NO: 40050 - protein, 374 aa, Coprinopsis cinerea okayama7#130
MWVIGAVIAFAGMRVYIVWGIALPHNGGEKNYLEFLFPRPRRLITSIYAANAVLLAYAAGNSLVFAEYALKAVAPHLLDAPSPPPGKAVIWSYVGFSNANYALSEMRRPERTLRIAGPIAIGVVTVFYLAANLAYFSAASKDAITGSGRLVAALLFKNVWGPRTERILSGFVALSALGNVLSVSFSQGRVNQSLGKEGILFFSKVWASEWPRKAPLAGLALHCIVCSIVVFALPAGDAYNFVLNVISYPLAVINCVISFGLVWTLLPATYTSGVTRKIASHSTILASFLSAPPSDPDPQPSNDVVFPRPTPSLVLSALFFGFANVFLFVLPFFKPPNGAEPYQHLPYWTHAAGGWSVFLVGFAWWYFQTRNYTS

SEQ ID NO: 40051 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKVDPTHSYVKDIDDLSKHTLDKIKHFFETYKDLEPNKWVKVKGFEN

SEQ ID NO: 40052 - protein, 452 aa, Pseudomonas syringae pv. phaseolicola 1448A
MAFDFDLFVIGAGSGGVRAARFAAGFGAKVAVAESRYLGGTCVNVGCVPKKLLVYGAHFSEDFDHAKGFGWSLGEASFDWSTLIANKDREINRLNGIYRKLLVDSGVTLLEGHARLVGPQRVEINGQSYSAERILIATGGWPQVPDVPGREHAITSNEAFYLKTLPKRVVVVGGGYIAVEFASIFNGLGADTTLVYRRELFLRGFDGGVRTHLHEELLKRHMTIRFNSDIERIDKQADGSLLLSMKGGGTLETDCVFYATGRRPMLDNLGLDSVDIKLDEHGYIKVDEHYQSSEPSILAIGDVIGGVQLTPVALAEGMAVARRLFKPEQYRPVDYNHIPTAVFSLPNIGTVGLTEEDAIKAGHDVQVFESRFRPMKLTLTDDQERTLMKLVVDAKTDRVLGCHMVGPDAGEIVQSLAIAIKAGATKQVFDDTIGVHPTAAEEFVTMRTPAKR

SEQ ID NO: 40053 - protein, 151 aa, Lactobacillus delbrueckii subsp. lactis
SAPNVAAVGLAAANGVKISWFGWVAAAIVPALISFILVPIIIYKMYPPKIKETPNAKEWADGQLKEMGAIKASEKVMMAVFILALVLWMLSSFIGLDATWVAFLATALLLVTGVLTTKDMLSZTGAWNVVVWFSILIFMANQLSLKGGVIP

SEQ ID NO: 40054 - protein, 560 aa, Salicornia europaea
MLSQLSSLFYSKMDMLSTSDHASVVSMNLFVALLCGCIVIGHLLEENRWMNESITALLIGLCTGVVILLISGGKSSHLLVFSEDLFFIYLLPPIIFNAGFQVKKKQFFRNFITIIMFGAIGTLVSFSVISLGAMTIFKKMDIGSLELGDYLAIGAIFAATDSVCTLQVLNQDETPLLYSLVFGEGVVNDATSVVLFNAIQNFDLTNIDHRIAIQFSGNFLYLFFASTMLGAMTGLLSAYVIKKLYFGRHSTDREVALMMLMAYLSYMLAELFYLSGILTVFFCGIVMSHYTWHNVTESSRVTTKHAFATLSFVAEIFLFLYVGMDALDIEKWRFVSDSPGTSVAVSSILLGLLMVGRAAFVFPLSLLINFSKKSHSEKITFNQQIVIWWAGLMRGAVSMALAYNQFTRSGHTQLRGNAIMITSTITIVLFSTMVFGLLTKPLILFLLPHSKHFNSASTVSDLGSPKSLSLPLLDGGQDSEADMDNQDEAVNNRYEGTHNRTIARPGSLRMLLNAPTHTVHYYWRKFDDSFMRPVFGGRGFVPYVPGSPIEQNTDNLLDRT

SEQ ID NO: 40055 - protein, 305 aa, Bacillus cereus ATCC 10987
MKLCENVTELIGDTPVVRLSKFIPEDAADVYVKLEMFNPSRSVKDRAAYNLLHVAEENGHIKPGDTIIEPTSGNTGIGLAMNAAAKGYKTILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGAGKKVLCIAPDTGERYLSMGLFE

SEQ ID NO: 40056 - protein, 132 aa, Helicobacter pylori
SNIKYELDKESGALMVDRVLYGAQNYPANYGFVPNTLGSDGDPVDALVLSDVAFQAGSVVKARLIGVLNMEDESGMDEKLLALPIDKIDPTHSYVKDIDDLSKHTLDKIKHFFETYKDLEPNKWVKVKGFEN

SEQ ID NO: 40057 - protein, 233 aa, Brassica napus
  misc_feature (180)..(180): Xaa can be any naturally occurring amino acid
  misc_feature (213)..(213): Xaa can be any naturally occurring amino acid
  misc_feature (223)..(223): Xaa can be any naturally occurring amino acid
MNSPSSSSSSPSSPSKFLDLGSVFGQKEVKKILVLFLGLTASCLLLYKTAYPLPQELDVNNLTSSRPLLDHSSSSSPQRRPKSISFREVLENASTENRTVIVTTLNQAWAEPNSLFDLFLESFRIGQGTQKLLQHVVVVCLDPKAFDRCSQLHPNCYYLETSGTDFSGEKLFATPDYLKXMWRRIPAPHHKCLKWGFNFFLTDADIMWLRDPXPRLYPDGDFXMACDRSSVIL

SEQ ID NO: 40058 - protein, 149 aa, Triticum aestivum
AAELKQRQWRARRRTCVWARTGTRSGISGGHINPAVTFGLFLARKLSLTRAVFYMVMQCLGAICGAGVVKGFQTTLPIGFAVFLVHLATIPITGTGINPARSLGAAIIYNKKQSWDDHWIFWVGPFTGAALAAIYHVVVIRAIPFKSRD

SEQ ID NO: 40059 - protein, 534 aa, Ralstonia eutropha JMP134
MPKAPTPIQPPSRAALLARLEREPRWDVIVIGGGATGLGTAVDAASRGYRTLLVEAADFAKGTSSKATKLVHGGVRYLAQGNISLVREALHERGLLARNAPHLVWPLGFVVPAYQLFDQPFYGIGLKLYDMLAGGLNLDGSRWLNHREVLAAAPTLAEHVGGRPLRGGNLYFDGQFDDARLAIALMRTLFDVGGTAINYLPVIGLSQQGGVVNGVTVRDALGDTTFRLRADCVVNATGVWVDAIRRMEDGQARTMVAPSQGVHLTLPRSFLPGDRAILIPKTDDGRVLFVVPWNGHVIVGTTDTPRKDLPLEPGASGDDVDFILDTASRYLARDPGRTDVTSVWAGLRPLVKATGEASTASLSREHTIVVSRAGLITVTGGKWTTYRKMAEDVIETAIQRQMLRAAPCVTADLPLHGASGLPADLPAPNSVSPDRYYGNELPALRALPGIDHVLAPASGLTEAHVRFAARHELARRVEDVLARRNRALFLDARAAVEAAPQVAAILAEELGHDEAWQASEVENFRKLAAGYMLD

SEQ ID NO: 40060 - protein, 338 aa, Variovorax paradoxus
MNLKKFPRHVLTFGPTPIQPLKRLSAHLGGKVDLYAKREDCNSGLAFGGNKTRKLEYLIPEALEGGYDTLVSIGGIQSNQTRQVAAVAAHLGLKCVLVQENWVNYSDAVYDRVGNIEMSRIMGADVRLDAAGFDIGIRQSWEQAMADVRAAGGKPFPIPAGCSEHPRGGLGSVGFAEEVRQQEAELGFKFDYLVVCSVTGSTQAGMVVGFAADGRADRVIGIDASAKPQQTFEQILRIAKNTAELVELGRDITEKDVVLDRRFGGPEYGLPNEGTLEAIRLSARFEGMLTDPVYEGKSMHGMIEKVRLGEFPAGSKVLYAHLGGVPALNAYSFLFRNG

SEQ ID NO: 40061 - protein, 932 aa, Neurospora crassa
MVFGSLPSDHALEFCALGKAKTLDRPKAFYLNHLSAQEIHEYSPDTLRELKMLPKLPFETLTQIFSHFTLTLPNKSDVFPDYRPVRKHENEDSELARHLQDRRTLRDLCIVCSRCRAVASPMLYHTVILHDASALPFFTRALLENPQAGDIVRDLALLIAFNDEYQERDLFNCVKLGLWADLGQWLFGEAARKTRPREFDWNIRVASDIWHNDRLPVQIRERKSRTTELVNDLKRNLCGWSGKRRVDTRPPMHELIQGLLYCILRETPQVQRLLLQFPPAWGFKQNCFAKFRKLHIDNASSSPNFCSFLSSLILASNSEAPGHLKKGCRLGGQFPLQYFRSLETLMAVGPDATFDPLRENIKSIRHLHLLDTELQPRTLGSMLLRIPQNPASFVLKQRPSAPGNQPELLDFPTEKLPTLSEVLLLKGSELRELSLILCYTHCFRNFIGSGKCLTSLPTLDRLEKLTIQMHLLFGDTRGFSANLLVQRLPPNLVELNILDEWEMDVAERELWLTRYVYHYEEVEHDPIKIWIEEQAYDDDENGERHFCHVLQDHPVLDSNDRYIEAQKRTELYSRYRMKVKAMLLDIAAQCDADKIACQLQRADGQQGRGSLANLRSVTFQIAPNKPLKLIPADENYRYDGDWPHRLEIPPVKDSMENTMAEIKAGSFLCWIPYRWTNLELLKENFGVKDKEMSVRYIRDVVSHSEDESDNESEIGEVDEENESAGREEIGDDDENDGDSESDGNDENGEDEDDEADGEDGEDGEDGGDGDGEEGHEGDENDENDENDENDENDENDENDENDENDENDENDENDENDEDGGNSEYSEGDESDENDEGEEDDENDDGDVDGEASEYSETSETSEKPNPQLLTLWNTFRAIPREHFMDVTAAFARSGVRFDCFGPASEWILAIRDTAKDEVEAKALSHVVEEEL

SEQ ID NO: 40062 - protein, 258 aa, Shigella flexneri
MMNPLIIKLGGVLLDSEEALERLFSALVNYRESHQRPLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLMNVNADQAATALAATLGADLILLSDVSGILDGKGQRIAEMTAAKAEQLIEQGIITDGMIVKVNAALDAARTLGRPVDIASWRYAEQLPALFNGMPMGTRILA

SEQ ID NO: 40063 - protein, 461 aa, Chlamydomonas reinhardtii
MALSMKMRANARVSGRRVAAVAPRVVPFSSASSSVLRSGFALRCLWTSAAWAALASVVEAVKKSVGDLHKADLEGKRVFVRADLNVPLDKATLAITDDTRIRAAVPTLKYLLDNGAKVLLTSHLGRPKGGPEDKYRLTPVVARLSELLGKPVTKVDDCIGPEVEKAVGAMKNGELLLLENCRFYKEEEKNEPEFAKKLAANADLYVNDAFGTAHRAHASTEGVTKFLKPSVAGFLLQKELDYLDGAVSNPKRPFVAIVGGSKVSSKITVIEALMEKCDKIIIGGGMIFTFYKARALKVGSSLVEDDKIELAKKLEEMAKAKGVQLLLPTDVVVADKFDANANTQTVPITAIPDGWMGLDIGPDSVKTFNDALADAKTVVWNGPMGVFEFPQVRQRTVSIANTLAGLTPKGCITIIGGGDSVAAVEQAGVAEKMSHISTGGGASLELLEGKVLPGVAALDEK

SEQ ID NO: 40064 - protein, 354 aa, Glycine max
MAQKKASHVLVCKELKPHLLMVLVQVGYTFLYFITEASFNHGMSPYVYVTYRHIVAAVVMFPFAYFLERNARPKLTFALFMEIFVLSLLGVSVTLNMYFASLKYTNPTFVASMINTIASLTFIIAVALRFEVLDLRNPRGIAKVIGTIISLAGVLIMTLYKGPVMRNLWHPLIHIPGKSAAINEDWLKGSILTVSSCVTWSLWYIMQASTLKRYPAQLSLTTWMSFVGAAQSAAFTVIVEHNSSAWTIGLNVDLWSTIYGGVVVAGLIIYIQLWCTEKKGPVFVTVFNPLSTILVAILAYFVFGEKLYLGSIIGAIIVIIGLYFLLWGKEGDQEVYMKTKDKSQCSTVDPECRI

SEQ ID NO: 40065 - protein, 494 aa, Oceanobacillus iheyensis HTE831
MGKQTGFMEYERQTRPGRNPQERVKDWNDYTAPMSDEEVQKQGARCMDCGVPTCHQGIEIAGVTSGCPVYHLIPEWNNLVYEGKWREALDKEHQMNNFPEFTGIACPAPCEGACVLGINEPAVAIRTVERSIIEKGFEEGWVVPNPPKIRTGKRVAIVGSGPAGLAAADQLNKAGHSVTVYERDKRVGGLLTYGIPEMKLSYDIVIRRVSILEQEGIEFITNTEVGKDITNEELQETYDSVVLCGGASLHRDMPVEGSQLKGVHPAMDFLHANVESLLDSNLEDGSYISAKDKNVIVIGGGDTGTDCLATSVRHNCKSLTQFDIYEKRNLLRDEEANPWPQYPKIHRVEYGQKEAEAQFGEDPRAYAVQTTKFVGDENGHVKEVHTINVKTRYEGGKKIREEIPGTEKVWPADLVLVAIGFQGPDQDLIESLDVETTTRSTVKAKYGEFQTNIDGVFAAGDMRRGQSLIVWAINEGRGAARECDRFLMGDTILP

SEQ ID NO: 40066 - protein, 417 aa, Aspergillus oryzae
MSLSNKLAITDVDLKDKRVLIRVDFNVPLDADKKITNNQRIVGALPTIKYAIENGAKAVVLMSHLGRPDGKANPKYSLKPVATELEKLLSKSVIFAENCVGKETEEIVNKATGGQIILLENLRFHAEEEGSSKDAEGKKVKADKEKVEEFRKGLTALGDVYINDAFGTAHRAHSSMVGVDLPQKASGFLVKKELEYFAKALESPQRPFLAILGGAKVSDKIQLIDNLLPKVNSLIITGAMAFTFKKTLENVKIGNSLFDEAGSKIVGDIVEKAKKNNVKIVLPVDYVTADKFAADAKTGYATDADGIPDGYMGLDVGEKSVELYKKTIAEAKTILWNGPPGVFELEPFANATKKTLDAAVAAAQSGSIVIIGGGDTATVAAKYGAEAKLSHVSTGGGASLELLEGKVLPGVDALSSK

SEQ ID NO: 40067 - protein, 187 aa, Erwinia carotovora subsp. atroseptica SCRI1043
MSVINTQVKPFKNMSFKDGQFIEVTEKNIEGKWSVFFFYPADFTFVCPTELGDVADYYDEFQQRGVEIYSVSTDTHFTHKAWHSTSETIGKIKYTMIGDPTGQLTRNFENMREAEGLADRGTFIVDPQGIIQAVEITAEGIGRDASDLLRKVKAAQYVASHPGEVCPAKWKEGEATLAPSLDLVGKI

SEQ ID NO: 40068 - protein, 285 aa, Solanum lycopersicum
MEGKEEDVKVGANKYSERQPLGTSAQSKDYKEAPPAPLFEAGELHSWSFWRAGIAEFMATFLFLYITVLTVMGYSRANSKCSTVGVQGIAWAFGGMIFALVYCTAGISGGHINPAVTFGLFLARKLSLTRAVFYIVMQCLGAICGAGVVKGFQPSLFGTKGGGANVVAHGYTKGDGLGAEIIGTFVLVYTVFSATDAKRNARDSHVPILAPLPIGFAVFLVHLATIPITGTGINPARSLGAAIVYNKEHAWDDHWIFWVGPFIGAALAALYHQVIIRAIPFKSGN

SEQ ID NO: 40069 - protein, 417 aa, Candida maltosa
MSLSNKLSVKDLNVTGKRVFIRVDFNVPLDGKTITNNQRIVAALPTIKYVEEQKPKCIILASHLGRPNGERNEKYSLAPVAAELEKLLGQKVTFLDDCVGPEVTKAVDSATEGQIFLLENLRFHIEEEGSAKDKDGKKTKADPEAVKKFREQLTSLADVYVNDAFGTAHRAHSSMVGLEVPERAAGFLMSKELEYFAKALENPQRPFLAILGGAKVSDKIQLIDNLLDKVDMLIVGGGMAFTFKKVLNNMPIGDSLFDEAGAKNVENLVAKAKKNNVELILPVDFVTADKFDKDAEVSTADDVTGIPDKWMGLDCGPKSRKLFADAVAKAKTIVWNGPPGVFEFDKFAEGTKSLLDDAVKSAEVGNIVIIGGGDTATVAKKYGVVDKLSHVSTGGGASLELLEGKELPGVTALSNKA

SEQ ID NO: 40070 - protein, 584 aa, Desulfovibrio desulfuricans G20
MKTGIAAFFPFMHWLPGVTARTLRADLLAGLTGAIIVLPQGVAFATLAGLPPEYGIYTAVVPAIIAALFGSSMHLVSGPTTAISLVIFSNVSTLAPAGTPDYICLVLSLTLMAGLIQLALGLARLGSVVNFVSHSVLTGFTTGAAILIASSQLGGFAGLSVPRSGFLPRDMATFVSMLPQASWHAVAIAAVTFVTALLVRRVDKRLPAMLIAMAAGGLLCLVIDGAANGVRMVGALHAGLPPFSVPVFDPERLGILMPGALAVAMLGLAEAVSIARSVGALSHQRIDNNREFIGQGLSNMVGCFFSAYASSGSFTRTGVNYATGARTPLSAIFAAVLLVGMVSVMGGLAAYLPLPAMAGVIMLVAWNLIDIEHIRRIMSAGSGEPLVFAVTLLSTLTVKLEFALIAGVALSLLIYLHRTMHPHFMPMAPVLIDGMRHIIRQENRNLPECPQLKILRLDGSLFFGAAEHVAEELENIVAANPGQNHILIVASGINFIDYSGCETIFEERKLLQAAGVRLYMCSANPGVRAAMERLQCGPIIPIYEDKAEAIATITPQLDMNRCAVCRLRVFHECAGLPGPEMTAE

SEQ ID NO: 40071 - protein, 312 aa, Vitis vinifera
MVGGGSRRDEGSMVINNNNVFAVLESLRKKKKSDKERGSSKKKDPEPQVFWAPARLTVKSWADVDDDDDYYATTAPPQSVWGTSEQSQTMEKPTQVEESESEEDILDEVDDDLEEEHDHEPEVPVQPEPVVKKPVESSLVSKETERQLTKKERKKKELAELEALLADFGVSQKESNGQVESHEKKEEDKKGELNGDGEKKDNAPTESKNAKKKKKRDKLSSKEVKESHDLPDSSDAANGLEEAAAGEQVEEETPAVDMKERLKKMASGKKKKSTKEMDGAARAAASEAAARSARLAAAKKKEKNHYNQQPVR

SEQ ID NO: 40072 - protein, 411 aa, Vitis vinifera
MKFCFLSEFKQFKLCRVGDSFSCILFCFISSQTVGDERCGNFMLICGYVNLIIILLEFFKVGRGKYLGLLKMPVKLQQSSFRDRTPEFLNVAERLKKSFSSTQNGANSASKAEEQRFAVAMQSEFNKRASKIGFGIHQTSQKLSKLAKLAKRTSVFDDPTMEIQELTAVIKQDITALNSAVVDLQLLSNSRNESGNISSDTTSHSTTVVDDLKNRLMSATKEFKEVLTMRTENLKVHENRRQLFSTASKDSTNPFVRQRPLATRSAASASASPPPWANGSPSSSQLFPRKQIDGESQPLIQQQQQQQQQQQQQLVPLQDSYMQSRAEALQNVESTIHELSSIFNQLATLVSQQGELAIRIDENMDDTLANVEGAQGALLKYLHSISSNRWLMIKIFFVLIFFLMVFLFFVA

SEQ ID NO: 40073 - protein, 5826 aa, Streptomyces halstedii
MSESENPVSATTAGADETPDTRTALARRLAGLSPAEQEQHLVDMVHRHTVAALQAVAPLTPDQVDVQRPFLELGFDSLAAVDLHKRLTGETGLELPVTVAFDFPTPVLVAEEIRRIAFGIRPAPLAPVVATGNLDDDPIAIIGIGCRFPGGINSAEELWQLVMDEAEVLSGFPTNRGWDVEGIYDPDPGKPGKSYVREGGFLQDAGDFDADFFGISPREALAMDPQQRLVLETAWEAFERAGIDPGSLHGSKAGVFIGAEVHEYGTRVHEAPEGLDGYLMTGNAPSVASGRIAYSLGLEGPAVTIDTACSGSLVALHLAAHSLRQGESSLAIAGGVTVMGNPGMFAAFSRQRGLAADGRCKPFAAAADGTGFSEGVGVFVVERLADARRNGHPVLGIVKGSAINQDGASNGLTAPNGPSQQRLILQALANAGLKPADVDTMEAHGTGTKLGDPIEAQAILATYGQEREEGRPLWLGSIKSNLGHTQAAGGAASLIKMLMGMRHGKLPRSLHIDAPTPHVDWTTGDVALLTETRDWDAPDRPRRAGVSAFGISGTNAHVIIEEAPEFEPSAVEPVAGSGVTPPWVLSARSADALRGQAERLLSFVSTDADVSVVDVAYSLGVSRAGLEHRGVVLGESREELIAALESLASGAEAPGVVTGRVAEGRLAFLFTGQGAQRVGMGRELAAEFPVFAASLEETCDLLDVGLEDQDHSLREVLFAEEGSAEAALLTRTVYAQAALFAVEVALFRLVESFGVVPDFVAGHSVGEIAAAHVAGVFSLEDATMLVAARGRLMDALPEGGTMVAVQATEEDVLALLEGVEDASIAAINGPDAVVVSGTETGVARVVDVLRDRGAKTKRLDVSHAFHSPLMEPMLTEFRRVAEVLEYQAPRIAVVSNVSGSVAGTELATPEYWVTHVREAVRFSAGVRTLLGAGVSSFLEIGPDGVLSGMARGSVSDGADVGCVPVMRRGRGEVREFLTGLSRIAVRGVPVTWEPLIEGARRVELPTYAFQRRWFWLEAGRSTTDALGLGQTAAEHPLVGAVVGLAGGDGVVLTGRVSLHTHPWLADHQVAGVTLLPGTGFVELAVRAGDEVGCGRLEELTLEAPLVVPDRGAVQLQVVVGALEESDVRTVSVYSRAEEDDVWTRHATGFVGAAVDGGLNLEAWPPPGARAVDVSDVYAGLADQGYGYGPVFQGLRSVWRGDGEVFAEVVLPEGAQADASAFGLHPALLDAALHATDYLDPESAVEGTHLPFAWTGVSLHATGASELRVRITATGNDGYALDLADTTGRPVATVQSLVLRPVTEEQLRSAQGGNGPDSLFRVEWAPVTADLTASGAGWAVLGAGAPELAAALTAAGTPGTAYHGTAELSAAVDGGTTPDVVAVQLPSAGAADADLPDAVRATLNTALEFVQNWLADERLAETRLVVVTRDAVTVDTAAGGPDLTVAPVWGLIRSAQAENPGRILLADIDGTDQSRTALAAITAADEPELAFRNGNAYAPRLVRSVSEGGLVPPSDAASWRLDVLSQGTLENLALIPSDADERTLAPGEVRIAVRAAGVNFRDVLVALGMYPTKADIGGEAAGLVLEVGPGVTDFTPGDRVMGLFDTAFGPHAITDHRTLVPMPTGWTYAQAATAPLVFATAYYGLVDLAELRSGESALIHAAAGGVGMAAVQIARHLGAEVYGTASPGKWNALRAAGLDDNHIASSRDTTFEQKFLANSGGRGVDVVLDALTGEFIDASLRLLPRGGRFAEMGKTDVRDPERVAAEYPGVRYRAFDLFEADLDRLREILRELLALFESGALRPLPVRAWDIRKSKDAFRHIAQARHIGKVALTMPTGGLGDGVVLVTGGTGGLGALVARHVVVVHGVRRLVLVSRRGLGAPGAVGLVAELEGLGAVVEVVACDVSDRVALAGVVGGIGSDLSAVVHTAGVVDDGVVGSLSVGRLSSVLGPKADAAWYLHELTVGLDLSAFVLFSSVAGVVDGAGQGNYAAANVFLDGLAVVRRGLGLPGTSVAWGLWEGAGMGAVLGEADVLRMSRSGVLGLSVGEGLGLFDVALGEDVAALVPVRLDLGALRSRVDGVPAVFRSLVRVPVRRSVGVGVSGGGEVSLERRLVVLDAGERERVLLELVRSHVAAVLGYEGAGSIEPGRAFSDIGFDSLSAVELRNRLNGETGLRLPATLIFDYPTPQALAEYVIVALLGEEAANAPALPPTEAPTVTGTDDDPVVIVGMGCRFPGDVRTPEDLWRLVSNGSDAVTPFPDNRAWDIEGIYDPLPGVSGKTYAREGGFLHDAAEFDPEFFGISPREALAMDPQQRLLLETSWEAIERAGIDPNSLRGTQTGVFAGVMQTDYGNGGARLAEDVEGYIANGTLGSIVSGRVSYALGLEGPAVTIDTACSSSLVAMHWAAHALRQGECSLALAGGVTVMSTPETFVDFSLQRGLAPNGRCKAFSADADGTGWGEGVGVLVLERLSDARRNGHQVLAVIRGSALNQDGASNGLTAPNGPSQQRVIRQALVSAGLTTSDVDAVEAHGTGTTLGDPIEAQALLATYGQERDADQPLWLGSVKTNVGHTQAAAGVAGVIKMVLAMRAGVLPKTLHVTEPSPHVDWSAGAVELLTETRDWPETGRPRRAGVSSFGVSGTNAHVIVEQAPAVEEEPTRALPALPVPWSISAKSADALRGQAQALSSFVSAAGDVSVVDVAYSLGVSRAGLEHRGVVVGESRAELLVALESLASGVESPGVVTGRVAEGRLAFLFTGQGAQRVGMGRELAAEFPVFAASLEQTCDLLERAGVAVREVLFAEEGSAEAALLTRTVYAQAALFAVEVALFRLVESFGVVPDFVAGHSVGEIAAAHVAGVFSLEDAVSLVAARGRLMDALPEGGAMVAVQATEEDVLALLEGVEDASIAAINGPDAVVVSGTETGVARVVDVLRERGAKTKRLVVSHAFHSPLMEPMLADFATVVEGLSYKAPAIPVVSGSVVGSELSTPGYWVRHVREAVRFGAGVETLLGAGVSSFLEIGPDGVLSGMARTSVPEGADVECAPLMRRDRAEVREFLTGLSRLAVRGVPVAWESLVEGGRRVELPTYAFQRRRFWLEAGRSVTDASGLGQTAAEHPLVGAVVGLAGGDGVVLTGRVSLHTHPWLADHQVAGVTLLPGTGFVELAVRAGDEVGCGRLEELTLEAPLVVPDRGAVQLQVVVGALETSGVRTVSVYSRVEEESADDTWVRHATGALMAAAEEPGFDLTAWPPAGARAVDVSDAYAGLASQGYGYGPVFQGLTAAWRKGREVFAEITLPEAAQVDASAFGLHPALLDAALHATDYLDQESAEGTHLPFAWSGVSLHAAGASALRVRIVATGKDGYALDLADSTGRPVATVQSLVTRPVTADQLSEASATQHQSLFRMEWTATTAPAATADVRWALLGEPVAELGDLAGFGRTTAYASLADLAAADADTVPDLVVLPLGSRMAEGSDVPEAVRENLGQVLATIQQWNDDSRFDGSRLVVLTHGAVSVSDDESLTALDLAPVWGLVRSAMAETPGRFLLVDTDGTDPSTDALRHLAELQEAEFALREGEIRVPRLARVPVAGAGADITGGLGDGVVLVTGGTGGLGAVVARHAVVVHGVRRLVLVSRRGLGAPGAVGLVAELESLGAVVEVVACDVSDRVALAGVVGGIGSDLSAVVHTAGVVDDGVVGSLSVGRLSSVLGPKADAAWYLHELTVRLDLSAFVLFSSVAGVVDGAGQGNYAAANVFLDGLAVVRRGLGLPGTSVAWGLWEGAGMGAVLGEADVLRMSRSGVLGLSVGEGLGLFDVALGEDVAALVPVRLDLGALRSRVDGVPAVFRSLVRVPVRRSVGVGVSGGGEVSLERRLAVLDAGERERVLLELVRSHVAAVLGYEGAGSIEPGRAFSDIGFDSLSAVELRNRLNGETGLRLPATLIFDYPTPQALADLIQEKTLGLVDAAAATVSTTVSRTDDEPIAIVGMGCRYPGDVRTPEELWRLVASGTDAVSLFPEDRGWNVDSIYDPTPGLSGKTYTREGGFLHDAAEFDAGFFGISPREALAMDPQQRLLLETSWEAMERAGIDPNSLRGTQTGVFAGIMYHDYGSRVTQPSEEVEGYLGNGSAGSIASGRVSYTFGFEGPAVTVDTACSSSLVALHWAAQALRQGECSMALAGGVTVMSTPETFVDFSLQRGLATNGRCKAFSSDADGTGWGEGAGMLLLERLSDARKNGHEVLAVIRGSALNQDGASNGLTAPNGPSQQRVIRQALANAGLSAAEVDAVEAHGTGTKLGDPIEAQALLATYGQERDGDQPLLLGSIKSNVGHTQAAAGVGGVIKMVMAIRNGVLPKTLHVTEPSPHVDWSAGAVELLAEAREWPETGRPRRAGVSSFGISGTNAHVIVEQAPTDQPAPLSEPVGDVPGLPVPWIVSAKSAEALRAQAGRLGSFLGETGVVDVPAVGWSLVRGRSVFAHRAVVVGGEWDELLAGVARVAEGVDDSVVSGVADVSGRRVFVFPGQGSQWVGMAQGLLDSSVVFTERMTECAAALDPLVEWSLLDVVRGVEGAASLERVDVVQPVLWAVMVSLASVWRSVGVVPDAVVGHSQGEIAAAVVGGWLSLVDGARVVALRSLAIREVLAGGGGMVAVQAAEDEVAGWLEGVEGVGIAAVNGPRSVVISGTRAGLDACVELWSGRGTWVKRVPVDYASHSAEVERVRERVLADLASVTGLSGSVPMLSTMTGDWIVEGQVGAGYWVENLRRPVLFADATRRLASEGFGAFVEVSAHPVLVMGIEETIEALRSGAADGAKSGAGEESSSAVVAVGTLRRGEGGWDQFLRSLAGLFVRGAVAPDWESLLGGVRPRVDLPTYAFQRERLWLDAGVVAGDVSGLGQVVVGHPLLGAGVGVAGEGGGVLFTGRLGLGSHPWLGDHAVSGVVLLPGAAFVELVVRAGDEVGCGRLEELTLAAPLVVPERGSVRIQVVVGAGDGSGARSVGVWSSVGDEGVGGEWVCHASGLLTADVGVAPVLGGVWPPVGGVAVDVSGVYEGLALEGYEYGSVFRGLRSVWRRGDEVFAEVALGEGVGVEGFGLHPALLDAALQAAGFGSFVPESEAGSEAGSGGVRLPFSWSGVSLFASGASVGRVRLWPVGGDGFGVELFDGVGMPVARVDALVTREISAGQLGAAAGAGSLVGGESLFRVEWAPVSGVAPASAGVGGCVVVGAGSVLSGFGEVVPDLAAVSAGSADGVGVPGWVLVDVDAWLGADLAVGVVSGEGVPVVARGVVARVLGLVREWLGDERWVSSRLVWVTRGAVGARVLDEVSGVVSSGLWGLVRAAQSEHPDRFALLDLDSATAVDAVRDGVLGLLAAGEPQLVVREGEVLAARLTPAHTTDEPTGQEFGKAATGTVLVTGGTGGLGAVVARHLVTEHGAQRLLLTSRRGINAPGAAELVAELAELGARADVAACDVSDRAALKELLAGVPGDAPLTAVVHAAGVLDDGVIESMTADRLDAVMRPKVDAAWHLHELTADRELDAFVLFSSAAGTLDGAGQSNYAAANVFLDALAQYRRGQGLAGLSLAWGLWGESTGMVGALEGSDLDRIGRSGVRALSSAEGLALFDAAAVLGEPAVLPVALDLGVLRTQPRNQVPAILRGFAAGPTRRTAVTGGPETDQEALTRRLASLSPADRDRFLLDLVRTQVAGVLGYSGPDAIDPQRGFQELGVDSLAAVQIRNRLGAATGVRPPTTLVFDYPTPDAVAGYFKEHLVIEEEDSTAELMREIARLEAAVTSAASSAGGAGLAPAVDRLRAMAAKLADADAQRADEDDPGLESATADELFDILDGELSTD

SEQ ID NO: 40074 - protein, 531 aa, Pleurotus sapidus
MFPGARILATLTLALHLLRGTHAAIGPIDDMYIVNEDVSPDGFTRSAVVARSVPATGPAPATVSIPGVLVQGNKGDNFQLNVVNQLSDTTMLKTTSIHWHGFFQFGTSWADGPAFVTQCPIASGDSFLYNFNVPDQAGTFWYHSHLSTQYCDGLRGPFVVYDPSDPHLSLYDIDNADTVITLEDWYHVVAPQNAVLPTPDSTLINGKSRYAGGPTSPLAIINVESTKRYRFRLVSMSCDPNFMFSIDGHSLQVIEADAVNIVPITVDSIQIFAGQRYSFVLTADQTVGNYWIRANPNLGSTGFAGGINSAILRYAGATEDDPTTTSSTSTPLLETNLVPLENPGAPGPAVPGGADININPAMAFDFTNFELTINGAPFHAPTAPVLLQILSGATTAASLLPSGSIYELEANKVVEISIPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDDLCPIYDALSDSDKGGIV

SEQ ID NO: 40075 - protein, 428 aa, Neptuniibacter caesariensis
MISTEQVSFDQQHIWHPYSSMINPPPTYPVESARGVRIKLADGRELIDGMASWWSVIHGYNHPELNQAAHQQIDKMSHVMFGGLTHEPAIELCKKLVEMTPSSLDKVFLADSGSVAVEVALKMAIQYQHARGKPEKHKLITIRNGYHGDTFGAMAVCDPVTGMHEIFSGTLPKQFFAPAPQTRFEQAWDENDITPLQSLLAQNHDQIAALILEPIVQGAGGMRFYSAEYLRQARTLCDEYDVLLIADEIATGFGRSGRLFACEHAGIEPDILCLGKAITGGYMTLAATLTSSHIGETISAGGAGCFMHGPTFMGNPLACAVANKSLELLVNNDWQSNVQRIENGLKAGLLEAKNLAKVADVRVLGAIGVIEMKEAVNTSEIQKLFIERGLWIRPFGKLVYVMPPFIMQDEDLATLTSGMVESVAAYQY

SEQ ID NO: 40076 - protein, 398 aa, Legionella pneumophila str. Paris
MDTYQYTFSLPKKLQISPMIKVGVAGSGNLEVIIKPNSNCDKTDIIVNTVISGFRNTWDAVIVRFVEDYPYGGLSITLNDAGATPPVVSLRLRQAIETYQTGYPKKDSYTEANARTRIYSLVDEASFTEFLLDKETPSPTLPQLNMQVETDDGVIIGIAKMNGIDIAIVSQQKDFIGGSVGEIHGAKINGLIKYAIKNQLPAIIFLIDSGGVRLQEANVGEIEISEIIRSILDARSAGIKTIGVICGNNGAFGGMGIISGTLDYLIVNQGARIGVSGAEVIQAVKGVEVFDSSNRPLVWRVYGGRTRFLKADVQGYTTNKTMDIRQAIKTALKTLPTAPSLNLNSILAEHEQLQKRIASAKNCREEGEWLKNNRTELYQQDIFNVSDQQFLALTNKGK

SEQ ID NO: 40077 - protein, 552 aa, Cryptococcus neoformans var. neoformans JEC21
MGQTLSEPMTEKHTTDVVRGKQFWVGLSDMQGWRISMEDAHSVHLYLPPSSDDSKPHSPASDVPAQPEGSTVTNHNEPEVANAMFGVFDGHGGQTVAKFAGTTLHSRLSALDAYKSGDYITALTQAFIKTDEDLRADPSFLNDPSGCTAVVGLITTDGRIIVANSGDSRSVLGYQGQAKALSNDHKPTNEEETARITAAGGFVEFGRVNGNLALSRAMGDFEFKQNFSLAPEKQIVTVVPEIITHELDGEEEFLVLACDGIWDCLTSQQVIDFTRRAIANGDPLGKICENMMVKCLAKDSSTGGIGCDNMTVVIVALLNGRTPEEWQAWVKERVEQKVGHDTPESIPDVFPQNSGPSNSGFAGSGFRVAGGAGGLANIASILGASGITFRPAYDSDDDDDGIQLMGDGPVSPDKLSSPGLIDNEAVEGGTKPKDVTGQLEKEEEETMFGGEGKKGSVRLLDEDGDSSMDSDDSDSTTTGNDPAPQPIPSSSHQATHSPIPPNFSSIGSPTVPTPQELQGLQASNRSEPQGDAYSDAVKVEGLMDKSESPLNL

SEQ ID NO: 40078 - protein, 514 aa, Oryza sativa Japonica Group
MAMVQYVTGYLCLSLALLLLTLVLHKVARKATGNGAGKPRLPPGPWRLPVIGNLHQVAMGGPLVHRTMADLARRHDAPLMSLRLGELRVVVASSADAAREITKTHDVAFATRPWSSTIRVMMSDGVGLVFAPYGALWRQLRKIAVVELLSARRVQSFRRIREDEVCRLVAAVAAAQPGEAVNVSERITALISDSAVRTIMGDRFEKRDEFLEGLAEGDRIASGFSLGDLFPSSRLASFVGGTTRRAEANHRKNFGLIECALRQHEERRAAGAVDDDEDLVDVLLRVQKEGSLQVPLTMGNIKAVILELFGAGSETSASTLHWAMTELIMNPKVMLKAQDELSNVIKGKQTISEDDLVELRYLKLVIKETLRLHPVVPLLLPRECRETCEVMGYDIPIGTTMLVNVWAIGRDPKYWEDAETFRPERFEDGHIDFKGTDFEFIPFGAGRRMCPGMAFAEAIMELVLASLLYHFDWELPDGISPTKVDMMEELGATIRKKNDLYLVPTVRVPMSTAL

SEQ ID NO: 40079 - protein, 514 aa, Oryza sativa Japonica Group
MAMVQDITGYLCLSLALLLLTLVLHKVARKATGNGAGKPRLPPGPWRLPVIGNLHQVAMGGPLVHRTMADLARRLDAPLMSLRLGELRVVVASSANAAREITKTHDVAFATRPWTSTIRVLMSDGVGLVFAPYGALWRQLRKIAVVELLSARRVQSFRRIREDEVGRLVAAVAAAPAAQPVNVSERIAALISDSAVRTIIGDRFERRDEFLEGLAEAIKITSGFSLGDLFPSSRLASFVGGTTRRAEANHRKNFELIECALRQHEERRAAGAVDDDEDLVDVLLRVQKDGSLQMPLTMGNIKAVVLELFGAGSETSANTLQWAMTELIMNPRVMLKAQAELSNVIKGKQTISEDDLVELKYLKLIIKETLRLHPVVPLLLPRECRETCEVMGYDIPIGTTVLVNVWAIGRDPKYWEDAETFIPERFEDGHIDFKGTNFEFIPFGAGRRMCPGMAFAEVIMELALASLLYHFDWELPDGISPTKVDMMEELGATIRRKNDLYLIPTVRVPLSTVL

SEQ ID NO: 40080 - protein, 260 aa, Bacillus cereus ATCC 10987
MNYISPKEEVLKVKRWPKNTIAAGRGHTVALKSDGTVVAVGRNKEGECNVSSWCDIEAVAAGNVHMATNTGNAHTIALKSNNTVEAVGWNKHGQCDVNDWHNIVAVAAGWRRTIGLKLDGTVMAVGRNKEGECNVSSWRNIVATAAGDWHTVGLKVGGTVMGVGNNRYGQCDVSSWRDIVAVAAGYLHTVGLKVDGTVIAVGNDKHNQCDVSGWRGIVAIAAGTNHTIGLKSDGTVVAVGENTYGQCDVSSWRNIRLPGK

SEQ ID NO: 40081 - protein, 179 aa, Novosphingobium aromaticivorans DSM 12444
MRIDMIPTGDNPPESLNVIIEVPVGGEPVKYEFDKASGALFVDRILHTPMRYPANYGFVPHTLSPDGDPLDALVIARSPFVAGSVVRARPIAVLNLEDEHGGDEKLVCVPVDSTFPYYSDVKERDDLPEIVMQQIEHFFTHYKDLEKDKWVRVGTWGDAEDAKRITIEAIERAKAAKAA

SEQ ID NO: 40082 - protein, 202 aa, Brassica napus
MAAGGGGGGSSSGRTPTWKERENNKRRERRRRAITAKIYSGLRGQGNYKLPKHCDNNEVLKALCLEAGWIVEDDGTTYRKGSKPPASDMLGTFSTNSSIQPSPQSSAFPSPAPSYHGSPVSSSFPSPSRYDGNPSSYLLLPFLHNIASSIPANLPPLRTSNSAPVTPPLSSPTSRGSKRKLMTQQLPRHPLLFAISAPSSPT

SEQ ID NO: 40083 - protein, 127 aa, Candida albicans SC5314
MSSVQTTVASEYSSEIQTVPIEHRFNPYSDNGGTVLGIAGEDFAVLAGDTRQVEGYSIQSRYESKIHDVGDDILMTANGFAADGVALIDRFKQSLIWYKFDNNGKKLAIKSAARYIQQLLYGKRFFP

SEQ ID NO: 40084 - protein, 190 aa, Rhizobium leguminosarum bv. viciae 3841
MNAHLQPTGSAYFISPETAAVESHTLSVLVDNEPGVLARVIGLFSGRGYNIESLTVSETEHQAHLSRITVVTRGTPQVLEQIKAQLERIVPVHRVVDLTVRARELGQDRPIEREVALIKVIGEGEMRAETLRLADAFHAKVVDATIGHFILEITGKSSKIDQFVAIMKPLGLIEVCRTGIAAMNRGVQGM

SEQ ID NO: 40085 - protein, 397 aa, Burkholderia thailandensis E264
MNTAADSLLRLASRVDAIEPFYVMEIVKEAAVLERAGRDIIHMSIGEPDFTAPEPVVDAAAAALRRGVTQYTSALGIAPLREAIAAHYARAYGLSIGPERIVVTAGASAALLLACLALVGRDDEVLMPDPSYPCNRHFVATAEGRAVLVPSGPEARFQLTADDVRTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPHTLAIYEARRAEFKRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 40086 - protein, 264 aa, Zea mays
  misc_feature (123)..(123): Xaa can be any naturally occurring amino acid
MSSRELSGHRLPSSSSEDDAPETRDRVVDGPEAEAEMVHFSHPEHRLARFDFPHLFMCMGCKEYGAGKRFMCQACGFQLHESCALAPPSLHEHPFHPKHPHLLFFVKPASGGFLRCRCDVCGXPVRGFSFRCASCSFDMHPCCAAMARRMELPAVHEHPLLLLARDGAEQTSFVCQACRRTRRAGQHAYQCLPCGYYLHARCAKDVVNGLYVHGVVPPEKRSALATAARVTVNALFGVIGGLIEAIGEGIGEAFVENIGRSRRI

SEQ ID NO: 40087 - protein, 708 aa, Bordetella parapertussis 12822
MTYLVLARKWRPRSFDTLIGQDHVVRALTHALDTQRLHHAWLFTGTRGVGKTTLSRILAKSLNCENGITSKPCGQCRACTEIDAGRFVDYLELDAASNRGVEEMTQLLEQAVYAPGAGRFKVYMIDEVHMLTGHAFNAMLKTLEEPPPHVKFILATTDPQKIPVTVLSRCLQFNLKQMPPDAIVGHLQAVLGEEQIGFEVPALRLIGQAAGGSMRDALSLTDQAIAYSAGNLSEEAVRGMLGTIDQRHLVRLLDALASGDAAGVLAVADELAVRGLSYAGALADLAVLLSRVAIEQRVRGALPQDDPLTEDITRLAAALHPDAVQLFYSVAVHSRGELTLSPDEYAGFVMACLRMLALNGEAGPATAVQAPRADTTPRAAAPAAAAPAETRPEPTPALAPQAAAAPRAVARSESKPQPAPEPEPEPEPEPEPEPEPEPEPEPEPASRPAATPVAATPPAVAEPEPVAAPTVQARAAEPAPVPPWEDLPEAVAAPAPAQPAAAPAPVVADDDGPPAWVDEAIPDEAGGGFAPEHSFTADPDDEFETLAPAPAAMPAPRAPTPRRESGGRGRAARSRLADMSPAGWPELVARLPVTGLAAELARQSEWAGVQGDAVLLRVAVRTLAESESRVRLQTVLCEHFGQGLRLEIEVGVTGDGTAHAVAQIERAARQQAAEDAVAVDPFVQALVADFGGRVVPGSIRHVDNPPAA

SEQ ID NO: 40088 - protein, 565 aa, Bacillus pumilus SAFR-032
MNQSYRVHGDVIETPLRGMEVMSVPYLNKGVAFTKEEREELGLKGFLPPKVLTLEDQAKRAYEQFKAQPDELGKNVYLTSLHDRNEVLFYKLLNEHLAEMLPIVYTPTVGTAIQRYSHEYRKPRGLYLSIDDLEGMEEIFASYGVDESIDLIVATDAEGILGIGDWGVGGIAISVGKLAVYTAAAGIDPSRVLAVVLDAGTNQESLLNDPLYVGNQHSRVRGERYDQFIDQYVELARATFPNALLHWEDFGTKNARAILEKYKEQICTFNDDIQGTGAVSLAAVLACAKASKVPLKDHRIVIFGAGTAGIGIAEQIRDAIVRDGVKEEESYGRFWCIDKTGLLTDDSPDIQPFQKPYARRSDEVKDYARNGPKHSIDLLEVVKQAKPTILIGTSTVGGAFTEEIVKEMASHVERPAILPMSNPTPLSEAKPKDLIEWTEGRALVTTGSPFDPVEYGGVTYEIGQANNALVFPGLGLGTIVSKARLMSDSMFVASAEAIASMVNVGKPGAAMLPSVDQLRTVSATVAVRVAQAAIDEGIAEETPEDLIQAVQDAMWHPVYKKIKAI

SEQ ID NO: 40089 - protein, 388 aa, Archaeoglobus fulgidus DSM 4304
MIEIGIAGKPNAGKSTFFKAATLADAEIANYPFTTIKPNVGIGHVRVKCVCQELGVKCNECVDGWRFIPVKLIDVAGLVPDAHKGRGLGNEFLDNLRQSEAVIHVVDASGSTDEEGNEIGVGERNPVEDVKFLYREIDMWLFGILKRNWDKIIRRMKAEKRDAAKFLTEQLAGLGFEEWMVREAMRSFGDVSTLSDEQLRDFAVELRKRRMQMVIAANKADKAPKNLLEELMKLDEIVVPTSAAYELILRTAAKNGYIKYLPGDSDFEIVKELNEKQMKALEKIREFLREFGSTGVQEAINRVVFDLLDYIVVYPVEDENKFTDSKGNVLPDAMLVKRGTTAKELAFKIHTDIGKHFIYALDARTKMRVADDYELKNNDVIKIVSGAK

SEQ ID NO: 40090 - protein, 498 aa, Nocardioides sp. JS614
MTTTIPHWIDGLPQPGAATRLGDVTNPATGQVTGQVVLADGADVDAAVASAKTASTAWARTSISARTQVVFRFRELLNERKAELAAIITAEHGKVLSDALGEVSRGQEVVEFACGIPHLLKGGNSPQVSTGVDVHSIRQPLGVVGIISPFNFPAMVPMWFFPIAIAAGNAVVLKPSEKDPSAAIWMARLWQEAGLPDGVFTVLQGDKVAVDGLLDHPDVAAISFVGSTPIAEYVYERASRTGKRVQALGGAKNHMVVLPDADLDLAADAAVSAGYGSAGERCMAISVVVAVGGTGDDLVERIAARTTGLRVGDGTRESDMGPLVTAAHRDKVASYVDAGEAEGAALVVDGRKVDADGEQDGHWLGPTLFDHVTPQMSIYTDEIFGPVLSVVRAETYAEAIELVNANRYGNGTAIFTGNGGAARAFEQDVEVGMIGVNVPIPVPMAYYSFGGWKASLFGDTHAHGIEGVHFFTRGKVVTTRWPDPGSAGGLELAFPKNH

SEQ ID NO: 40091 - protein, 435 aa, Nocardioides sp. JS614
MSTAYDLDRKHVFHSWSAQAEITPMVISAARGSYVWDEDDRRYLDFSSQLVFTNIGHQHPRVVAAIKEQADRLCTIAPQHANEQRSQAAALIADLAPAGFEKVFFTNGGADANEHAVRMARLHTGRFKVLTAYRSYHGGTQTAINLTGDPRRWPSDTATAGTVHFFGPFLYRSEFHATTVEEECERALHHLARTLEAEGPHTVAAILLETIPGTAGIFEPPPGYLAGVRELCDRYGIVLILDEVMAGFGRAGTWLALDRYGVTPDLITFAKGVNSGYVPLGGVIISDPIADTFAHRPYPGGLTYSGHPLATAAAVATIHTMREEGIVANAERLGREVFGPGLADLAERHPCIGDVRGVGVFWALDLVTDRATRAMLEPAALGEVVAACKTAGMLPFSNTNRIHLVPPCTMSEEEAREGLAILDDALKAGDVHAQA

SEQ ID NO: 40092 - protein, 309 aa, Bacillus pumilus SAFR-032
MKVAQNIAELIGDTPLVQLQRLQPDNAAAVYLKLESFNPSGSVKDRAAYNMIVEAEKQGKLTKGATIIEPTSGNTGIGLAMNAAARGYQAILVMPDTMTKERINILKAYGAQVILTPGEEKMPGCIRKAEELAAQIPHSFIPMQFDNRANPDAHRGTTAVEIMDAVKQIGKPLGAFVATAGTGGTITGTGEELKKAFPQLTIRVAEPKGSPVLSGGTPGKHKLVGTSPGFIPQILNEHVYDEIVQVSDEDAYTITRQLARLEGILVGPSSGAACYAAIETAKQLPADQIVICMTADTGERYLSSDVYQD

SEQ ID NO: 40093 - protein, 446 aa, Candida albicans SC5314
MASVPPLFKVPNTKRTSNNKVLPNLSIPPTSNNKNGNPNTKPSLSLNQNIINHDSQQHENLNPLSYQPHQLQHQQYQNPQGLKLSTSPSSVSSSKSTKRKPPPIDTKVISHSPDMMDVDQQGSADESVNVDENEYSVKHHLEQLTPYDWHLIANANKIVEISSLGEGNGGAVTKCYIPQLPNKQIFALKLVMCDPNPDLQKQIFRELEVAKKCQHPNIVKYYGTFLLEKQSMIGIAMEFMDGQSLDSIYKEVLKRDKTNRINEKVLGKIANSILSGLDYLHSKNIIHRDIKPSNILLDTKGNVKLCDFGVSGEAVNSFASTFVGTQYYMAPERITGGNYSITSDIWSLGMSLLEVANGCFPIIQSLGPIEVVEIISRSNLELKDCEEDNIFWTREFKQFIAKCLTKDYLRRPKPSDLLAHDEWCLIQSKEKVKMDKFVKVVWELNE

SEQ ID NO: 40094 - protein, 310 aa, Zea mays
PRVRGDARNPRPRGSSAEAQQGSGGGRRREPLRRGAVSARLPVPDHIRRPPYVGTAAVPEVCPDRQVHDGESIMRMLDACELAARVLHHAGAMVKPSVTTDEIDRAVHQMIVDAGAYPSPLGYGGFPKSVCTSVNECTCHGIPDSRELQDGDIINIDVTVYLNGYHGDTSRTYLCGEVDDATKQLVKVTEECMMRGISACRHGASFKEIGQRISEHAEKYGYGIDPFVGHGVGRMFHSEPIIWHTYDYEPGFMVAGQTFTIEPTLSMGSTQCVVWDDGWTAVAADGSLSAQFEHTVLVTTDGAEILTGFP

SEQ ID NO: 40095 - protein, 213 aa, Gossypium hirsutum
GYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 40096 - protein, 195 aa, Pseudomonas fluorescens
MNIPNLITVLRVLLIPIFILLFYLPYNWSYMAASSVFAFAAATDWLDGYLARRLEQSTPFGAFLDPVADKLMVAVALVLLVQEHGNLWLTLPAAVIIGREIVVSALREWMAELGRTRPGGRCPTWANRKTAAQMLALVILLANPPAFTFWVLLGYAFLLIAGGLTLWSMLQYLRAAWPHLKTDGRKEIKLFESRG

SEQ ID NO: 40097 - protein, 275 aa, Kineococcus radiotolerans SRS30216
MTQATPQVTLHDGVGIPQLGFGVWQVPPEQTAEVVLRALQAGYRHIDTAAGYGNEAGVGDALRASQIPREDVFITTKLANSEHGRDKTLAAFDASMAKLGLDYLDLYLIHWPLQADDYVETWKAFEEIKASGRVRTIGVSNFQKTHLRKLLDETGTVPTVNQVEVHPYLVQEDLRSFHAEHGIATEAWSPLAQRAGLVEDPVVTGIAEQLGRTPAQVVIRWHLQQGNVVIPKSVTPERIVSNIDVFGFELPPEQVDALTGLDRAERTGPDPDVLG

SEQ ID NO: 40098 - protein, 515 aa, Glycine max
MLSSRIWQRRALISARTLFSASASHSSSSSPAIPFRFSKANASSSSHLIFNFARVNIYWFSTQPALELPASKIVDVPLAQTGEGIAECELLKWYVQEGDYVEDFQPLCEVQSDKATIEITSRYKGKISSFLYVPGDIVKVGETLLKILVDESAFPSGTPCDSENAKSPDSDQTLVNESVLTTVVDDSDNAKLIDSDPGKGRQTGVLSTPAIRSLAKQHGIDITEVCGTGKDGRVLKEDVLNFAVKKGIIKNPSTVLHSDSGEQLQGAEGYNCNVATKFYRSSEDRTLPLRGFQRAMVKSMSLAAKVPHFHYVDEINCDALVELKTSFQKNNPYPDVKYTFLPILIKSLSMALSKYPFMNSCFKEDALEVVLKGSHNVGIAMATPHGLVVPNIKNVQSLSIMEITKDLARLQQLASDNKLTSEEIYGGTITLSNIGAIGGKFGSPLINLPEVSIIAIGRIQIVPRFADNGNVYPASLMNVNIGADHRVLDGATVARFCNEWKQLIENPELLTLHLK

SEQ ID NO: 40099 - protein, 319 aa, Legionella pneumophila str. Paris
MGILIDGIWHDENNINTDKEGRFVRAESGFRQHITASGESGFKAEPDRYHLYLSYACPWACRTLIMRKLKGLEKIISVSFSDPVMGKNGWSYGESGNETADEINHIHYLKELYLLARKDYTGRVTVPVLWDKKKKTIVNNESSEIMRMLNSEFNAFSSTDHDYYPKQWRQKIDEINQLVYENINNGVYKCGFAKSQKAYEEAFDALFNTLNQIENILATQRYLIGEQLTEADWRLFTTLIRFDAVYHGHFKCNLQRIIDYPHLSNYLRELYQFPGIKETVNFNHIKQHYYRSHLSINPTGIVPKGPKLNLDEPHNRHEF

SEQ ID NO: 40100 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGMDEKLLALPIDKIDPTHSYVKDIDDLSKHTLDKIKHFFETYKDLEPNKWVKVKGFEN

SEQ ID NO: 40101 - protein, 300 aa, Rhodococcus sp. RHA1
MGELDSAGFRTAVVPAAGMGTRFLPATKTVPKELLPVVDTPGIELVAGEAAESGAERLIIVTAPGKDGVVAHFVEDLVLENNLAARGKHALLEKVRRAPGLLAVESVVQQQPLGLGHAVGCAEAVLGDDEDAIAVLLPDDLVLPNGVLDVMSRVRAKRGGTVLCAIDVPKEEVSAYGVFDVEMVPDVVNPNVLRVKGMVEKPKLQDAPSTLAAAGRYLLDRAIFDALRRIRPGAGGELQLTDAIALLISEGHPVHVVVHRGPRHDLGNPGGFLRASVDLALSHPEYGADLRTWLENRVKG

SEQ ID NO: 40102 - protein, 179 aa, Rhodococcus sp. RHA1
MTRSRTSTVFQDWSANATNPKARIVLAAFRVAHLCRSTRNWRINPVVLAVGVLYRVLVEWILGIEIPWKTKIGPNFVVYHGIGIVINDATVIGSGVTLRHNVTIGSKTHDGPAPRIEDDVEVGAGAIILGDIVIRKGAVIGAGAVVSQDVPAGAVVVGNPARVVNATLDAVSVDAVADQ

SEQ ID NO: 40103 - protein, 507 aa, Gibberella zeae PH-1
MFHLLIYPLWVLVALFAVIIANLLYQQLPRRPDEPPLVFHWFPFFGNAVAYGLDPCGFFEKCREKHGDVFTFILFGRKIVACLGVDGNDFVLNSRLQDANAEEVYGPLTIPVFGSDVVYDCPNSKLMEQKKFVKFGLTQKALESHVQLIEREVLDYVETDPSFSGRTSTIDVPKAMAEITIFTASRSLQGEEVRRKLTAEFAALYHDLDLGFRPVNFLFPWLPLPHNRKRDAAHIKMREVYMDIINDRRKGGIRTEDGTDMIANLMGCTYKNGQPVPDKEIAHMMITLLMAGQHSSSSASSWIVLHLASSPDITEELYQEQLVNLSVNGALPPLQYSDLDKLPLLQNVVKETLRVHSSIHSILRKVKRPMQVPNSPYTITTDKVIMASPTVTAMSEEYFENAKTWNPHRWDNRAKEEVDTEDVIDYGYGAVSKGTKSPYLPFGAGRHRCIGEKFAYVNLGVIVATLVRNFRLSTIDGRPGVPETDYTSLFSRPAQPAFIRWERRKKI

SEQ ID NO: 40104 - protein, 223 aa, Zea mays
MDWAYYGSGYSTPASGGGGGDEDAYMTVSSAPPKRRAGRTKFKETRHPVYKGVRSRNPGRWVCEVREPHGRQRIWLGTFETAEMAARAHDVAALALRGRAACLNFADSPRRLRVPAQGAGHDEIRRAAVEAAELFRPQPGERNVGGSEAAAEAAAAAPCAMGSGDLGGGEFPYYPVDDGLEFEMRGYLDMAQGMLIDPPQPAAGQSAAWIEDEYECEVSLWSY

SEQ ID NO: 40105 - protein, 588 aa, Geobacter metallireducens GS-15
MDSARNETRIFRGIEASAGIAIGTARLTDRSRVAVTEVSIGDEEVELECARFLAALQDAREELLAVKEHLASSRGPEHLYVVDSHLLILEDGMLTRGTLDLIAGEKINAEAALKRNLLKFKEFFSAIEDEYLRERAGDVETVVERIMRAMVGKRQECIGSIDGGKIVIVAHDLSPTDILQIDKNNVIGFITDLGGRTSHTAILARALEIPAVVGLETITGEDIDGLPIIIDGTDGTVVVNPDQDTFRDYLRRKQRYDYLEQEFLKLRDLPAETIDGHRISLMGNIEFAEEIPTLKGHGGEGIGLYRTEMLYMNRQGLPDEEEQYLAYSAIVEAMAPLPITIRTLDVGGDKLATDLHLEDEMNPALGLRAIRLSLRKPEVFKTQLRAILRASVRGKVRIFFPMISGVEEVRAAKAILEEAKNELRAEGVPFDNAIDVGIMIEIPSAVLVADILAREVDFFSVGTNDLIQYSLAIDRTNEHLAHLYQPMHPAVLRSLRTVVDAAHAAGIRACMCGEVAGESRYLPILLGLGFDELSMTGVSIPRVKKVLRRAVKADAQLLVSRAFTFSTAAEVEAFLNSEISARFSESFD

SEQ ID NO: 40106 - protein, 326 aa, marine gamma proteobacterium HTCC2080
MVEDRIQVGAGHMPTLGLGLWKLPEQSVASTVVDAVAAGYRHVDSAADYGNEEAVGEGLRQVLKTTDVVRDDLWVTSKLWNTFHRPEHVRAACERSLRDLGLDYLDLYLIHFPIALKYVDFSDRYPPEWIYDPTAEVPRMEPDLVPIAETWGAMEGLVEAGLVKEIGVCNFNTGLLHDLIASSRRPPALLQVESHPYLTQERLIRLAHQYDMAVTAFSPLGSLSYLELGMAEAQECLLDESVVCAAAERLQRSSAQVLLRWGLQRGTAVIPKTSQLERLRENIDVFDFSLSDAEMNAISALNRNRRFNDPGLFCEEAFGSFYPIYD

SEQ ID NO: 40107 - protein, 401 aa, Myxococcus xanthus
MTALSQSEPSLSASSDSSTDALVQKAKRHLLQNYKQPPFVLARGQGARVWDMDGREYLDLIGGIATCALGHCHPEVVAAAKAQLDSLWHVSNVFYSQPQIDLAAQLTEWSGLSRAFFCNSGAEANEALLKLTRKVMKDRGTPERFEVISFDSSFHGRTLATVTATGQAKYQKGFEPLPAGFTHVPYGDLEAVRKAVGPATAAILVEPIQGEGGVRMAPLGFLVGLRALCDEHGLLLLVDEVQTGMGRTGKPFGFMHEGIVPDGISVAKALGNGLPIGAMLCKEELGASLTPGTHGSTFGGNPVAAAAANAVVRILRRPGFLDEVQEKGAYLLARARELQGRLPAGRIQAVRGQGLLVGVQLDHKVAPVIAQVHEEGLLVNPAGDRTMLFAPPFIVTVRELD

SEQ ID NO: 40108 - protein, 422 aa, Campylobacter upsaliensis RM3195
MQIEDLKKDIILRKNTLYLDFAASALALKSVEKRIKSILPFYANTHSESSLNAFKMQKLYEEARIKIKKSLNLNEDFALIACGTGSSGAIKKFQELLGLYAPPVLKQKYLSQIDSKSLPLVLVGPYEHHSNELSFREALCECVRVPLDKQGEIDFAFLKQILNLNQKRQVIASFSLASNVTGILSDYEKISTLVRRYGGLVAFDASSFIPYKNIPCKFYDALFISAHKLIGGVGSCGLLAIKKTLCGTTPSFAAGGTVGYVSRTSHNYLCNEENLEEGGTPGILQLIRASLAFEIRDKIGLDYIEKKEEFLKNYFFQKCQEVPNLELYAKNLTKRLAIFSFNIKKLSPFDLAYDLSKKFHIETRAGCACAGPYGHDLLHLKDNQKLTFKPGWLRVSFHYTHEKEDIDHFFKALQESIARLSF

SEQ ID NO: 40109 - protein, 340 aa, Burkholderia vietnamiensis G4
MNTSNIASPSSAPALPRIAVLATGGTIAGAAPDAASTAGYQAGALGVNFLLDAVPALASVARVDAEQVASIDSKDLALPLWNTLAARIDALMADPAIDGIVITHGTDTLEETAYALHLVVTGDKPVVLTAAMRPATALSSDGPLNLLNAVTVAAHPAARGQGVLLAFNNRIHAARDVVKTSTYAVDAFHSPELGALGWVQDGRVEFARRATRSRDAQLKIAAAWPAVEVVASYAGATRTAVDALVAAGVRGLVVAGTGNGSIHATLQAALADAANAGVAVVRASRVGSGHVMRNGAANDDALGFVSAGSLNPFKARVLLMLALANGIDGRDALQRVFDTL

SEQ ID NO: 40110 - protein, 359 aa, Zea mays
MGVYLSTPKTDKLSENGENDRLKFGLSSMQGWRATMEDAHSALLDLDSETAFFGVFDGHGGRVVAKFCAKYLHGQVLKSEAYSTGDLGTAVHRAFFRMDEMMQGQRGWRELSALGDKINKFSGMIEGLIWSPRGSDSNNQQDDWASEEGPHSDFAGPTCGSTACVALIRNTQLVVANAGDSRCVISRGGKAYNLSRDHKPELAAERERIMKAGGFIHMGRVNGSLNLSRAIGDVELKQNKFLPPEKQIVTANPDINVVELCDDDDFVVVACDGIWDCMSSQQLVDFIHERINTESSLSAVCERVLDRCLAPSTIAGDGCDNMTMILVQFKKPVDRNKKAEAAGQSASNVDEAKSRVAEE

SEQ ID NO: 40111 - protein, 461 aa, Mycobacterium tuberculosis H37Rv
MATATTQRPLKGPAKRMSTWTMTREAITIGFDAGDGFLGRLRGSDITRFRCAGRRFVSISHPDYVDHVLHEARLKYVKSDEYGPIRATAGLNLLTDEGDSWARHRGALNSTFARRHLRGLVGLMIDPIADVTAARVPGAQFDMHQSMVETTLRVVANALFSQDFGPLVQSMHDLATRGLRRAEKLERLGLWGLMPRTVYDTLIWCIYSGVHLPPPLREMQEITLTLDRAINSVIDRRLAEPTNSADLLNVLLSADGGIWPRQRVRDEALTFMLAGHETTANAMSWFWYLMALNPQARDHMLTELDDVLGMRRPTADDLGKLAWTTACLQESQRYFSSVWIIAREAVDDDIIDGHRIRRGTTVVIPIHHIHHDPRWWPDPDRFDPGRFLRCPTDRPRCAYLPFGGGRRICIGQSFALMEMVLMAAIMSQHFTFDLAPGYHVELEATLTLRPKHGVHVIGRRR

SEQ ID NO: 40112 - protein, 243 aa, Zea mays
  misc_feature (71)..(71): Xaa can be any naturally occurring amino acid
  misc_feature (76)..(76): Xaa can be any naturally occurring amino acid
  misc_feature (99)..(99): Xaa can be any naturally occurring amino acid
  misc_feature (166)..(166): Xaa can be any naturally occurring amino acid
  misc_feature (171)..(171): Xaa can be any naturally occurring amino acid
  misc_feature (182)..(182): Xaa can be any naturally occurring amino acid
TYLDGCDYPSWHAIHIFDSRGNPTVEIDMFGSNVTIVRLAVLTGAYPGVYDALELRDDGSDYLYKAVTKGXENVNXVIGPALIAKVPYRSDCMIDNFMXHHVDGTIYECLWSKHNLAANAILYVTLAVCIAGNSINSIPLYHHIDNLCDNNNLMMPAAAFHVIDGXGSHAXNKLAMQEFMIXLPTGAGSLNEAMNMNGEHYHHLKYRIINEYAKEATNDEAKCALAPNIPHNEEGLELLKTAL

SEQ ID NO: 40113 - protein, 250 aa, Comamonas sp. NCIMB 9872
MGRVNDKVVLVTGGAMGMGLTHCTLLAREGATVYLSDMNEELGHQAVAEIRRQGGKAHFLHLDVTNENHWTGAVDTILAESDRLDALVNNAGILTLKPVQDTSNEEWDRIFEINVRSVFLGTRAVIEPMRKAHKGCIVNVSSIYGLVGAPGAAAYEASKGAVRLFTKACAVDLAPFNIRVNSVHPGVIATPMTQQILDAPQSARALLGPTLLGRAAQPMEVSQAVLFLVSDEASFVHGSELVVDGGYTAN

SEQ ID NO: 40114 - protein, 194 aa, Neptuniibacter caesariensis
MLVMIDNYDSFTYNVVQYLGELGADVHVYRNDEITIEEIEALNPDHLVISPGPCTPNEAGVSVAAIKHFAGKLPILGICLGHQSIGQAFGGDIVRAKQVMHGKTSPVYHHDDGVFTALNNPVEVTRYHSLVIDQATIPDCLEITSWTQNEDGSIDEIMGVRHKELDIEGVQFHPESILTEQGHDLLANFLKRSK

SEQ ID NO: 40115 - protein, 224 aa, Neptuniibacter caesariensis
MPDFKIAPSILSADFARLGEEVENVLSAGADIVHFDVMDNHYVPNLTIGPMVCSALRKHGIQAPIDVHLMVKPVDRLIGDFIEAGASYITFHPEGSEHIDRSLQMIRDGGCKSGLVFNPATPLSHLEYVLDKVDMVLLMSVNPGFGGQKFIPGTLDKLRQARKIIDESGYDIRLEIDGGVGVGNIKEIAEAGADTFVAGSAIFNTDDYADTIAQMREQLAMADL

SEQ ID NO: 40116 - protein, 486 aa, Cryptococcus neoformans var. neoformans JEC21
MGRQRRKNRTHLKGPPKGETEENVPKSFVIKSGHVTKSISQLVRDTRKVMEPNTASRLRERPNARLRDYLTIAPSLKVTHLLAFTLTDAANVHLRVARFPQGPTMTFRVQKYSLMKDLFNSGLRNVGRSPAGEYRNPPLLVLNGFQQPQNGPALPQLRLMSTMFQGIFPPIQVEKSALPTFRRVLLISYSHVTGCISFRHFTITVRPHGVSRRVRKLLSSTVTSANPTSSKSRKTVDLSNTDDIADYLLRRTGSETSGASTAGYDSASETEASEAESDTNAVELPEDYVGRGNKKGERKAVRLVETGPRMEWRLIKVVEGLVGSKKGEGETVFHEFVHKSAKDANAQAQAHERKRKAKEARRAEQAANVARKKAERAKKKGKAVGDGEEDEDNDSEEEPDIEGLSDIDPEEELERLRERKVGFQDEDDDEDFEYEDRGANADDEDDDDWGEDVGAGEGDVTSDDEESSEDEEAKPPPKKRASGKRK

SEQ ID NO: 40117 - protein, 270 aa, Oryza sativa
CKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 40118 - protein, 560 aa, Bacillus anthracis str. Ames
MKFSSKQRKDVLNGVNKQELDVIVIGGGITGSGIALDGATRGLSTIVFEMQDFAAGTSSRSTKLVHGGLRYLKQLEVKMVAEVGKERAIVYENGPHVTTPEWMLLPFHTGGTFGSFSTSIGLRVYDFLAGVKRSERRKMFNREETLKKEPLVKQEGLKGGGYYVEYRTDDARLTIEVMKEAIEHGAKAVNYAKVDGFLYKDGKVCGVRVIDLLDGEVYEVYGKKIVNAAGPWVDTLREKDNSKKGKVLQLSKGVHLVIDQKRFPLGQAIYFDTPDKRMVFAIPRGGKTYVGTTDTFYDKDAAVPQMTTEDRTYIINAINYMFPSVKITEKDIESSWAGVRPLIYEEGKSASEISRKDEIWTSESGLITIAGGKLTGYRKMAEMVVDYVTNLLQKEGHSAYPKSSTKHMPISGGHVDGSKGLPAFIAKKAGEGTKYGLTTAQAEEFAKFYGSNVDVLFDLAKKHKDEAKEYNMPLDVLIPLVYAMDYEMTAKPVDFFVRRRGAVFFNIHWVYEWKEAVINYMAAKLGWSKEEQMKYTAELEKALTDAVIPVDQQEHAAALA

SEQ ID NO: 40119 - protein, 501 aa, Ehrlichia chaffeensis str. Arkansas
MTNHSVILCILDGWGNSENSQFNAIAQSYKPCWDNTILQYPKSQLITHGLNVGLPDGQIGNSEVGHVNLGSGRIVLQDLCKINNEIKYIKNNRYLLEFIKKIKQNNGICHIAGLLSDGGVHSLHTHMLDIIDTLSNFQIQIAVHIFLDGRDTPPISAIKYINILREHIKHLNNVNIATISGRYYSMDRDNKLDRTRTAYKAMAFADAKRYTDPSLAIQDSYNAGITDEFILPCVIGDYNGMNPQDGFIMTNFRSDRAIQIIKMIIGDIKTDNHITLENTIGMVKYSESINIPCLFPNNNITNTLGEVIANHKLHQLRIAETEKYAHVTFFFNGGREDTFENEDRIIIPSPSVTTYNLMPEMSAKEVTNTVIERIKLQKYSLIILNYANADMVGHTGNIEATKQAITALDQCLNKILNCIQGTNYVLVITADHGNAEEMFDVKNNMPYTAHTLNPVPFIICNYSKQIRLKNGRLCDVAPTILEILNIEKPKEMTGISLIEYI

SEQ ID NO: 40120 - protein, 328 aa, Medicago sativa
NSNEFGNFIAIDDELKLPEDQPEPMTLEHTEPMHSDPLEMEEVEMEDIEGEMILDIDSCDANNSLAVVEYIEDLHAYYRKIEYLGCVSPTYMDEQLDLNERMRAILVDWLIEVHDKFDLMQETLFLTVNLIDRFLAKQNVVRKKLQLVGLVAMLLACKYEEVSVPVVSDLIHIADRAYTRKDILEMEKLMLNTLQYNMSLPTAYVFMRRFLKAAQADKKLELVAFFLVDLSLVEYEMLKFPPSLVAAAAVYTAQCTVSGFKHWNKTCEWHTNYSEDQLLECSMLMVGFHQKAGAGKLTGVHRKYGSAKFSFTAKCEPACFLLENKNQP

SEQ ID NO: 40121 - protein, 132 aa, Helicobacter pylori
SNIKYELDKESGALMVDRVLYGAQNYPANYGFVPNTLGSDGDPVDALVLSDVAFQAGSVVKARLVGVLNMEDESGIDEKLLALPIDKVDPTHSYVKDINDLSKHTLDKIKHFFETYKDLEPNKWVKVKGFEN

SEQ ID NO: 40122 - protein, 145 aa, Lactobacillus delbrueckii subsp. lactis
NDGDKVIVPTPVWSMYMQLVCLTGATPVEVDTSDTGFILTPEKLEEVIEREGKGVKAVMLNDPTNPTGVTYPKEVIEGLAEVIKKHHMYAISDEIYSELIYGDAKHYSLATYIPDRTIFISGLSKSHAMTGWRLGYICGPAEIMA

SEQ ID NO: 40123 - protein, 441 aa, Rhodococcus sp. RHA1
MSTRIAVFGTGYLGATHAACMAELGHEVLGVDVDPAKLAKLTAGEVPFYEPGLDEVLRRNIAADRLRFTDSYQEAADFANVHFLGVGTPQKKGEFAADLTYVDAVINTLAPLINAPAVIFGKSTVPVGTAQRLQARAHELSPAGHDLEVAWNPEFLREGFAVQDTLHPDRLVLGVDRDRPGRAETVAREVYAQLIDEDIPFLVTDLATAELVKTSANAFLATKISFINAIAEVCEAAGADVTVLADAIGHDARIGRRFLNAGLGFGGGCLPKDIRAFMARAGELGADQALTFLREVDNINMRRRTRMVELAREACGSLLGARVAVLGAAFKPDSDDVRDSPALNVAGQIQLQGAAVTVYDPKANNNSRKLFPTLGYADNVLDACEGADVVLVLTEWPEFQKLQPADIEGVVRKQSLIDGRNCLDPFQWRAAGWTYRGLGRP

SEQ ID NO: 40124 - protein, 305 aa, Xylella fastidiosa 9a5c
MQHRRWTRATATMIASFSSIAMPHVSLLPSPSPIAFIGGGNMARSMIAGMIRQGAPSTSICVIEPIAALRDALIADFNIKAVTTATEAATDTSTWVLAVKPQVMPDVCATLPLPVQPNTPLVISIAAGITTCKLKHWLGDTCAIVRAMPNTPALLGAGVTGLFATSHTTATQRTLAEELFNSVGKTLWITEEALMDAVTAVSGSGPAYAFLLAEAMEAAAIMQGLSTANARTLVQQTLLGAARMMTELGETPAALRHRVTSPHGTTEAAIATFQENDFQALVAKAIDAATRRARALGKANDTEPT

SEQ ID NO: 40125 - protein, 691 aa, Oryza sativa
MDTPLLLLLPFLAACLLAPRHAAEAAVTSCAPRRCGNVTIAYPFWLPDSSPPPSSSSAPCGPAAFQVNCDNGSRASLARSFRSGYKILGVSYANRTVVVANDNVQTDASGCPVPKIDVSASLTLAPFTASPANSQLVFLFNCTSSSRPPPAGFVNVTCPGAKAVVRLDTSYNNTAARVVAGGCDYAAVPVVGVPGASPTDYPQLLRGGYMLEWRAPAGDCMACNASGGQCGYDADTEAFACICSDGSSRPGICGWLELTKGNAKKSGNKVILIVSLSICATGLVLLACIAIVYKCRRRMQNRFSFLNAMDGASRTDTAKVEKLLQSYGSLAPRRFRYSELKKITKSFSQRLGEGGYGTVFSGTLADGRAVAVKFLHHSKPNGEEFLNEVVSIGRTSHVNIVSLLGFCLEGSKRALVYEYMPNGSLDKYIYSTSAAAAAEAEEAEATASPDRDVLGWKVLQEIAVGVARGLEYLHDGCNTRIIHFDIKPHNVLLDEGFRPKIADFGMAKLCNPKESILSMADTRGTIGFIAPEVFSRGFGDISTKSDVYSYGMLLLEMVGGGSNVKAYAEKGASGTFFPLWVYDHLLEDGGVLQSVAAAAAATAGGGAGSPGGEEIARKMALIGLWCIQTVPANRPSMGKVLEMLERSVHELAMPPRPYHSNSSSPSRPSSYPSSASDFTQRSRLSTPGSTA

SEQ ID NO: 40126 - protein, 139 aa, Pisum sativum
NTDITSITSNGGRVKCMQVWPPIGKKKFETLSYLPPLTRDQLLKEVEYLLRKPWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 40127 - protein, 127 aa, Saccharomyces cerevisiae
MLFYKPVMRMAVRPLKSIRFQSSYTSITKLTNLTEFRNLIKQNDKLVIDFYATWCGPCKMMQPHLTKLIQAYPDVRFVKCDVDESPDIAKECEVTAMPTFVLGKDGQLIGKIIGANPTALEKGIKDL

SEQ ID NO: 40128 - protein, 296 aa, Xylella fastidiosa 9a5c
MQDLKKKVILVTGASDGIGKFTAATLAKQGHKLIIHGRNRQKTEAALAEIKRQSGNPDVAMFLADFLPLAGVKAFADAIKEKYDHIDVLINNAGAQFTEQREVTSEGHEKTMAINVFAPMLLTKLLMPLLVKSESARVVTVASDAHRMAGKPDLDDIELKQGYHMAKAYSLSKLYVIWVMHHFIGETKKAGIHNVTFNLVHPASTRTNLGREAVKSWKWKIIFFLWQIMLVSMDKAASSTLYAATAPELEGVSGRYFGPKGEEQPSAKYHSPENEQKVWDYALNAIRPYLPAGAQS

SEQ ID NO: 40129 - protein, 713 aa, Saccharomyces cerevisiae
MTASVSNTQNKLNELLDAIRQEFLQVSQEANTYRLQNQKDYDFKMNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 40130 - protein, 110 aa, Brassica napus
  misc_feature (106)..(106): Xaa can be any naturally occurring amino acid
MQAAIRSFVSGGNVVKASLLQHLCVINPAIQPSSVFCTRSESTQTSRMEEHGFESTTISDVMKAKGKSADGSWLWCTTDDTVYDAVKSMTQHNVGALVVVKPGERXSLAG

SEQ ID NO: 40131 - protein, 450 aa, Salmonella enterica subsp. enterica serovar Paratyphi B str.
MTKHYDYIAIGGGSGGIASINRAAMYGQKCALIEAKELGGTCVNVGCVPKKVMWHAAQIREAIHLYGPDYGFDTTINQFDWSKLIASRTAYIDRIHTSYDNVLGKNNVDVIKGFARFVDAKTIEVNGETITADHILIATGGRPSHPSIPGVEYGIDSDGFFALSALPERVAVVGAGYIAVELAGVINALGAKTHLFVRKHAPLRSFDPMISETLVEVMNAEGPQLHTHAVPKAVVKNADGSLTLELEDGRSETVDCLIWAIGREPSTDNINLAAAGVKTNEKGYIIVDKFQNTNVEGIYAVGDNTGAVELTPVAVAAGRRLSERLFNNKPDEHLDYSNIPTVVFSHPPIGTVGLSEPQAREQYGDEQVKVYKSSFTAMYTAVTTHRQPCRMKLVCVGPEEKIVGIHGIGFGMDEMLQGFAVALKMGATKKDFDNTVAIHPTASEEFVTMR

SEQ ID NO: 40132 - protein, 691 aa, Staphylococcus aureus subsp. aureus MRSA252
MLRGQEERKYSIRKYSIGVVSVLAATMFVVTSHEAQASEKIPTTNAAAQKETLNQPGEQGNAITSHQMQSGKQLDDMHKENGKSGTVTEGKDMLQSSKHQSTQNSKIIRTQNDNQVKQDSERQGSKQSHQNNATNKTERQNDQIQNTHHAERNGSQSTTSQSNDVDKSQPSIPAQKVIPNHDKAAPTSTTPPSNDKTAPKSTKEQDATTDKHPNQQDTHQPAHQIIDAKQDDNVHQSNQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKYKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLNGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 40133 - protein, 381 aa, Geobacter metallireducens GS-15
MSLYLDNAATSYPKPEPVYEAVNRAMRDVGVSPGRGGYRRGIEASRLLFETRESVAALFGIGDSSRVVFTHSATEALNLAVLGLVRPGDHVVTTSAEHNSLVRPLHLAGQRGVEISWIEADRRGFVSPDQIAAAIRPSTRLIALAHCSNVTGAIQPVTEIAAVARRAGVLTLVDAAQSAGMIPLDVSAMGIDLLAAPGHKGLMGPPGTGILCVAEGVDLEPLFVGGTGGYSSGVEQPDAMPERFESGTHNLPGIAGLGAGVDFIRTVGLEVIRKREEELVAFLMDGLGALPGVTCHGPLPDEPRGGLVSFTVEGVDPQTIGFRLDQEFDICVRVGLHCAPAAHRTIGTYPGGAVRVSPGYFTTDEEIGTFLQAMGKIISSP

SEQ ID NO: 40134 - protein, 199 aa, Ralstonia eutropha JMP134
MPFNIPILLTWLRVAMIPLVVGVYYLPEAWLPMHTKNITAASFFIIAAVTDWLDGFLARRWNQTSAFGAFLDPVADKLMVTAALLSLLALGRVADLVALVIIGREITISALREWMAQIGASKSVAVNFLGKLKTTVQMIAIPLLLYTDRLFGVDAQVLGTWMIYLAAVLTLWSMFYYMKLAWPQIRERSGVLNEARAPK

SEQ ID NO: 40135 - protein, 296 aa, Leptospira interrogans serovar Lai str. 56601
MVIHADLEEAICEGLDKLGILNSGYRPKVTFHSSSLNEIYLAKLPDHSFGVKVISNKEMAETEKESLEQLYRIGVRVPECYGTVQTGNFWLLVMDYIEPGSVPTAREDLIRSLKLLYRKDSNSWGWKRNNFIGTLSQKNQWYSSFEKFFWESRLSIQLNLALSRKLITTKDTENVKEVFQKFTEEWSLNQSNPRLIHGDLWSGNILTGKNGHSYLIDPSISFSHPEQDLAMLNLFGSSLNLEEMQRILSHSGIENPEHFKDRIPFWQMYPILVHINLFGPSYLSSLRQILRYYGKS

SEQ ID NO: 40136 - protein, 377 aa, Bacillus sp. SG-1
MKAVTYQGSKDIQVKEVEDPKIQKPDDIIVKITSTAICGSDLHLYQGNLPLRPGYIIGHEPMGIVEETGPDVTRVKKGDRVVLPFNVSCGHCFYCQHDMESQCDNSNPHKDTGGYFGYTEQYGNHPGGQAEYLRVPFGNAMPFKVPESCDLADEALLFMSDVLPTAYWSVEHSGMKPGDTVIVLGCGPIGLMAQKFAWMKGAGRVIAVDNLPYRLNKAKQNNNVEIFNFDEFKEMGQHLKEVTGGGADIVIDCVGMDGEKSAVEKVEQKLKLQGGTLSAINIAKDAVRKFGTVQLTGVYGMMYNMFPLGNFFERNVTLKMGQAPVVHYMPELFEKITSAELNPTEIITHIMPLEKAAEAYKIFNDHDDECIKVVLKP

SEQ ID NO: 40137 - protein, 449 aa, Mycobacterium tuberculosis H37Rv
MTVSIAPPSRPSQAETRRAIWNTIRGSSGNLVEWYDVYVYTVFATYFEDQFFDRADRNSTVYVYAIFAVTFVTRPVGSWFLGRFADRRGRRAALTFSVSLMAACSLIVALVPSRSSIGVAAPILLILCRLVQGFATGGEYGTSATYMSEAATRERRGYFSSFQYVTLVGGHVLAQFTLLVILAVFTREQVHEFGWRIGFAVGGGAAIVVFWLRRTMDESLSQERLTAIKAGRDHDSGSLRELATHYWKPLLLCFLVTLGGTVAFYTYSVNAPAIVKSVYGSQAMTATWINLVGLILLMMLQPIGGMISDKIGRKPLLLWFGVGGLIYTYVLVTYLPETRSPTMSFLLVAVGYVILTGYCSINALVKSELFPAHVRALGVGVGYALANSVFGGTAPLIYQALKERDQVPMFIAYVTACIAVSLIVYVFFIKNKADTYLDREQGFAFYGHA

SEQ ID NO: 40138 - protein, 320 aa, Burkholderia vietnamiensis G4
MPLNPKIAQVLDMIERAKRPSYHHQTPQQARAAYEKSAPILDVAPAPMHSVDACVVPTRDGRTIGARLYLPVAPSLAEPLPALVYYHGGGFTVGSVDTHDALCRMFARDAQCAVLSVDYRLAPEHKFPTAVHDAEDALRWLHREAAAFGIDAARLAVGGDSAGGTLATVCAVLARDAGIHLALQLLIYPGVTGHQATESHARLANGYLLTQDTIQWFFSQYVREPADRDDWRFAPLDGTRGAPSSFAGVAPAWIATAEYDPLSDEGAAYAQKLRAAGNTVALVCYPGMIHEFFKMGGYIPEVRAAHADATAALRAAFDGV

SEQ ID NO: 40139 - protein, 339 aa, Rhizobium leguminosarum bv. viciae
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 40140 - protein, 337 aa, Agrobacterium tumefaciens
MLEKFERYPLTFGATAIEYLPRLTEALGGDVEIWAKREDCNSGLAMGGNKLRKLEYIVPDAIASNADTLVSIGGVQSNHTRMVAAVAAKLGMKCRLVQESWVPHEDAVYDRVGNILMTRLMGADSRIVDDGFDIGIRQSWEDAIQSVIDEGGKPYAIPAGASVHKYGGLGYVAFAEEVARQEADLGFKFDYIIVCVVTGSTQAGMIVGFAAQDRADRVIGIDASGTPEQTRSQVRQIVDNTAELVELGRPVREDEIVILNDYAYPAYGVPSNETNEAIRLAARTEAMITDPVYEGKSMQGMIDLTRKGFFPKGSKVLYAHLGGAPALNGYSYTYRNG

SEQ ID NO: 40141 - protein, 549 aa, Erwinia carotovora subsp. atroseptica SCRI1043
MKNINPSQTAAWQALQTHFDAMKDVKISELFAQDSDRFAHFSATFDDQMLVDYSKNRITAETMGKLHALARETDLPAAIHAMFAGEKINRTEDRAVLHVALRNRSNTPILVDGKDVMPEVNAVLAKMKDFSERVIGGEWKGYTGKTITDVVNIGIGGSDLGPFMVTEALKPYKNHLNMHFVSNVDGTHIAETLKPLNPETTLFLVASKTFTTQETMTNAHSARDWFLKTAQDEKHVAKHFAALSTNAKAVGEFGIDTNNMFEFWDWVGGRYSLWSAIGLSIILSLGFDNFEKLLSGAHAMDKHFASTPAEKNLPVLLALIGIWYNNFFGAETEAILPYDQYMHRFAAYFQQGNMESNGKSTDRNGNPVDYQTGPIIWGEPGTNGQHAFYQLIHQGTKLVPCDFIAPATSHNPLSDHHSKLLSNFFAQTEALAFGKSREVVEAEFTAAGKSAKEVEHVAPFKVFEGNRPTNSILLRDITPYSLGALIALYEHKIFTQGAILNIFTFDQWGVELGKQLANRILPELESDSTIDSHDSSTNGLINRFKAWRN

SEQ ID NO: 40142 - protein, 215 aa, Lentisphaera araneosa HTCC2155
MEVKADFSREEIVCATCKGHLGHVFKGEGFTPKNVRHCVNSLAIKFIPQQVQKKAIFASGCFWGTDYWLRTVPGVLDTKSGYIGGSESNSTYEDVCTGTTGHYEAVEVTYDETLVDYETLARMYFNTHNPEQANGQGNDIGSQYLPAIFCLDEEQKRISEKLLSELRALGYKPATELIKAPRFWSAENYHQDYYIKNGKKPYCHFYKTKFNKAKP

SEQ ID NO: 40143 - protein, 274 aa, Oryza sativa Japonica Group
MAASRLALLLLVLAVAAARHALPAAGSDAHPGYDGAEDTCGVPAAAAAAGRMEEYGGGRILDITHAYRADLPAFAPGAVTGPVVRLRDSMANGTLYNLSELKMECHMGTHVDAPGHMNQGHFAAGLDVDKLDLDLLNGPTLLVDTPRNTNITAKAMESLNIPKGVRRVLFRTLNTDRKLMWKKGGDLSYVGFTEDGAQWLVDNTDIKLVGIDYLSVAAYDHLITAHVVFFKFPNIILVEGLKLDDVKAGIYMLHCLPLRLVGSEGSPIRCILIK

SEQ ID NO: 40144 - protein, 182 aa, Arabidopsis thaliana
  misc_feature (15)..(15): Xaa can be any naturally occurring amino acid
MASSMLSSAAVVTSXPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 40145 - protein, 131 aa, Glycine max
MSLLVNSPLLPLQSTRWLKPKQEARFLSHGPTIIGGGMSTNIFGTAKRNGNGNGVKAFFINPEQDLIIKEALKEPVAFLGGMFAGILRLDLNEEPLKEWVTRTAEAAGISEEEANTEESTTEEAPQEIQIE

SEQ ID NO: 40146 - protein, 440 aa, Rhodococcus sp. RHA1
MRCTVFGTGYLGATHAACMAELGHDVLGVDIDPGKVAKLSSGEVPFYEPGLGEVLRRNIDAGRLHFTTSYSEAAEFADLHFLGVGTPQKKGEYAADLRHVHSVIDTLAPLLDRPAVIVGKSTVPVGTAAELGARARALAPAGNAVEVAWNPEFLREGFAVADTLHPDRMVLGVDRQRPGRAETELRELYARLLGEDIPFLVTDLATAELVKVSANAFLATKISFINAISEVCEATGADVTQLADALGYDARIGRRFLNAGLGFGGGCLPKDIRAFMARAGELGANQALHFLREVDSINMRRRTRMVELAAQVCGGSLLGANVAVLGAAFKPESDDVRDSPALNVAGMMQLHGAVVSVYDPKALDNSRRLFPTLNYATSAVEACDNADAVLLLTEWAEFVALKPEDLNDVVRARVMVDGRNCLDAADWRTAGWVYRGLGKG

SEQ ID NO: 40147 - protein, 500 aa, Panax ginseng
MFPLAYPLLFVLLGALSWWILPIISPLKRHHKLPPGPRGLPIIGSLHTLGALPHRTLQTLAKKYGPIMSMRLGSVPTIVVSSPQAAELFLKTHDNIFASRPKLQAAEYMSYGTKGMSFTAYGPHWRNIRKFVVLELLTPAKINSFVGMRREELGMVVKSIKEASAANEVVDLSAKVANIIENMTYRLLLGRTKDDRYDLKGIMNEALTLAGRFNIADFVPFLGPLDIQGLTRQFKDTGKRLDKILEFIIDEHEQNSSNGNASGDFIDDMLSLKNKPSNTHDELSKVIDRSVIKAIMIDIISAAIDTSDTSIEWILTELIKHPRAMKKCQEEIDAVVGVDRMVEETDLPNLEYVYMVVKEGLRLHPVAPLLGPHESMEDITINGYFIPKQSRVIVNSWALGRDPNVWSEDADEFLPERFEGSNIDVRGRDFQLLPFGSGRRGCPGMQLGLITVQLVVARLVHCFDWNLPNGITPDNLDMTEKFGLTTPRVKHLLAVPKYRL

SEQ ID NO: 40148 - protein, 333 aa, Nostoc punctiforme PCC 73102
MQLKPINQQVVSVVGASSGIGRITALEFARRGAKVVVSARSESKLKSLVEEIRGFGGKATFCVADVEVFEQVKAIADKTVEIYGRLDTWVHVAAIGIFATFDKTTPEEFKHVIDVNLMGQVHGAMAALPHLKREGRGALIHVSSMEGRRSLPYQSAYSSAKHGIEGFLEAMRLELIHEKWPISVTSVKPAVINTPFWNNGLTKLGVKPSGIPPYYDPRIVSDAILYAAEHPIRDLLVGDIAKLLDLAQKISPSLVDSLLLLLGFNSQHSDEPKSEDAPNNFYQSVPEDNRIDGDYKNLVIPSISDLLGKLPLFQWGLAALLTVLAAQEFKQNK

SEQ ID NO: 40149 - protein, 183 aa, Glycine max
  misc_feature (171)..(171): Xaa can be any naturally occurring amino acid
MGTALHLCVSFNPAQGRKCKYEAQSVRALPIRILSVGKKRSRGLQLMVDEYVDKLRYYCSVEDAQIRPNPRNARDQRAQVDAEDEAVMNLIRSDDWVVMLDERGQDIESEQMAELVGDAGNTGASRLSFCIGGPYGHGRKMRQRANLSIKLSSLVLNHQIALLVLMEQLYXSWTILKGQKYHH

SEQ ID NO: 40150 - protein, 440 aa, Arabidopsis thaliana
MYLDINGVMIKQFSFKASLLPFSSNFRQSSAKIHRPIGATMTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNVKKETLVKGLKEVGFTVFPSSGTYFVVADHTPFGMENDVAFCEYLIEEVGVVAIPTSVFYLNPEEGKNLVRFAFCKDEETLRGAIERMKQKLKRKV

SEQ ID NO: 40151 - protein, 436 aa, marine gamma proteobacterium HTCC2080
MFQELIAIGINHDSATLDIRERVAFAPESIAMALGSALATAPITEVVILSTCNRTEIYGVVPTSGDPLSASEALVSWVTEHHGLPSEALSTCTYRHHGKQALTHLVRVAAGLNSMVLGEPQIFGQLKSAFAVAEEAGAVGSRLQRLFPEAFRIAKKVRTDTAIGENPVSVAYASVDLAGHIFSNLSKRTALLLGAGETIELVARHLCDAGLGNLIIANRTLARAESLAQQFDASAVMLADVPDRLPEADIVISSTASQLPILGKGAVERALRQRHYRPMLLIDLAVPRDIEPEVSELSDIYLYSVDDLKDVIAENLRLRASEANKADGIINAGVVGVEEDFRGRQSADVVRTFRESALAIQEVELSKAIKSVERGETPEDVIRRLARDLTNKLIHAPTAGLRQIAREGDDGQVTRAKALLGLNESASSEDENPTLQ

SEQ ID NO: 40152 - protein, 599 aa, Vibrio cholerae O1 biovar eltor str. N16961
MMHEESIALTIAAVGVVGLGCQWLAWRLRLPAILFLLLAGILAGPVFGVLNPEALMGDLLFPLVSLAVAVILFEGSLTLNFKEIRGVSNTVWSIVTVGALVSWGITSTAAHWLLGFEWPLALMFGSLTVVTGPTVIVPLLRTVRPTARLANILRWEGILIDPLGALFVVMVYEFIVSSSHAHSLEVFSLILLVGFSIGIASGVAVAAVLRRGLLPEYLQPFAVLSVVLGVFAASNALESESGLLTVTVMGMWLANAKGVNIQHILHFKEHLTILLITGLFILLAARIEVADFQALGWSALGLFVVMQLLARPASIFISTLRSTLNVREKAFLAWVAPRGIVAASISSLFAIKLMEFGIADAKLLVPLTFMVIIGTVVLQSATARPMALALKVSEPAPKGFLIIGANDVARQVGLAIAKYDCRVVVTDSNWDYIRQARMTGLEHYYGNPISSHAEDYLNLIGIGHVLALSPDKHFNIMACMQFLSDFGDKRVFCLNDNPTNNVSEKHLVAQEYHGLPFLGGEVSYKKLASLVGQGAEVKHTKLSENFTYQDYQQIHKESFVLPLFSVDSRGRVQMCQDVASFAPKEGEIVVSLIKSHESP

SEQ ID NO: 40153 - protein, 495 aa, Glycine max
GRVGGRVGGRVGGRVGGRVGFKNPPLPPGPKGLPIIGNLHQFDSSILYLQLWQLSKKYGPIFSLQLGLRPAIVVSSPKLAKEVLKNHDLEFSGRPKLLGQQKLSYNGSEIAFSPYNEYWRQIRKICVVHIFSSKRVSSFSSIRNCEVKQMIKKISGHASSSGVTNLNELLISLSSTIICRVAFGRRYEDEGSEKSRFHVLLNELQAMMSTFFVSDYIPFTGWIDKLKGLHARLERNFKEFDKFYQEVIDEHMDPNRQQMEEHDMVDVLLQLKNDRSLSIDLTYDHIKGVLMDILVAGTDTTAATSVWAMTALVKNPRVMKKVQEEVRNVGGTKDFLDEDDIQKLPYFKAMIKETLRLHLPGPLLVPRESTEECIVDGYRIPAKTILYVNAWVIQRDPEVWKNPQEFIPERFLDSDVDFRGQDFQLIPFGSGRRSCPGLPMAVVILELVLANLLHSFDWELPQGMIKEDIDVQVLPGLTQHKKNDLCLCAKTRSHI

SEQ ID NO: 40154 - protein, 326 aa, Bacillus cereus E33L
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGSKEIYIAKYIVVATGYYDNPNYMNVPGEELKKVAHYFKEGHPYFDRDVVVIGGKNSSVDAALELVKAGARVTVLYRGSEYSPSIKPWILPEFEALVRNGTIHMHFGAHVKEITEHTLTYTVDGETTTIQNDFVFAMTGYHPDHSFLTKMGVRIDEATGRPIYAEDTMETNAANIFIAGVIAAGNNANEIFIENGRFHGDAIAQTIATREM

SEQ ID NO: 40155 - protein, 310 aa, marine gamma proteobacterium HTCC2080
MVFTGNANPELARQVADRLYLTLGAAQVSKFSDGEITVELNENVRGKDVFVIQSTCQPTNDNLIELVLMIDALRRASAGRITAVVPYFGYARQDRRVRSARVPISAKVIADMMASVGVDRVLTVDLHAEQIQGFFTCAVDNVYASSVLNHDITRCNYENLVVVSPDIGGVVRARAIAKQLDDADLAIIDKRRPRANEAQVMNLIGDVDGRTCIMVDDMVDTAGTLCSAAKALKERGATKVVAYCTHAVLSGKALENIRNSELDELVVTDSIPLSDEAKALNIRQLTISDLLAESIRRVSNEESISALFDE

SEQ ID NO: 40156 - protein, 272 aa, Zea mays
  misc_feature (45)..(45): Xaa can be any naturally occurring amino acid
  misc_feature (79)..(79): Xaa can be any naturally occurring amino acid
  misc_feature (107)..(107): Xaa can be any naturally occurring amino acid
MRKRERENPCGICGHYHKYEEGEVCGVCGHRWKPSDGGGRPVEAXSPPFPPQRCFKDFLFLGSYNNASRSEVLRTLSIXAHILNTVPDAHNLYKNSFTYHSLQRDRXLDFDEANQYLEKCERDKSRVLVHCMTGKNRSAAIVAAFLMKSRGWRLAQSFQWVKDRRPQVQLTDASQKELLEYELKLFGPSTQTLVPTESFASLGFGYTKPAGDMQTPVFNQTTMPSIFERFNPNDRPANFTFGVERKAEANPRDNNSDGRVNPTSMENLMDSS

SEQ ID NO: 40157 - protein, 251 aa, Burkholderia thailandensis E264
MSKQRIKRVIGNWKMHGRLSGNQALLTEVAQGAQAVHDNVAIGVCVPFPYLAQAQAQLQGGRVSWGSQDVSAHEQGAYTGEVAAGMVAEFGAAYAIVGHSERRAYHGESNETVAAKARRALAAGLTPIVCVGETLAEREAGTTEQVVGAQLDAVLAVLSPDEAARIVVAYEPVWAIGTGKSATAEQAQQVHAFLRGRLAAKGAGHVSLLYGGSVKADNAAELFGQPDIDGGLIGGASLKSGDFLAICRAAK

SEQ ID NO: 40158 - protein, 590 aa, Leptospira interrogans serovar Lai str. 56601
MEHHSLSLLNDIALSIIFATFFSHIARITKQPLILGYVAGGLLLGPNLGLSLVINEESIELISEIGLILLLFIIGLEIDLKELARMGKSMFVLGIVQFVFCVLFGFFFFKWILANSTGRFDLLYFAIALAISSTMIVVKLLHDKFEVSTIAGRLTIGVLVLQDIWAIIFMGVQPNLQNPQILKIAGSLGIGLVLICVSFLISRFFLSKLFNAAASKPELILITSIAWCFLLCGFAEKAGLSKEMGALIAGVSIAAFPYGADVIAKLSGIRDFFITLFFVALGMKIPIPSIQILSISLIAVVFVIFSRVITVATPVYLSGKGLRAGIVTGLNLAQISEFSLVILSLGMGYGHISKELESTVLTSMILASVVSTYIILFNDPISRFILKILNMIGLKEKEDEEDQTESYITGQSKRDIVILGYFRIAQGLLEGIEREKPEWLNRILIVDFNPVFRQSLEAKGIRWAYGDLANPETLHHLGIEEAKYVICTISDMILKGTTSRRLLESLKVICHRTQPSIILTTDDVQEAEILVKSGAAHVIVPGRISGMSLFKEMKTIVDHSKRSLESQTSSVKKKKTMKKKVSSTSKIKVK

SEQ ID NO: 40159 - protein, 225 aa, Zea mays
  misc_feature (93)..(93): Xaa can be any naturally occurring amino acid
  misc_feature (130)..(130): Xaa can be any naturally occurring amino acid
  misc_feature (148)..(148): Xaa can be any naturally occurring amino acid
MSRRGDWVYENNGGTCVAIAGADYCVVAADTRLSVGYSILTRDHSKICDLADKCVLASSGFQGDIKALHKNLAARELLYQHQHNKRMSCPAMXAQLLSNTLNYKRFLPHITAFHVLRGLDSEGKGCVFTXYDGIGSYQKTGYNAQGNXDSTLIMPVLDNQLKSPSPLLLPAKDAVTPLSESEAIDLVKDVFASATERDIYTGDKLEIVVINKVGTKREYIDLRKD

SEQ ID NO: 40160 - protein, 366 aa, Glycine max
MEPETAKLGSSLLVDSVKELAKKALIEVPERYVHPNIDPPILVNTDSLLPQLPIIELHKLLSEDLKELEKLDFACKDWGFFQLVNHGVGIKLVENIKKGAQELFNLSMEEKKKLWQKPGDTEGFGQMFGSKEGPSDWVDLFYIFTLPSHLRKPHLFPNIPLSFRENLEDYCIKMRHLAINIFALIGKALGIELKDIKKSLGEGGQSIRINYYPPCPQPENVLGLNAHTDGSALTILLQGNEVVGLQVKKNETWVPVKPLSNAFIVSLGDVLEVMTNGIYRSTMHRAVVNSQKERLSIATFYGPGWSGNIGPAPTLVTPERPALFKTIGVEDFYKGYLSPEHLGKPKSYINDVLRTQNGHVKGLTPS

SEQ ID NO: 40161 - protein, 79 aa, Ralstonia eutropha JMP134
MDNIEQRVKKIVAEQLGVAEADIKNESSFVNDLGADSLDTVELVMALEDEFGMEIPDEEAEKITTVQQAIDYATAHVKA

SEQ ID NO: 40162 - protein, 141 aa, Triticum aestivum
  misc_feature (101)..(101): Xaa can be any naturally occurring amino acid
  misc_feature (128)..(128): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREXHNASPGVLRWPGTGTMWKAAYFGCTDXQVINEVEESRRST

SEQ ID NO: 40163 - protein, 441 aa, Triticum aestivum
  misc_feature (283)..(283): Xaa can be any naturally occurring amino acid
  misc_feature (325)..(325): Xaa can be any naturally occurring amino acid
  misc_feature (335)..(335): Xaa can be any naturally occurring amino acid
MGLAENQLSLDLIEEWSKAHPEASICTAEGPSQFKRIANFQDYHGLPEFRQAMAQFMGQVRGWKARFDPDRVVMSGGATGAQETLAFCLANPGEAFLVPTPYYPGFDRDCCWRSGVKLLPIECHSSNDFRITREAVVAAYESATSNGVRVKGILITNPSNPLGTTADRATLAMLATFATEHRVHLICDEIYAGSVFAKPEYVSIAEVIERDAPGPDRDLIHIAYSLSKDFGLPGFRVGIDYSYNDAVVACARKMSSFGFVSSQTQLFLAKMLGDEEFMARFLXESARRLAARHELFTSGLREVGIGCLGGNAGLFSWMDLRGMLXREKTAEADLXELWRVIIRKVKLNVSPGTSFHCGEPGWFRVCHANMDDETMGVALSRIRDFVRQHQQQKAKAQRWAARGHLHLSLQRHGAMASQYHALSSPMAALLSPQSPLVHAAS

SEQ ID NO: 40164 - protein, 256 aa, Lentisphaera araneosa HTCC2155
MSRKPKKMTLDEIKKMEAVCRLAAEALQLAGKMVKPGVTSQEINDAVHEFTLSKGCLSAPLNYHGFPKSVCTSINDVVCHGVPQEGEVLNDGDIINVDVTLIKEGFYGDTSRTFFVGDVSDEAKRITQAAQESMYAGIDQVKAKARTHDIGFASEKVAKKYGYFPVRDIGGHGIGKAFHLDPFVPAVGPKGTGPRIMENTCLTVEPMINATSHRYETFQIPNSNITYFRTLDGSLSAQFEHTILVTSDGRHVLTEW

SEQ ID NO: 40165 - protein, 699 aa, Pseudomonas fluorescens Pf-5
MQTFFIAPTDFGVGLTSISLGLVRTLERAGLKVGFFKPIAQPHPGDTGPERSTELVARTHGLKPPQPLGLAHVERMLGDGQLDELLEEIITLYQQAAIGKDVLIVEGMVPTRSASYAARVNLHLAKSLDAEVILVSAPENEVLTELSGRVELQAQLFGGPRDPKVLGVILNKVRTDESMEAFSARLKEHSPLLRSGDFRLLGCIPFQPELNAPRTRDVADLMGAQVLNAGDYESRRMTKIIICARTMRNTVELLKPGVLVVTPGDRDDIILAVSLAAINGVPLAGLLLTSDTLPDPRIMELCRGALNAGLPVLSVSTGSYDTANQLNGLNKEIPIDDRERAEIITDFVASHLDANWLHQRCGTPREMRLSPAVFRYQLIQRAQEANKRIVLPEGSEPLTVQAAAICQARGIARCVLLAKPEDVHAVARAQGIELPEGLEILDPDLIRQRYVEPMVALRKSKSLNAPMAEQQLEDPVVIGTVMLALDEVDGLVSGVIHSTANTIRPALQLIKTAPGCSLVSSVFFMLFPEEVLVYGDCVMNPHPSASELAEIALQSADSAAAFGITPRVAMISYSSGDSASGEEVEKVREATLLAHEAQRSLLIDGPLQYDAAANENVARQLAPNSQVAGKATVFVFPDLNTGNTTHKAVQRSADCVSLGPMLQGLRKPVNDLPRGAQVDDIVYTIALTAIQAANRPMDV

SEQ ID NO: 40166 - protein, 278 aa, Nocardia farcinica IFM 10152
MDVQRRNRIVVTGQAGAPVVVLAHGFGCDQNLWRLVVPLLAPDFTLVLFDHVGSGGSDLSAWNAERYGTMQGYADDVVEVCRAIDAGPVVFVGHSVAATMGVLAAAAEPELFRGLVLLAPSPCFIDDPARGYRGGFSAADIDELLESLDANYLGWSGAAAPMIMGNPDRPELAAELESSFCRTDPEIARVFARVTFLSDNRDDLAAVTVPTLVAQCSHDAIAPPEVGEFVHARIPGSELITLSATGHCPQLAAPEETAAAIATFVRKLPARAPTTATR

SEQ ID NO: 40167 - protein, 183 aa, Triticum aestivum
  misc_feature (105)..(105): Xaa can be any naturally occurring amino acid
  misc_feature (112)..(112): Xaa can be any naturally occurring amino acid
  misc_feature (136)..(136): Xaa can be any naturally occurring amino acid
GGGRSRTSGSPGLQAEKVWSEVFFYLAENNVLFEGILLKPSMVTPGAEHKEKASPEAIAKNTLTMLRRRVPPAVPGIMFLSGGQSELEATMNLNAMNQSPQTPWXVSFSYAXRALQNSVLKTWQGQPENIEAAQKXALLVRAKANSLAQLGSYTGEGESDEAKKGMFQKGYTYRPAGGRMIYI

SEQ ID NO: 40168 - protein, 365 aa, Populus tremuloides
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHVDVIMLAHNPGGKERTEKEFEGLAKGAGFQGFEVMCCAFNTHVIEFRKKA

SEQ ID NO: 40169 - protein, 738 aa, Ostreococcus tauri
MASHRISEGGAHAPSLDPIVARAFGAFDHTFTVCDATKPDCPIVYASDGFLRMTGYAAAEVIGYNCRFLQGEKTNKNDVRELREAIKNGDRWSVRLLNYKKDGTPFWNYLVVAPVKLADGTVVKYIGVQTDVTEVKDADTGERGIEFDEKGQPVPSRYDARAAAATLGRVSEVEQAVRTAEGLGNQAQRRTGMDLASTLERIEQSFVITDPSLPDHPIVFASDGFMEFTGYSVDEILGRNCRFLQGPKTDRAAVAKIREAIENGEECTVRLLNYTKTGEEFWNMFTLAPVRDEQGIVRFFAGVQVDITAHDPQTEHETVAEITFKEEDNDANVQVSKSAAQLVAGAAAKDKEFEPPWKHMSGHMLQPKPHQLENRRHWEALWRVTNYNDRPLTIDDFVPIRRIGQGDVGTVHLVALAKEKDVRFALKILTKQEIIDRNKLHRLQTESTILNQIDHPFVATLFASFQTSTHVYFLMEYCEGGELYDFLQKAPGKRLSEEATKFYAAEVLVSLQYLHLLGFVYRDLKPENVLLRRNGHIMITDFDLSFCASCQPHIKVRPGNPTWYPGQRATAHAKKKKLKPPRLPKSGSNPTIVAEPFTFTNSFVGTEEYLSPEVLNGTGHSGAVDWWELGIFMYEMAYGTTPFKAATRDETFSNITNAKLTFPDNIPMSEDFKDCVRKLLQRDSTSRLGTLGGAEEIKSHPFFSCVNWGLLRWEEPPYVPKPRRAAPVRDEEIFEMEI

SEQ ID NO: 40170 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAQQTPLSALYAAKLIKEAPFPAGVINVISGFGRTAGAAISSHMDIDKVAFTGSTLVGPTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDVAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 40171 - protein, 328 aa, Nostoc punctiforme PCC 73102
MSTILVTGGAGYIGSHAALALKNAGYEVIVLDNLSNGHRELVEEVLQVKLIVGDMSDRSLLDDIFSTHNITAVMHFAAYIAVGESVTDPAKYYQNNVAGTLTLLEAMLAASVNKFIFSSTCALYGVPKFVPLTEEHPQDPISPYAISKWMVERILSDFDTAYNLKSVRFRYFNAAGADPNRLLGEDHEPETHLIPLVLLTAFGKRESILIFGTDYPTPDGTCIRDYIHVTDLAQAHILGLEYLLKGGESEVFNLGNGSGFSVREVIETAKEITGKEIKIEERDRRPGDPPILVGSSDKATKILGWHPEYPNLNEIIAHAWKWHQQRHK

SEQ ID NO: 40172 - protein, 364 aa, marine gamma proteobacterium HTCC2080
MGIKCGIVGLPNVGKSTLFNALTEAGIDAENFPFCTIEPNAGVVPIPDPRQHSIAALINPEREIAATMEFVDIAGLVAGASKGEGLGNQFLANIRETDAIAHVVRCFEDDNVIHVANKIDPTSDIEIINTELALADLESCEKQLTKVTRTAKGGDKESIAMKQLLEDKLLPQLNEAQPIRALTLDDNEQALLSTLHLLTTKPTLYIANVAEDGFENNPHLDTVQSIAAAEGAEVVAICNKLESEIIELEDDEKQDFLAEMGMEEPGLNRVIRAGYKLLNLQTYFTAGPKEVRAWTVPIGATAPQGAGVIHTDFQKGFIRAEVIGYDDFIAHKGEQGAKDAGRWRLEGKEYILADGDVIHFRFNV

SEQ ID NO: 40173 - protein, 255 aa, Brassica napus
YIRDLATLVVAYGISINLVEVTWKSKLKAQFPSPNEYSAFMGDFSTCTGIATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILTFGSLASSTPYLGVILLGIVTAWLAAAKSLEGQFNTLMSEEELEKEMERAASLKIPVVSSEEAASGESTSQLPETSSPSSI

SEQ ID NO: 40174 - protein, 361 aa, Campylobacter upsaliensis RM3195
MPADLNDYFNKKNGNSNGKNNHRQNFNFKAPVFNFKGFGKFAPVIYTLIIIVLILIVAKPFVIINSGEMGIKARTGQYDPNPLEPGLHFFLPFIDRVIVVDTRVRQINYASLEGTNENLGIGTGVINKNSISVLDSRGLPVSIDVTVQYQLNPIQVPQTIAVWSLNWENKIIDPVVRDVVRSVVGRYTAEELPTNRNAIATQIEEGIRKTIVAQPNEPVELRAVQLREIILPAKVKEQIERVQIAKQEAERTKYEVERANQEALKKAALAEGEANATIISAKGKATAVKIEADAQAYSNKEIAQSLNTPLLNLKQIETQKAFNEALKVNQDAKIFLTPGGAVPNIWVDTKDAKKQTAISPN

SEQ ID NO: 40175 - protein, 247 aa, Coix lacryma-jobi
VGEGVTDLAPGDHVLPVFTGECKECAHCKSAESNMCDLLRINTDRGVMIGDGKSRFSINGKPIYHFVGTSTFSEYSVMHVGCVAKINPEAPLDKVCVLSCGISTGLGASINVAKPPKGSTVAIFGLGAVGLAAAEGARIAGASRIIGIDLNPNRFEEAKKFGCTEFVNPKDHNKPAQEVLAEMTNGGVDRSVECTGNIHAMIQAFECVHDGWGVAVLVGVPHKDAEFKTHPMNFLNERTLKGTFFGN

SEQ ID NO: 40176 - protein, 528 aa, Triticum monococcum subsp. aegilopoides
MAHVHVDELLHEAAAAAPRSLLIASAVLFSLVVVPLLLRIISKQGAASDAMLLSLLPSPPTKLPIIGHLHLMGDLPYVSLAGLAAKYGPELMLVHLGAVPTAVVSSPRTAEAVLRTHDHIFASRPRSMVFDIIMYGQTDSCFAPYGEHFRKARKLVTVHMLNARKIRSQRPAREEEVQLVIVKIAKAAAAREAVDMSELLHSYVNDLVCRAVSGKFSQEEGRNKLFRELTDINAALLGGFNILDYFPSLGRFELVCKMACAKARRVRKRWDLLLDKLIDDHAARMVSREDEAQPAQEEDKDFIDVSLSLQQEYGLTRDHIKAILIDMFEAGTDTSYMTLEFAMAELIRKPHLMKKLQEEVRRNVPNGQEMVAEDDLPNMTYLKAVIKETLRLHPPVPLMIPHFSLDACTVDGYTIPANTRVVINAWALRRHSSYWENENEFQPERFMNGAGVDLKPNEFHYLPFGFGRRMCPGVHSASATVETMLANLMYRFDWKLPPGLKEEDIDMTEVFGITVSRKEKLILVPVTA

SEQ ID NO: 40177 - protein, 527 aa, Triticum monococcum subsp. aegilopoides
MALEAANHYLQLPGVHGASTPAVLLTVLLLLIIRLAWVRTATASTRFGKQQKLPPSPPGKLPIIGHLHLLGSQTHISIRDLDAKHGRNGLLLLRIGAVPTLFVSSPSAAEAVLRTHDQIFASRPPSMAADIIRYGPTDIAFAPYGEYWRQARKLLTTHMLSAKVVHSFRHGRQEEVRLVINKIREAATSGTAVDMSELLSGYTNDVVCRAVLGESHRKEGRNRLFSELTEINVSLLGGFSLENYIPPNMVMADVLLRLVSVKAQRLNKRWDDLFNEIIEEHLHPSKPSSGEQQAADFIDLLLSLKEEYGLTTDNIKAILVDMFEAGIETSYLTLEYGMAELMNNRHILTKLQEEVRSQGKKLDMITEEDLSSMAYLRATIKETLRMHPPAPFLLPHFSTADCKIDGYLIPANTRVLVNAWALGRDPSSWERPEDFWPERFLQDQDGDVDTQMRGKDLRFLPFGFGRRICPGMNFGFATMEVMLANLMYHFDWDVPNMVGTGAGVDMAESFGLTLHRKEKLQLVPQIP

SEQ ID NO: 40178 - protein, 694 aa, Burkholderia vietnamiensis G4
MAVDYTTRDGVAVITLNNPPVNGLGLSTRQGVMAGLERAAQDPAVTAIVLTGAGRAFSGGADITEFNTPKALQEPTLHTVIRAVEASAKPVVAALHSVAMGGGLELALGAHYRIAAPGAQIALPEVKLGLLPGAGGTQRLPRAVGLETALNMIVSGAPVPSEQLATSGLFDAMADGDLLDAAVAFARQAGAQSGPHPRVRDRKIVHENAAGFIQFARNSARAAAPNFPAPHKCIDAIEAGVLHGFDKGSVAERDGFVALMMTPESRALRHAFFGERAASKIPDVPADTPVREIRRIGVVGAGTMGGGIAMNFVNAGLPVTLLETTQDALDRGLATIRKNYDAQVRKGKLTQQKLDARMALITPTLSYDDLHDADLVVEAVFEELGVKEQVFGRLDAVAKPGAILASNTSTLDIDRIAAFTKRPQDVVGMHFFSPANVMKLLEVVRGANTAKDVLATVMAVAKKIRKTAVVSGVCDGFIGNRMIEQYIRQALFMLEEGALPAQVDRAIEKFGFAMGPFRMSDLAGNDIGWAIRRRRYVEQPDLHYSKIADRLCELGRFGQKTGGGWYDYVAGERTAKPSALVDEMVVAYSNERGVERRKIGDDEIVERLVFALVNEGAKILEEKIASKASDIDMVYLTGYGFPLWRGGPMLYADTVGLYNVERAIRRYAAAPNGDAWRLAPSIVELAKAGRGFNG

SEQ ID NO: 40179 - protein, 522 aa, Burkholderia vietnamiensis G4
MSFSRSAADPADTLPDLAATLAAPGDDAFVALGDAFHTRLPAAPLPAPYVVGFSAEVAQLLGLPPSLAAHAQFAELFAGNPTRDWPAHALPYASVYSGHQFGVWAGQLGDGRALTIGELPGSDGRRYELQLKGGGRTPYSRMGDGRAVLRSSIREYLCSEAMHHLGIPTTRALTVIGSDQPVVREEIETSAVVTRVSESFVRFGHFEHFFSNDRPDLLRRLADHVIERFYPACREADDPYLALLEAAMLRTADMVAQWQAVGFCHGVMNTDNMSILGVTIDYGPFGFVDAFDANHICNHSDTSGRYAYRMQPRIAHWNCYCLAQALLPLIGLQHGIGDDDARAERAVDDAQAVLAKFPERFGPALERAMRAKLGLELEREHDAELANQLLETMHASHADFTLTFRRLAQLSKHDASRDAPVRDLFIDRAAFDAWANLYRARLSEETRDDAARAAAMNRVNPKYVLRNHLAEVAIRRAKDKDFSEVERLAQILRRPFDEQPEHEPYAALPPDWAGSLEVSCSS

SEQ ID NO: 40180 - protein, 251 aa, Arabidopsis thaliana
MICTEALQRISFSSDLGQSDKAPPPVIEPSGLIRRDETLLDSSNSDFEFHISNSFDPGDSSPADEIFADGMILPFHVTAASTVPKRLYKYELPPITSSLSPSPLSPQPLPTKHSEKETNGRASGANSDSEAEKSSKSFWSFKRSSSLNCDIKKSLICSFPRLTRSNSTGSVTNSKRAMLRDVNNHRPSSRSSCCNAYQFRPQKHTGKKGEGGGSFSVIPVLNGPSTFGLGSILRHSNSKDKTKTKKKKNKK

SEQ ID NO: 40181 - protein, 358 aa, Sinorhizobium meliloti
MARFYPLQITEVRRDTRDAVVVTLEPREEDRAAFDFTQGQYLTFRRLFGGEELRRSYSICAGLDEGALKVGIKRVDDGCFSSWANEELEPGDTLEAMPPMGAFFTPIEPEAAKHYLGFAGGSGITPVLSLIKTVLAREPRSAFTLVYANRHFSSIMFREELDDLKNLYLGRLSVLHVLESEAQEIDLFSGRLDREKCTALFRSWIDVTSADTAFICGPEPMMLGVAAALRAHGLGDDRIKFELFAASQPGRARRKVETAAGADSRARCEATVTLDGATRSFTFPKEGMSLLEAALENRMDAPFACKAGVCSSCRAKVLEGEVEMESNNALEDYEVEQGYVLTCQSYPLSDRIVVSYDQ

SEQ ID NO: 40182 - protein, 143 aa, Burkholderia vietnamiensis G4
MSHDSDDKTYPYQKDDAELRRRLTPMQYEVTQHAATERAFTGEYTDTEDAGIYKCVVCSTPLFESGAKFHSGCGWPSYFKPLNGEVIDEKIDRSHGMVRVEVRCNHCGAHLGHVFEDGPRDQTGLRYCINSAALNFESRPENE

SEQ ID NO: 40183 - protein, 487 aa, Arabidopsis thaliana
MASGKLPWELEEEILCRLPPGSLVRKSLGCARPQFIILPESKIYSIGTIGLDDFDPKIEVRELACQFHFKAEKWAFTRITACDGLLFRDFWNQGVTIWNPWLRQVGWIEYKEDRDFRFCGVGYDACKPEKDYKIFGYFSRFYDTTLKIGHRFAIFECASQAFKFIDSPEWPMLAGRGEYVSLNGNLYWTAYNEDTREHFLGSFDFSTEISMHFCLLPCGKHVSGLRDKLVLTVFKGDQFALLKQSRISSNTEIWVTNDMINSSNNVVWLNLMTLSIPDFPSLFHQLSDISYFIHDMTLILCCDDNQTGVGCIFIARGDFCKKIQIDSVSLGFSQCVHLPSLTSVPLEFRSLQLKPLAYSRNILHRPHGSPSWSEEDTKVLSAQYGPKARTKKNENAEKACLKSYGRKVEKEYETILKRTLQSICVLRVVPNTTTSVIIQNGCGLARGHQSGGTWRYLARVLRNRGQEGPQRVLRFSRTFHHLSWLKV

SEQ ID NO: 40184 - protein, 312 aa, Neptuniibacter caesariensis
MLVNGQWQRKWDPVQAKDSEGRFIRQSSSFTSRLGASDIESGRYSLIVGYICPWATRTLIARSLLGLEEHIDIKVVNPVLTDFGWRFGGFPGATVSGYSGVEYVHQLYTQTQADYTGRATVPVLWDNKGQCIVNNESADILKIFNQDMRVLHQSSIDLRPAAIEDAIDRFNERIYDSLNNGVYRAGFASSQQAYEEAVDQVFAALDQLEELFTNQKYALANGLTECDIRLFVTLVRFDPAYFSLFKTNVRRIEDYPALSAYLERLLQIEAFSVNTRIDHIKSGYYSIKALNPLGIVPKGPDLPWFKYLKEGV

SEQ ID NO: 40185 - protein, 489 aa, Marinobacter sp. ELB17
MSLELKNPELLRDRAYINGQWTAARSGKTFDVTNPANGEHLANVPDMDETDTRIAIESAETAWPAWRSAPAKERAKILRKWFDLLMENQEDLARLMTAEQGKPLAESRGEVGYGASFIEWFAEEAKRAYGDVIPSHGKDKRILVIKQPIGVVAAITPWNFPIAMITRKVAPALAAGCPVVVKPAEDTPLSALAITALAEQAGVPAGLINIITCSKPNAAAVGGELTGNPVVRKISFTGSTPVGKLLMRQASDTVKKVSLELGGNAPFIVFDDADLDAAVIGLMASKYRNTGQTCVCANRVYVQSGVYDAFAEKLKVAVSKMVVGAGLEGDTEQGPLINKPALDKVKRHIADATSKGAKIILGGQPHALGGTFFEPTILIDATQDMLIASEETFGPVAPLFRFETEEEAIAMANDSVFGLSAYFYSNNIHRIWHVAEALESGMVGINEGIISTEVAPFGGVKESGLGREGSHYGLDEYMELKYLCLGGMR

SEQ ID NO: 40186 - protein, 364 aa, Moraxella catarrhalis
  misc_feature (166)..(166): Xaa can be any naturally occurring amino acid
MTNTGTTDMKNIDTSPSNSEHYLPKKILVTGGAGYIGSHTLIELIQAGFVPVVYDNLSNSSFVAVQRVEQIVGKHIEFIQGDVLDKTHLDAVFKAHQFFAVVHFAGLKAVGESTKNPLKYYQNNVVGTLNLLELMAKYGVKNCVFSSSATVYGSSNRLPITEDMPXFCTSPYGQSKLMVEHILEDLVNADDTWNVVCLRYFNPIGAHESGRIGEDPTDIPNNLMPYISQVAVGNLKQLSVFGNDYETPDGTGVRDYIHVVDLAKGHVAALHYLVGQSVGIGFCPINLGTGQGTSVLQLIKAFESNTGQSVPYVITSRRTGDIAAYYASADKAKAILNWTAELDIERMCVDTWRWQSNNPHGYLS

SEQ ID NO: 40187 - protein, 269 aa, Neptuniibacter caesariensis
MTKTILITGSTDGIGLATALRLAEEGHHILLHGRSEKKLAEAQNKLKQVEGSGGVSCYQADLSVMADVVRFAEKVKAEQTHIDVLINNAGIFKTEERITSDGLDVRFAVNTVAPYLLTEKLLPMLGNQGRVINLSSAAQSEVNLEALLGVVSVEQDFNAYAQSKLAITMWSRVLAKSLTAGPAVIAVNPGSMLGTNMVQKGFGVSGNDISIGVNILTALALDDKYQQCSGQYFDNDAGHFADPHIDALDQHKSVAVVDAIKNILTELKL

SEQ ID NO: 40188 - protein, 137 aa, Zea mays
PDVKIMSLSILSPGRPDIVLPLPVEPNGKGVWFTLKEGSPYRLKFTFSVSNNIVSGFRYTNTFWKTGFKVDRAKEMLGTFSPQLEPYTYVTPGDTPPSGMFARGSFFARTKFFDDDRKCYLEINYPFDIRREWPWTS

SEQ ID NO: 40189 - protein, 766 aa, Magnaporthe grisea 70-15
MAPASRAPLGVGSGRDDIEVTWNYLQNGITRIMNNLQDGMTMETYMGIYTSVHNFCTSQKALGFSNSPGPPAAAHRGAHLLGEDLYKKLMKYLSDHLEDLLVQSKAHTGEALLSFYIREWDRYTTAAKYIHHLFRYLNRHWVKREIDEGKKHIFDVYTLHLVQWKNVLFDKVHEKVMDAVLALVERQRNGETIEYGQIKQILDSMVSLGLDENDASKTTLDCYRFHFEKPFIAATEAYYQKESRAFVAENTVVEYMKKAEARLEEEEERVRMYLHPDIAVALKRCCNTALIADHSAILRDEFQVLLDNDREDDMARMYNLLARISDGLDPLRQKFEAHVRQAGLTAVAKVASGQGEKLEPKVYVDALLEVHTQYQGLVKRAFNDEPEFTRSLDNACREFVNRNDVCKSGSNKSPELLAKYTDVLLRKSGSAVEEEELENTLSQIMTVFKYIEDKDVFQKFYSRMLARRLVHTNSSSDDAETSMISKLKEACGFEYTNKLQRMFQDMQISKDLNTGFREHAEKSEMKVLDSQYAILGTGFWPLQVPNTAFNPPAVISEDCERFTRFYKNKHDGRKLTWLWQLCKGEVRATYCKQSKVPYTFQVSMYQMAILLMFNDGDRHTHEEIASTTSMNSETMDPVLGLLLKAKVLLADSDKPGPGTTYSLNYDFKNKKVRVNLNIGLKTEQKQEEVETNKTIEEDRKLLLQSAIVRIMKARKRMKHNQLVSETIGQIKGRFVPKIPDIKKCIEILLDKEYLERLEDDDLGYLA

SEQ ID NO: 40190 - protein, 309 aa, Salmonella enterica subsp. enterica serovar Paratyphi B str.
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICEALATFDYLYLSGISLAILSPTSRVKLLSLLRECRANGGKVIFDNNYRPRLWTSREETQQVYQKMLECTDIAFLTLDDEDALWGQQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 40191 - protein, 360 aa, Nostoc punctiforme PCC 73102
MDFQQVFGKPPETQASAPGRVNLLGEHTDYNDGFVLPTAIPQSTTVQLGLSSDSHHHFYSENLNEQVSILDINHSPSGFASYIFGCIEVLQKAGYKIPSLCVYVKSSVPMGSGLSSSAALEVATLRAVRQLLNFPIDDVEIAQFAQQAEIHYAGVQCGIMDQMASSLADTEHILFLDTRTLKRRVMPLPDNAEILVIDSGVPRTLATSGYNQRRAECEEAARSLGVKALRDITDVEVTEKLPEPLRRRARHVVTEDNRVLEVLQGVSSERFGELMNASHASLRDDYEVSVPALDTLVELLQKTPGVFGARLTGAGFGGASVALVVAGEARSIATHVLEQYKQAGYNGQILVPSLELSDAA

SEQ ID NO: 40192 - protein, 293 aa, Cryptococcus neoformans var. neoformans JEC21
MSLSLDSTIKLASGNLIPRLGFGVYQARSKECEDAVKKAIDTGYRHVDTAQAYHNEENVGRAIRNSGVPRPSVFLTSKYMPSHTVYSPTEVLDVVRKSLKKVDRCGDDKPYIDLMLIHAPWGGEEGRKNNWEALTIAQKEGWVKDIGVSNFGIHHLKALPPPVPAVNQIELHPFCQQRDIVKYCEEHGIAIEAYSPLVRANKKHYDNEVLVKVAKKYGKEVAQVLLRWSLQKGYIPLPKSVTPSRIESNADLYDFKLDQEDMAEIDGLDKGSEGAISWNPVNHDGEIDQDALR

SEQ ID NO: 40193 - protein, 391 aa, Vibrio cholerae O1 biovar eltor str. N16961
MTDKQYSLDDIRLRLNELDDQLLNLLSERRKMSIEVAKSKVETAKPVRDPAREQQLLVKLINAGKEKYQLDPQYITKIFHTIIEDSVLLQQSYLQNLANPQSRKPLARVAFLGAKGSYSHLATREYFSRKNTELIELNCDHFKEVARTVESGHADYGVLPIENTSSGSINEVYDLLQHTTLYIVGELTQPIEHCLVATQEIRLEDLKVLYSHPQPHQQCSEFLSRLKGVKLESCASTADAMKKVQELNRADVAAIGNSASGKLYGLQPIQGNIANQTENHTRFIVVARKPVDVSPQIPAKTTLIMSTSQEAGSLVSTLLVLQRYGINMTKLESRPIMGNPWEEMFYVDLEAHIDSDEMQQALAELTQLTRHLKVLGCYPSENVKPTQVKFI

SEQ ID NO: 40194 - protein, 229 aa, Triticum aestivum
YVYYQLDNFYQNHRRYVKSRNDAQLRDYKKSNTTTSCDPERFTADGKPIVPCGLIAWSLFNDTYSFTRGKDNLTVDKKDISWKSDREHKFAKNVYPSNFQNGALIGGKKLNSSIPLSEQEDLIVWMRTAALPTFRKLYGRIYVDLKANDTITVRLSNNYNTYSFGGKKKLVLSTATWLGGKNDFLGFAYLIVGGLCIFLAFAFTLLYLIKPRKLGDHNYLSWNRHPAGR

SEQ ID NO: 40195 - protein, 228 aa, Gibberella zeae PH-1
MNILEWAFGKRMTPAERLRKNQRMLDKAIRELDQTRVKLEKQEKTLIQQIKTSAKNGQMGACKIQAKDLVRTRRYVEKFYSMRSQLQKISLRLQTYRTNEDMMQAMKGATRALGSMNKQMNLPQLQRIAMEFERENDIMDQRSEVMDDVFDDAMDVGVEEEGDEVVEQVLEEIGVDFNQALGETPTALGTAAVPEGKIAQAVGGGGGGGGGGDPVDDDLQARLDSLRK

SEQ ID NO: 40196 - protein, 197 aa, Triticum aestivum
  misc_feature (143)..(143): Xaa can be any naturally occurring amino acid
  misc_feature (154)..(154): Xaa can be any naturally occurring amino acid
MGAAATATATAVRLHAAATRRAAPRRPARLAVRADAARAATALTQDDLNLLAAVRAVEQVQSGMVLPLGTGSTAAFTVAEIGALLASGKLSGIVGVPTSKRTFEQATSLGIPLSTLDDHPVIDLAIDGADEVDPNLNLVKGRXGGALLREKMVXEAASGKFVVLTDETKLVNRLGREAASPLPGGSCAISAWKPQPK

SEQ ID NO: 40197 - protein, 524 aa, Triticum monococcum subsp. aegilopoides
MALEAAHHYLQLAVGHGTSSPAGLLLVVVPLLLLLLASVRSSTKASRKLRLPPSPPGSLPIIGHLHHIGAQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFRHGRQEEVCLVVDKIREAATNAPSTAVDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSRGEKLDMITEEDLSSLPYLKATMKEALRLHPPGPLLLPHYSTADCNIDGYDIPAKTRILVNGWAIGRDPTAWERPEDFMPERFLQDGQEKSGNLGQDFKYLPFGSGRRICPGANFALATMEIMLVNLMYHFDWEVPNGKEGTGGKISMAETFGLMLRRNEKLYLVPKIV

SEQ ID NO: 40198 - protein, 220 aa, marine gamma proteobacterium HTCC2080
MINHSKENGLHLITMDEGSSTICPDWQLRMLEILGEVEDDCDRGASLVLAGAGKFFCNGLNLEKVMTLTPDEMKGFGQRMGEVHQRLLVLPCPTVAAINGHAFAAGAFLAMSCDYRIMRRDRGWFSVSEVDVGVPIPPAMMGILRAKLPASTTRDAVLTGKRYAADEAMVAGIADGQASAEELLTQAKAMARELGTKEPGIFSTLKTTLFGPTADALVAG

SEQ ID NO: 40199 - protein, 218 aa, Streptomyces coelicolor A3(2)
GMAWEALNNIAAAKDRPLVIVVNDNERSYAPTIGGLANHLATLRTTDGYERFLARTKEVLERTPVVGRPLYDTLHGAKKGLKDFIAPQGMFEDLGLKYVGPIDGHDLEALESALTRAKRFGGPVIVHCLTEKGRGYQPALQDEADRFHAVGKIHPDTGLPISTSGADWTSVFGDEMLKLGKEREHVVAITAAMLQPVGLDKFAKAFPDRVYDVAIAEQ

SEQ ID NO: 40200 - protein, 111 aa, Oryza sativa
  misc_feature (27)..(27): Xaa can be any naturally occurring amino acid
QAFGQRVRPRVRGRVGVRQLVKPLLNXFHSEPGIGLWKRRADSTLRHCRTLESFLEETLDAIPNSVLDAPIGKEAYIEEGHFADMDSLLPPRYSSLTNGSCEIPALVTAST

SEQ ID NO: 40201 - protein, 556 aa, Burkholderia vietnamiensis G4
MRRRGIPPDSRFTRTAMTLNSLPAWTALQSHFAEIRHARLRDWFAPENDRAPTRAERFTIAGGGLAADFSKNRINDDTLRLLVQLARDTRVEARRDAMFAGDVVNPTEGRAALHTALRATDPNAPFHAQVSAERAKMASFARAVRSGAWTGHTGKRIRHVINIGIGGSDLGPKMVTHALHHVATPDISTHFVSNVDGADLARVLEQVDPEETLAIIVSKTFTTLETMTNARSLRDWFIARGCPEDALAKHFVGVSANPSEVVRFGIAADNVFEMWDWVGGRYSLWSAVGLSIMIAVGPDQFDELLAGANDMDRHFREAPLERNLPVLLGMIGIWYRNFFGSQSYLVAPYSEALHYLPSYLQQLEMESNGKSARLDGTFVDYPTSAVTWGEPGTNGQHAFFQMLHQGPTIVPIDFIAVLTPEHPLASHHPKLLANCFAQSEALMLGRTLDEARKIAGPGEEALAPHLTFPGNRPTTTLLVDALTPRTLGALIALYEHKVLVQATVWDINPFDQWGVELGKILGKVVEADLSADSVDPAKHDSSTTALIERARAALKR

SEQ ID NO: 40202 - protein, 219 aa, Streptomyces coelicolor A3(2)
GMAWEALNNIAAARDRPLIIVVNDNERSYAPTIGGLANHLATLRTTDGYERALAWGKDVLQRTPVVGHTVYEALHGAKKGFKDAFAPQGLFEDLGLKYLGPIDGHDIGAVESALRRAKRFHGPVLVHCLTEKGRGYEPALRDEEDHFHTVGVMDPLTCEPLGPAGGPSWTSVFGEEIVRIGEERADVVAITAAMLHPVGLAPFAERFPDRVWDVGIAEQ

SEQ ID NO: 40203 - protein, 218 aa, Streptomyces hygroscopicus
MAWEALNNIAAAKNRPLVIVVNDNERSYGPTIGGLANHLATLRTTDGYERFLARGKDLLERTPVVGRPLYETPHGAKKGLKDFITPQGMFEDLGLKYVGPIDGHDIEALESALQRAKRFGGPVIVHCLTEKGRGYQPALQDEADRFHAVGKIHPDTGLPISASGADWTSVFGEEMVKLGEEREDIVAITAAMLHPVGLTEFAKRFPDRVYDVAIAEQH

SEQ ID NO: 40204 - protein, 217 aa, Burkholderia vietnamiensis G4
MITRAELLDMLASNAPQGFEAQALGLVPIVVETSGRGERSYDIYSRLLKERLVFMVGEVNDQTANLVVAQLLFLESENPDKDISLYINSPGGSVSAGMAIYDTMQFIKPDVSTLCMGLAASMGAFLLASGAKGKRFALPNSRVMIHQPLGGARGQASDIEIQAREILYLKERLNNLLAQHTGQDVERIARDTDRDNFMSSDDAKAYGLIDQVLLKRP

SEQ ID NO: 40205 - protein, 480 aa, Zea mays
MASAAAPPTSLSLAARAATRAAAAAAAPLRRGGLATACQPARSLAFAAGDARLAVHVASRCRQAFSGRGTRAMATMAKKSVGELTEADLEGKRVFVRADLNVPLDENQNITDDTRIRAAIPTIQYILSKGAKVILSSHLGRPKGFTPKFSLAPLVGRLSELLGIQVQKADDVIGPEVEKLVAALPNGGVLLLENVRFYKEEEKNDPEFAQKLASLADLYVNDAFGTAHRAHASTEGVTKFLQPSVAGFLLQKELDYLVGAVSSPKRPFAAIVGGSKVSSKIGVIESLLEKCDILLLGGGMIFTFYKAQGLPVGASLVEEDKLELATSLLAKAKEKGVSLMLPTDVVIADKFAPDANSQIVPASAIPDGWMGLDIGPDSVASFNAALDTTKTVIWNGPMGVFEFDKFAVGTEAVAKKLAELSGKGVTTIIGGGDSVAAVEKVGVADVMSHISTGGGASLELLEGKELPGVVALNEAATVTV

SEQ ID NO: 40206 - protein, 220 aa, Streptomyces hygroscopicus
GMAWEALNNIAAARDRPLVIVVNDNERSYSPTIGGLANHLATLRTTDGYERFLARGKDLLERTPVVGRPLCGSLRGAKKGFKDAFAPQGMFEDLGLKYVGPIDGHDTEAVESALRRAKRFHGPVLVHCLTEKGRGYRPALEDEADRFHTVAAMDPLTCAPLTPSGGRSWTSVFGEEMVRIGAERPDVVALTAAMLHPVGLAGFAEAYPERVWDVAIAEQH

SEQ ID NO: 40207 - protein, 391 aa, Glycine max
  misc_feature (200)..(200): Xaa can be any naturally occurring amino acid
MKESSDGFVRADQIDLKSIDEQLERHLSKVLTIEKKKRSEGEEDADHVHLHVHTTSATASPKFSHASSAARVNFKKKKQDWEIDPSKLIIKTVIARGTFGTVHRGVYDTQDVAVKLLDWGEEGQRTEAEIASLRAAFTQEVAVWHKLDHPNVTKFIGATMGSSELQIQTDNGLIGMPSNVCCVVVEYLAGGNLKQYLIKXRRRKLAFKVVIQLALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEITSAVVRQNLRPEVPRCCPSSLANVMKKCWDASPDKRPEMDEVVSMLEAIDTSKGGGMIPHDQQQGCFCFRKHRGP

SEQ ID NO: 40208 - protein, 377 aa, Zea mays
MDTTSKKAYGVAVVIQLIYTGMYVVSKAAFDHGMSTYVFIFYRQAAATALLLPIAIVLERKNAPPMSFRLFLKLFFYALLGNTLSMNLYNISLKYTSATVASATSNSVPVVTFFLAVLLRLEVVRLRSPSGMAKAAGVALCLAGVLTIALYTGPSMSPVNHHRAFAAHQQHPHPHADGGGGGKGTWIKGTFLMLLSNTTWSLWIVLQASLLKEYPNKLLSTLVQCALSTAQSFLLAVAVERDPAAWKLQLDVGLLAVAYSGLVVTGVSFYLQAWCIEKRGPVFLAMSNPLGLLLTIFCSSFFLGEIVRLGSLLGSGLLVGGLYSVLWGKSKDHLHQEHQDDEEKQQQQPSAAGGDNQKQLKEQFAMEPSSPLRHQSG

SEQ ID NO: 40209 - protein, 498 aa, Tagetes sp. Nickrent 3061
  misc_feature (1)..(9): Xaa can be any naturally occurring amino acid
XXXXXXXXXSGVATLDKKNLGRIAQIIGPVLDVTFPPGKMPNIYNALVVKGRDTVGQPINVTCEVQQLLGNNRIRAVAMSATDGLTRGMDVIDTGAPLSVPVGGATLGRIFNVLGEPIDNLGPVDNSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFVDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGDEHYETAQQVKQTLQRYKELQDIIAILGLDELSEEDRLTVARARKIERFLSQPFFVAEVFTGSPGKYVGLAETIRGFQLILSGELDGLPEQAFYLVGNIDEATAKAINLEMESNLKK

SEQ ID NO: 40210 - protein, 571 aa, Lentisphaera araneosa HTCC2155
MTKKLFPFVNWFPMKSINLKDDLIAGITVALLLVPQSMAYAELAGLPVRYGLYAAIIPVALMALFGSMAQISGGPTAMTGIITASVLFPLVQDIPPEFRDARYIELAILLSLTVGICRLLMGVFKLSSLVNLISHPVIAGFTNAAAIVIALSQLPKLLGVTEVYIEQEFMGLIKSFAHFSDKIDQIHPLSAITGTLSLIGLVYLKKIYRKIPWPLVIVACSCFVFWKCDVVNESLIVGEIPSSFPALRFPQNSHGQWLDTLITLIPASIMITLIGFVETVSISKAISLKTRQPMNLDQELIGQGVGSIAGSFAQAYPVGSSFTRSALNLASGARTGMSNIFAVITVILVLLFLTPALYYLPKATLSAMIISSTFGLIDFEPIRVSWRVMRREGIVAIFTFVATLCFAPSIMDGFLWGAGISIAAYLYRTMKPRIDVFDWSEKCPLHLRTRSHHISALRFRCAIFFASVEAFEESIITCLAKNKNTRYMLIEAQSINRIDASGEWGLRNLVKDLKKNKVELVFAGLPPEACEMIQKTQLDELIGLNNFYPNSEAAINALHERINGNNLEYMI

SEQ ID NO: 40211 - protein, 402 aa, Brassica napus
  misc_feature (112)..(112): Xaa can be any naturally occurring amino acid
  misc_feature (141)..(141): Xaa can be any naturally occurring amino acid
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPXEGGVLLLENVRFYKEEEKNDPEFAKKLAXLADVYVNDAFGTAHRAHASTEGVAKYLKPSVAGFLMQKELDYLVGAVANPKKPFAAIVGGSKVSTKIGVIESLLSTVDILLLGGGMIFTFYKAQGHSVGSSLVEEDKLDLAKSLMEKAKAKGVSLLLPTDVVIADKFAPDANSKIVAATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELLEGKPLPGVLALDDA

SEQ ID NO: 40212 - protein, 435 aa, Thermus thermophilus
MIHDPAQLEKERPDRLRVLWLSTLAFTLMFAAWLMFGVLGVPIRKEFGLSDVQLSWISALAILNGSLWRLLAGILADRYGGRLVFTLMLFFTAIPAYLVSRAGSYEELLLYAFLVGFAGNSFSVGIAWNSAWFPKDQQGFALGVFGAGNVGASVTKFIGPALIASVPASGYLGGLIPGGWRFIPFLYAVLLVLMGFVLWFGTPRKDKRPGQGRPFLDMLKPLRYVRVWRFSLYYVVVFGAYVALSAWLPKYYVDVFGLPLHEAALLTALFIFPASLLRPVGGYLSDRFGARRIMYWTFGIILLASGVLMMPEGHIVLYTKQGAKEVMQFTMGVELFTLLVFLIGVGMGIGKAAVYKHIPTYFPQDVGAVGGLVGMLGALGGFFLPPLFAYAQAWTGLPQMTFFVLFLLAAISFLWMHLTVLKLLQQEAQHLKKRL

SEQ ID NO: 40213 - protein, 299 aa, Prochlorococcus marinus str. MIT 9301
MTKVINSYDFEKYLKQTKKVIEEALDFSLGPENPEILRESMRYSLLAGGKRIRPILCLASCSLAGGEPSLAVPTAVAIEMIHTMSLIHDDLPAMDNDDLRRGRPTNHKVYGDAVAILAGDALLTRAFEMVSLRSPGVDPNRLLNVIGELSLVAGAPGLVGGQVVDLECEGKEVDLDTLEYIHLHKTGALLKACVRTGAMIAGANEKLLQALTTYAEGIGLAFQIIDDILDLTSSSEKLGKTAGKDLLADKTTYPKLLGMEESKKRAFDLVEKAKKAIEPWGADANHLISLADFITNRDR

SEQ ID NO: 40214 - protein, 396 aa, Rhodococcus sp. RHA1
MSAAQWVAPVHAAAVADPAEALFRSTFGGAADGVWTAPGRVNLIGEHVDYAGGLVLPFALPYVTVVAVRVRGDGILHAVSTHTGESWHGPLDDVAPGHPAGWAAYVAGVVWALRRSGHLTAGTGFDVAVHSTVPVGSGLSSSAALECAFALAVADLAGLPTDDAGRRPLITASILAENEIAGASTGGMDQSVAMLARPGHALLLDCRDGATRHVPLDFDSADARLVVIDTNAPHRLVDGRYGTRRATIEKACADLGVATLRDVADTDTAVAALSSPAAQRVRHVLGEIRRVREVADLLDRGRISDIGDALNRSHASLRDDYEVSSVELDSAVDAALEAGAWGARMTGGGFGGSAIALVPADRVNAVAENVARRAGSASLPVPQFLHAEPSGSAHRL

SEQ ID NO: 40215 - protein, 78 aa, Bdellovibrio bacteriovorus HD100
MAIHPKVKDIIVEQLGVDPDKVKAEASFIDDLGADSLDIVELVMAMEEEFDLEIPDEDAEKLKTVQDVASYLEKKGKA

SEQ ID NO: 40216 - protein, 182 aa, Shewanella oneidensis MR-1
MPFNLPIALTLFRLFLLPIFVVLFYLPYSWTPFVAAFVFWLAALTDALDGYAARKLKQLTRFGAFLDPVADKLMVITALVLLVDQYADIWLTLPALFMIGREIVISALREWMAELGKRGTVAVSWIGKYKTAAQMVAIIGLIWQYNPLMIQAAFVLLYIAAVLTFWSKMSYILAAWKDLTAE

SEQ ID NO: 40217 - protein, 507 aa, Prochlorococcus marinus str. MIT 9301
MPSTLSNPLRLGLRQERVISPQCLVIFGASGDLTHRKLIPALFELYLQRRIPSEFGIVGCARRPWTDNEFREKMKVKLSNKISGKETEWEQFSNYLFYEPVDLQQSDHVVRLSKRLNEIDKKQATHGNRTFYLSVSPNFYASGCKALKEAGLLDDPKKSRLVIEKPFGRDYSSAKKLNKIVQSCAEENQIYRIDHYLGKETVQNILVLRFANTIFEPIWNRNYISSVQITSSETVGVEDRAGYYESSGALRDMLQNHMTQMLAVTAMEPPGKFEPEAIRNEKAKVLQASKLADENEPWNCCIRGQYGEGGNISNQLKGYRQEDGVNSNSTTETYIATKVFVDNWRWQGVPFYLRTGKRLPKRLGEIVLTFKDVPVHLFESTIINPAPNQLILRIQPNEGATFKFEVKSPGSGMKSRPVEMEFSYDESFGEPSDEGYVRLLADAMLSDPTLFTRSDEVEAAWKLYTPLIELMDNSPWKLPIYNYESMTWGPPESDQLLSKDNIFWRRP

SEQ ID NO: 40218 - protein, 215 aa, Synechococcus sp. WH 8102
MTDSSPQSNPNAVPGAADVPAAAEGQQQEQRRGGGRGERGDRRGGRRGDRRNQERDSEWQERVVQIRRVSKTVKGGKKMSFRAIVVVGNEKGQVGVGVGKAGDVIGAVRKGVADGKKHLVKVPLTRHNSIPTLSNGRDGAASVLIRPAAPGTGVIAGGSIRTVLELAGIKNVLAKRLGSKTPLNNARAAMVALSLLRTHKETAKERGISLEQIYS

SEQ ID NO: 40219 - protein, 215 aa, Streptomyces hygroscopicus
GMAWEALNNISGTPDRPVVIVVNDNGRSYAPTTGGLATYLAGLRTSPDYEWFLEWSKHQLRQTPKLYEALHAVKTGLKDMLAPQGLFADLGLKYLGPVDGHDIAAVEAALRQAAGFGGPVVVHCLTRKGHGYRRAEADERDHHHAVGASDPATGEPLGSPGPSWTSVFGAELVEIGRERPEVVAVTAAMLQPTGLAAYAEEFPDRVFDVAIAEQH

SEQ ID NO: 40220 - protein, 219 aa, Streptomyces lividans
GMAWEALNNIAAAKDRPLVIVVNDNERSYAPTIGGLANHLATLRTTDGYERFLARTKEVLERTPVVGRPLYDTLHGAKKGLKDFIAPQGMFEDLGLKYVGPIDGHDLEALESALTRAKRFGGPVIVHCLTEKGRGYQPALQDEADRFHAVGKIHPDTGLPISTSGADWTSVFGDEMLKLGKEREDVVAITAAMLQPVGLDKFAKAFPDRVYDVAIAEQH

SEQ ID NO: 40221 - protein, 291 aa, Boletus edulis
LENPEINITAVNDPFIDLDYMVYMFKYDSVHGRFEGEVSTKDGKLVINGKAITVFAERDPANIPWGTVGAQYVVESTGVFTTIEKASAHLKGGAKKVIISAPSSDAPMFVCGVNLDAYDPKHTVISNASCTTNCLAPLAKVVNDKFGIVEGLMTTVHATTATQKTVDGPSPKDWRGGRAVNNNIIPSSTGAAKAVGKVIPVLNGKLTGLAFRVPTLDVSVVDLVVRLAKPTSYEEIKTAFKEASESSELKGIVAYTEDAVVSTDFLGHHASSIFDATGGIMLNDSFVKLIA

SEQ ID NO: 40222 - protein, 331 aa, Candida albicans
MAIKIGINGFGRIGRLVLRVALGRKDIEVVAVNDPFIAPDYAAYMFKYDSTHGRYKGEVTASGDDLVIDGHKIKVFQERDPANIPWGKSGVDYVIESTGVFTKVEGAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRLPTTDVSVVDLTVRLKKAASYEEIAPAIKKASEGPLKGVLGYTEDAVVSTDFLGSSYSSIFDEKAGILLSPTFVKLISWYDNEYGYSTKVVDLLEHVA

SEQ ID NO: 40223 - protein, 219 aa, Streptomyces lividans
MAWEALNNIAAARDRPLIIVVNDNERSYAPTIGGLANHLATLRTTDGYERALAWGKDVLQRTPVVGHTVYEALHGAKKGFKDAFAPQGLFEDLGLKYLGPIDGHDIGAVESALRRAKRFHGPVLVHCLTGKGRGYEPALRDEEDHFHTVGVMDPLTCEPLGPAGGPSWTSVFGEEIVRIGEERADVVAITAAMLHPVGLAPFAERFPDRVWDVAIAEQH

SEQ ID NO: 40224 - protein, 582 aa, Marinobacter sp. ELB17
MAMPKMLRNLPGIATGLRSAFKEGYGLADLRKDVMAGLTIGTVAVPLSMALAIATGVPPQHGLYTAIVAGVIIALTGGSRFNVSGPTAAFVVILFPIVQQYGLGGLLIASMMAGLILVALGLARMGQLIQFVPYPVVLGFTAGIAVVIAVLQIPDFLGLEVGQMGEHFVENLGRIGASLPSINPFELGIGFFSLAVFILWPRLKLPLPAPLMGLVAGAIGAYLINSLMGGDGTTVETIASRFTWEHQGDVGSGIPPIAPTFMVPWSLPGANGEPLKLNFELIRSLMGPAFAIAILGAIESLLCAVVSDGMTKTRHDPNAELIGQGLGNIVAPLFGGVTATAAIARTATSIRSGARSPIAAVVHSLVVLLSVVALAGLLGLVPMAALAALLLVVAWNMSEARHFMHTLRSAPAGDVGVLLVCFGLTVIFDMVLAVAVGIGLAAALFIRRMALLTRTDKIDTETHSTVNGLPPEVAVYGVNGPMFFGAAEKALTSLRLVDPQVRIIILDMQGVPSMDGTAIVNLQTLVEDMLQDNVSLILTGLPTRIIVKLRRAHVRKVIGRLTYAGSLTQARAIALRWLASQR

SEQ ID NO: 40225 - protein, 337 aa, Claviceps purpurea
MAVKVGINGFGRIGRIVFRNAVEHPEIEVVAVNDPFIDPEYAAYMLKYDSSHGVFKGEIKKDADGLIVNGKKVKFHTERDPSAIPWKASGAEYIVESTGVFTTTEKAKAHLTGGAKKVIISAPSADAPMYVMGVNEKTYDGKADVISNASCTTNCLAPLAKVIHDKYTIVEGLMTTVHSYTATQKTVDGPSGKDWRGGRGAAQNIIPSSTGAAKAVGKVIPDLNGKLTGMSMRVPTPNVSVVDLTVRIEKGATYDEIKATVKEAANGSLAGILGYTEDDIVSSDMNGNTNSSIFDAKAGISLNKNFVKLIAWYDNEWGYSRRVLDLLAYVAKADASK

SEQ ID NO: 40226 - protein, 219 aa, Streptomyces caeruleus
GMAWEALNNIAAAKDRPLVIVVNDNERSYAPTIGGLANHLATLRTTDGYERFLARGKDILERTPVVGRPLYETLHGAKKGLKDFIAPQGMFEDLGLKYVGPIDGHDLEAMESALQRAKRFGGPVIIHCLTEKGRGYQPALQDEADRFHAVGKIHPDTGLPIASSGVDWTSVFGEEMVKLGNERADIVAITAAMLQPVGLEKFAKAFPDRVYDVGIAEQH

SEQ ID NO: 40227 - protein, 338 aa, Blumeria graminis f. sp. hordei
MAPIKVGINGFGRIGRIVFRNAAQSCEVEVVAVNDPFIEPEYAAYMLKYDSTHGQFNGDIQTVEDGLVVNSRNVKFYNKRNPEEIPWAETGAEYIVESTGVFTTTEKAKAHLKGGAKKVIISAPSADAPMFVMGVNHKSYTTDLEVISNASCTTNCLAPLAKVINDEFTIIEGLMTTIHSYTATQKTVDGPSAKDWRGGRTAAQNIIPSSTGAAKAVGKVIPALNGKLTGMAMRVPTANVSVVDLTCRIEKSATYDEIKKAIKIAAGNELQGILSYTEDEIVSTDLIGNNHSSIFDAKAGISLNDNFVKLVAWYDNEWAYSRRVIDLISYIAGKDGSK

SEQ ID NO: 40228 - protein, 331 aa, Kluyveromyces marxianus
MVRIAINGFGRIGRLVLRIALSRKNIEVVAINDPFITVDYAAYMFKYDSTHGRFDGEVSHDGKSLIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 40229 - protein, 220 aa, Streptomyces caeruleus
GMAWEALNNIAAARDRPLVIVVNDNERSYSPTIGGLANHLATLRTTDGYERFLAWGKDVLQRTPVVGQPLYGSLHGAKKGFKDAFAPQGMFEDLGLKYVGPIDGHDTEAVESALRRAKRFHGPVLVHCLTEKGRGYRPALEDEADRFHTVAAMDPLTCAPLTPSGGRSWTSVFGEEMVRIGAERPDVVALTAAMLHPVGLAGFAEAYPERVWDVAIAEQH

SEQ ID NO: 40230 - protein, 315 aa, Triticum aestivum
  misc_feature (298)..(298): Xaa can be any naturally occurring amino acid
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSRRSHSRSSRSPSPYRHHARDRDRSSRSRDRGDYYGGSLDRGDYGDYYHHSRRSSERNRNYDSDGSRLRRRHRSRTRSPVREGSEERRAKIEQWNREREAPDRQGSEXRRAKIEQWNRERETAQA

SEQ ID NO: 40231 - protein, 128 aa, Arabidopsis thaliana
MSTMKPSRSDEITDHPEADKFQSLQSQTHGKVLGEGDSSAVQDEFLETEYYSNLTAIDKQHHTTGSGFINVVKEDNGEESEAVTAAAIGDGGEKAVYRSNPATNEWIPATEEDFDSESSSKPNRSESS

SEQ ID NO: 40232 - protein, 640 aa, Arabidopsis thaliana
MLLHCNVSYYTSTFSFISSSLRRQDNADDSQDTVIRRRHNARSISLYIRHNRDLKLNKNPNESQETFVPPPPPPRRDLDGENRSKLLELSLVTRRTPQFPGSIYAQSASDADIASSLPSLRNFLGSDGDDDGESEREMIVKALEIRRKVTKEIIKESLVRKGRFGITYATNVTDRLGDFVDHVMIQAAALKRLPEFSESRFNLRARTVIEDSNFVPLVRWLKHHELSYNRIAKIICMSKGNLDSIRIMIEWLKSIHVKGEFIAVAFLRSGDNILQRNREELNEIVEYLESNGVRRDWMGYVVGRCPELLSFSMEEVKSRVDFFLKMGMNQNDFGTMVYDYPKIIGFFSFQVMEKKINYLKEFGLSTEEVGRLLAYKPHLMGCSIEERWKPLVKYFYYLGIPKEGMKRILVVKPILYCIDLEKTIAPKVRFLQEMGIPNEAIGNMLVKFPSLLTNSLYKKIRPVIFLLTRAGVTQKDIGKVIAMDPALLGCSIGTKLEPNMRYYISLGIRFYQLGEMIADFPMLLRYNVDNLRPKYRYLRRTMIRPLQDLIEFPRFFSYSLERRIIPRHTIMVENRVNFKLRYMLACTDEEFERRVRDKVERRERFEAGLDSEDSQPSDENISDQEIAFSDEAEEEEDLTE

SEQ ID NO: 40233 - protein, 331 aa, Prochlorococcus marinus str. MIT 9301
MTSFITAMQSKESNFNLTNSRLRLVSGTTNPKLAEEIASYLGIENVPLISKRFADGELYVQIQQSIRGCDVFLIQPTCAPVNDSLMELMIMVDACKRASARQITAVIPYFGYARADRKTSGRESITAKLTANLLEKSGVDRVLAMDLHSAQIQGYFDIPCDHIYGSPVLIDYLETLDLEEIVVVSPDVGGVARARAFAKLMKDAPLAIIDKRRSAHNIAESLTVIGEVKGKTAILIDDMIDTGGTICSGANLLKQEGANRIFACASHAVFSPPSYERLSAKNLFEQVIVTNSIPVLHKDNFPQLKVLSVANMLGEAIWRIHEESSVSSMFR

SEQ ID NO: 40234 - protein, 533 aa, Burkholderia thailandensis E264
MKSSIQRNIGPFALMLTGLGSIIGSGWLFGAWKAAKIAGPAAICAWIIGAVVILAIALTYAELGAMFPESGGMVRYARYSHGSLVGFISAWANWIAIVSVIPIEAEASIQYMSTWPYAWAHALFVNGELTTPGLLLSAVLVVIYFLLNYWGVKLFARANTTITIFKFLIPGLTIAGLLLSSFHSENLGTAGGSSSFAPYGWSAVLTAVATSGIVFAFNGFQSPVNLAGEARNPSRSVPFAVISSILIALVIYVLLQVAYIGAVNPADVAKGWAHFNFASPFAELAIALNLNWLAILLYVDAFVSPSGTGTTYMATTTRMIYAMERNNTMPKIFGSVHPLYGVPRPAMWFNLIVSFIFLFFFRGWSSLAAVISVATVISYLTGPISLMALRRAATDLERPLSIPGMKLIAPFAFVCASLILYWAKWPLTGEIILLMVVALPVYFYFQGKSGWSGWGRDLKAAWWLVAYLPTMAVLSLIGSKEFGGHGLLPYGWDMLVVAAIALVFYYWGVNTGYRTEYLDERESRDEILEGIGA

SEQ ID NO: 40235 - protein, 420 aa, Oryza sativa Japonica Group
MARGIRMKPTYVPHVVSPAAQSPWIYVVVWYQNYENPFHNSPVVVFVIYVEFIVSPVRRYRSTPRCRGDCYHSSQSDSRRKKKKQQQQSSQPVRRARSNRGSKRRRREDSTVRLYRLMGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKKDSQLHSFARARWRNWIGIGWQEYLSPVLRSPDKGVVRYGRGDSRRETCLHVWRSLLSRAPSIPPGSKGRPLLRFCLPLQFYYCCPYRVRLASVYLKQSHINSAHHSLR

SEQ ID NO: 40236 - protein, 122 aa, Bacteroides fragilis YCH46
MTTQHYIFLENVRFYSYHGVAPQETAIGNEFIINLRLKTDFGKATETDEVEDTVSYADIYATLKEEMELPSKLLEHVCGRIVKRLFRDFRKIKEIEIKLAKRNPPMGADIDSAGVEMHCTRD

SEQ ID NO: 40237 - protein, 336 aa, Emericella nidulans
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGILGYTEDDIVSTDLNGDTRSSIFDAKAGIALNSNFIKLVSWYDNEWGYSRRVVDLITYISKVDAQ

SEQ ID NO: 40238 - protein, 558 aa, Zea mays
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLSYKRTTRFTFICSIQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGTLGLWKDNVASYLHYLILHSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 40239 - protein, 337 aa, Lyophyllum shimeji
MVNVGINGFGRIGRIVFRNALLNPKIQVVAINDPFINLEYMVYMFKYDSVHGRFKGTVEAKDGKLWIQGKPVIVYGEKNPSDIKWGAAGRDYVVESTGVFTTVEKAEGHLKGGAKKVIISAPSADAPMFVMGCNLDQYDPKYTVISNASCTTNCLAPLTKVIHDKYGIIEGLMSTIHATTATQKTVDGPSNKDWRGGRAVVNNIIPSSTGAAKAVGKVIPSLNGKLTGLSFRVPTIDVSVIDLVVRLEKPASYEDIKKTVKEASEGAYKGIIEYTEEQVVSADFIGHHASSIFDAQAGIQLNPNFVKLIVWYDNEWGYSARVCDLLVFAAEQDAKQQ

SEQ ID NO: 40240 - protein, 333 aa, Pichia pastoris
MAITVGINGFGRIGRLVLRVALSRADIKVVAINDPFIAPEYAAYMFKYDSTHKAYKGEVSASGNKINIDGKEITVFQERDPVNIPWGKAGVDYVIESTGVFTTLEGAQKHIDAGAKKVVITAPSKDAPMFVVGVNEEKYTSDLNIVSNASCTTNCLAPLAKVVNDTFGIESGLMTTVHSMTATQKTVDGPSHKDWRGGRTASGNIIPSSTGAAKAVGKVIPELNGKLTGLAFRVPTVDVSVVDLTVNLKKETTYEEIKSVIKAASEGKLKGVLGYTEDAVVSSDFLGDERSSIFDASAGIQLTPSFVKLISWYDNEYGYSTRVVDLLQHVAKA

SEQ ID NO: 40241 - protein, 449 aa, Glycine max
MGSHQQEPWLLENGKPRVLTKETRHGRSAHRMSSTSLRKKSSRTLVSKVPCATLRNFLLNLQEVILGTKLSILIPAIPAAIVAECFGFGRPWIFILSLLGLTPLAERVSFITEQVAFYTGPTVGGLLNATCGNVTELIIAIFALSSNKIAVVKYSLLGSILSNLLLVLGTSLLCGGIANLKVEQKYDRRQADVNSLMLLLGLLCYLLPMLFKYSGASAALTVDPSLHLSRASSIVMLIAYVVYIVFQLWTHRQLFEAEDEGEDGEDGEEEQAVIGLWSGIAWLVGMTVFIAVLSEYVVDTIEDASDSWGLSVSFLSIILLPIVGNAAEHAGAIIFAFKNKLDISLGVALGSATQIAMFVVPLCVIVAWIMGIDMDLNFNLLETGSLALAIIVTGFTLQDGTSHYMKGLVLLLCYIVIGACFFVQRTPFNNQADVTNITLKPTTNAVLSA

SEQ ID NO: 40242 - protein, 414 aa, Marinobacter sp. ELB17
MTKNFKQAALDYHSKPVPGKISTGLTKPASTVGDLSLAYSPGVAEPVREIARDPDNAYLYTGKGNLVAVITNGTAILGLGNLGPLASKPVMEGKALLFKRFAGIDSVDIEVKADTAQAFIDTVISISDTFGGINLEDIKAPECFEIERVLIDRCDIPVFHDDQHGTAIVTAAGMLNALEIQGKTLNTARIVCLGAGAAAVACMRMLLSLGAKRENLYMVDRRGVIRSGREGLNSFKEKFINDGGAKTLDDAIDSADVFVGLSGPDLLNAEQLKQMAPRPIVFACSNPDPEISPELAMSVRDDLIMATGRSDYPNQVNNVLGFPFIFRGALDVRAKRINEAMKVAAVYAIRDLAKKEIPQDVLAAHQLRELSFGPHYIIPKAMDYRLLTEVSDAVAKAAIESGVARLPYPSHYPL

SEQ ID NO: 40243 - protein, 182 aa, Burkholderia vietnamiensis G4
MKTVGDKLEAFTVVAAKPGFNNHEENGQSAFETVTETSFPGKWKIIYFYPKDFTFVCPTEIVEFAKLAKQFEERDAVLLGGSSDNEFVKLAWRREHKDLDKLNHYSFGDVKGELIDQLGVRDKEAGVALRATFIVDPDNTIQHVSVNNLNVGRSPEEVLRILDGLQTDELCPCNRAVGGATL

SEQ ID NO: 40244 - protein, 220 aa, Streptomyces caeruleus
GMAWEALNNIAAAKDRPLIIVVNDNERSYAPTIGGLAGHLATLRTSDGYEQVLAWGKEVLQQTPVVGRPLYGSLHGAKKGFKDFVAPQGMFEDLGLKYVGPVDGHDIAAVETALRRASRFTGPVLVHCITEKGRGYQPALDDEADHFHTVGVMDPLTCEPLAPAGKPSWTSVFGDEILAIGEERPDVVAVTAAMLHPVGLTGFAARFPDRVWDVAIAEQH

SEQ ID NO: 40245 - protein, 97 aa, Zea mays
MDYSNLRRQAASMKKTLFDQGYLDEQFCQVEDLQDEASPNFAEEVVTLFFKDSARLISNAEQALEKYPKDFNRWDAYMQQLKGSCSRYLGAASGYFF

SEQ ID NO: 40246 - protein, 94 aa, Brassica napus
  misc_feature (32)..(32): Xaa can be any naturally occurring amino acid
GDNIYAHTLASIMSGLASTTLSCPADVVKTRXMNQGEKGVYRSSYDCLVKTVRFEGVRALWKGFLPTWGRLGPWQFVFWVSYEKFRQLAGLSSF

SEQ ID NO: 40247 - protein, 338 aa, Trichoderma atroviride
MSIKVGINGFGRIGRILLSNALEKPELSVVAVNDPFIEPTYAAYMLKYDSSHGLFKGDIEVDGQNLVVNGKPIRFYSERDPANIKWSETGAEYIVESTGVFTTIDKAKAHLNGGAKKVIISAPSADAPMFVMGVNHKDYDGTPTVLSNASCTTNGLAPLVKIVNDNFGIVEGLMTTVHSYTATQKTVDGPSGKDWRGGRGAAQNIIPSSTGAAKAVGKVIPAMNGKITGMSFRVPSANVSVIDLTVRLEKAASYEEITSAIKKAADGELKGIMAYTSDEVVSTDMLGNNNSSIFDIKAGISLNPNFVKLVSWYDNEWGYSRRVLDLLEHVAKVDASKK

SEQ ID NO: 40248 - protein, 174 aa, Mycobacterium tuberculosis H37Rv
MPLFSFEGRSPRIDPTAFVAPTATLIGDVTIEAGASVWFNAVLRGDYAPVVVREGANVQDGAVLHAPPGIPVDIGPGATVAHLCVIHGVHVGSEALIANHATVLDGAVIGARCMIAAGALVVAGTQIPAGMLVTGAPAKVKGPIEGTGAEMWVNVNPQAYRDLAARHLAGLEPM

SEQ ID NO: 40249 - protein, 158 aa, Burkholderia vietnamiensis G4
MDFRIGQGYDVHQLVPGRPLIIGGVTIPYERGLLGHSDADVLLHAITDALFGAAALGDIGRHFSDTDAAFKGADSRVLLRECAARVKAAGFTIQNVDSTVIAQAPKLAPHIDGMRANIAADLGLPLERVNVKAKTNEKLGYLGRGDGIEAQAAALLVK

SEQ ID NO: 40250 - protein, 334 aa, Clostridium pasteurianum
MTKVAINGFGRIGRLALRRILEVPGLEVVAINDLTDAKMLAHLFKYDSSQGRFNGEIEVKEGAFVVNGKEVKVFAEADPEKLPWGELGIDVVLECTGFFTKKEKAEAHVRAGAKKVVISAPAGNDLKTIVFNVNNEDLDGTETVISGASCTTNCLAPMAKVLNDKFGIEKGFMTTIHAYTNDQNTLDGPHRKGDFRRARAAAVSIIPNSTGAAKAIAQVIPELKGKLDGNAQRVPVPTGSVTELISVLKKNVTVEEINAAMKEAANESFGYTEDEIVSADVVGISYGSLFDATLTKIVDVDGSQLVKTVSWYDNEMSYTSQLVRTLEYFAKIAK

SEQ ID NO: 40251 - protein, 179 aa, Streptomyces caeruleus
GMAWEALNNLGGARQRPVIVVLNDNERSYAPTVGGLATHLGKLRSARGPGNVFEEFGFGYLGPVDGHDIAAVEEALGRARALGGPVVVHVVTEKGRGWETAETNELDRCHVVRATPSSSAAPASSPSWTAVFSDEMVRIGAERPDVVAITAAMAEPVGLLDFQREFPARTIDVGIAEQH

SEQ ID NO: 40252 - protein, 220 aa, Streptomyces caeruleus
GMAWEALNNIAAAKDRPLVIVVNDNERSYAPTIGGLANHLATLRTTDGYERFLARGKDILERTPVVGRPLYETLHGAKKGLKDFIAPQGMFEDLGLKYVGPIDGHDLEAMESALQRAKRFGGPVIIHCLTEKGRGYQPALQDEADRFHAVGVMDPLTCEPLAPAGKPSWTSVFGDEILAIGEERPDVVAVTAAMLHPVGLTGFAARFPDRVWDVAIAEQH

SEQ ID NO: 40253 - protein, 457 aa, Iris x hollandica
MVGILVYVALFILSLLLFLTAAAKLHNSKSKIKNQAPSPPSLPVVGHLHLLKKPLHRSISLLSARHGPILLLRFGSRPALAVSSLPLAEECLSGKNDLAFANRAHFPHEAAPLQLLTLGSANYGPHWRMLRRISAVELLSSHRINSFSQLRSEEVHSMISTLFRESSDKELNRVELKSKLFELAMNNMMRMIFGKDLASSEGAGRFREMVKESHSLLGASTRLGDFFPFLGWMDWRARRMVLRLVRRRDEFLQSLIDAHARKMEEVEEKTMIRVLVELQKSNRESNNDEGFMLKPLIIGLLQAGTDTSSDTIEWAMSLLLNNRDKLKKARDEIDARVGKERLLRESDLPNLPYLQCVITETLRLYPAAPLLVPHESAEECTVGGYAVPQGTMLLVNAYAIRVVGIVLGTLIQCFEWERVGEEEVDMTEGSGLTLPRANPLEAICRPRQSMISVLAGL

SEQ ID NO: 40254 - protein, 332 aa, Streptomyces aureofaciens
MTRIAINGFGRIGRNVLRALLERDSDLDVVAVNDLTEPATLARLLAYDTTSGRLGRPVTVEGNVLVVDGRRITVTAEREPANLPWAELGVDIVLEATGRFTSAKAARAHLDAGAKKVLVSAPADGADITLAFGVNTDAYDPDLHTIVSNASCTTNALAPLAKVLDDLAGIEHGFMTTVHAYTQEQNLQDGPHRDPRRARAAAVNIVPTTTGAAKAIGLVLPNLDGKLSGDSIRVPVPVGSIVELNTTVARDVTRDEVLDAYRAAAQGPLAGVLEYSEDPLVSSDITGNPASSIFDSELTRVDGRHIKVVAWYDNEWGFSNRVIDTLQLLAAR

SEQ ID NO: 40255 - protein, 539 aa, Marinobacter sp. ELB17
MSRSQQLSELKKQTQSFDVVVIGAGITGAGIALEAAASGLKTLVLEQQDFAWGSSSRSSKMVHGGLRYLAGGHLRLARSAVQERQRMLAEAPGLVMPMHYVMPHYKGEFPGPRLFRLMLRLYNRLAGAATLPPLQPAQVPLWVPGLNSENLAAASVFTDAVTDDTRLVQRLLAEARAKGALCLNYVKVLKLQRNADSQKQVCGLVAQAEEDTKPFTIKTLLAIAATGAWSSQFKSAEEKQFPIRPLRGSHLVLPWQRLPVDCSVTAFHPKDRRPVFVFPWLGQTVLGTTDLDHNEDLAQEPAISQGEVDYLMAVAAHLFPASELKPADVLSSWAGVRPVISTQENDGIKRSPSRESREHKINNDNGLITIAGGKLTTFRLIAREALKMGLSGGTKPKLRDNRLRVFNPAPELQKPARISHKTWARLRGYYGPDLPALLAAGPLEPVLDASLVHNPAIDVTWAELCYACRNEQVKHLDDLLLRRTRLGLLIADGAAVLLPQIKSRCRPLLGWSESHWHSEVERYMAIWQSYYSLPPGTAE

SEQ ID NO: 40256 - protein, 218 aa, Streptomyces rishiriensis
GMAWEALNNIADGDRPLVIVVNDNERSYAPTIGGLANHLATLRTTDGYERFLARGKDLLERTPVVGKPLYETLHGAKKGLKDFIAPQGMFEDLGLKYVGPIDGHDIEALESALARAKRFGGPVIVHCLTEKGRGYQPALQDEADRFHAVGKIHPDTGLPIATSGADWTSVFGEEMVALGKEREDIVAITAAMLQPVGLDKFAKAFPDRVYDVAIAEQH

SEQ ID NO: 40257 - protein, 335 aa, Haloarcula vallismortis
MMSEPVRVGLNGFGRIGRNVFRASLHSDDVEIVGINDVMDDSEIDYFAQYDSVMGELEGASVDDGVLTVDGTDFEAGIFHETDPTQLPWDDLDVDVAFEATGIFRTKEDASQHLDAGADKVLISAPPKGDEPVKQLVYGVNHDEYDGEDVVSNASCTTNSITPVAKVLDEEFGINAGQLTTVHAYTGSQNLMDGPNGKPRRRRAAAENIIPTSTGAAQAATEVLPELEGKLDGMAIRVPVPNGSITEFVVDLDDDVTESDVNAAFEDAAAGELEGVLGVTSDDVVSSDILGDPYSTQVDLQSTNVVSGMTKILTWYDNEYGFSNRMLDVAEYITE

SEQ ID NO: 40258 - protein, 220 aa, Streptomyces rishiriensis
GMAWEALNNIAAAKDRPLIIVVNDNERSYAPTIGGLANHLATLRTTDGYEKVLAWGKDVLLRTPLVGNTVYESLHGAKKGFKDAFAPQGMFEDLGLKYVGPIDGHDLGAVESALRRAKRFHGPVLVHCLTEKGRGYEPALAHEEDRFHTVGAMDPLTCAPLAPAGGPSWTSVFGDEIVAIGEERDDVVAITAAMLHPVGLGKFAERFPGRVWDVGIAEQH

SEQ ID NO: 40259 - protein, 320 aa, Coccidioides immitis RS
MATNSIKLLTGNSHPELAQLVADRLGIELTRVMVSQYSNQETSVTIGESVRDEDVFILQSTRPNDINDGLMELLIMINACKTASARRITAVIPNFPYARQDKKDKSRAPITAKLMANMLQTAGCNHVITMDLHASQIQGFFNVPVDNLYAEPSMLRWIRQNLDVSNCVIVSPDAGGAKRATAIADRLDLQFALIHKERPRPNEVSRMVLVGSVKDKIAIIVDDMADTCGTLVKAASTLIDNGAKEVLAIVTHGILSGKAIETLNTGRLSRIVVTNTVPHEEKKLLCDKIETIDISPVLAEACRRTHNGESVSFLFSHAVS

SEQ ID NO: 40260 - protein, 239 aa, Coccidioides immitis RS
MKLNIAYPANGSQKLIEIDDERKLRPFMEKRMGTEVPGDSLGDEFKGYLFKITGGNDKQGFPMKQGVLLPNRTRLLLSTGHSCYRPRRTGERKRKSVRGAITGYDLAVMALTVVKQGEGDIPGLTDVVNPKRLGPKRASKIRKFFGLDKKDDVRKFVIRRTVTPTKEGKKEYTKAPKIQRLVTPQRLQRKRQRIALKRRRAESAKEQANEYAKLLAARVHEEKAKREELRKRRASSMRK

SEQ ID NO: 40261 - protein, 343 aa, Zea mays
  misc_feature (167)..(167): Xaa can be any naturally occurring amino acid
MSAAKEAGPSSRAVLVTGGAGYIGSHAVLQLLTAGFRVVVVDSLANSSELVIRRLRSLAGEHAKNLAFHKVDIRDTDGLKKVFASTRFDAVIHFAGLKAVGESVQKPLLYYDHNVVGTINLLEVMAAHGCKKLVFSSSAAVYGSPNNPPCTEDFPLTPHNPYGRTKXYFNPVGAHPSGYLGEDPCGTPNNLMPFVQQIAVGRRPSLTIFGNNYATKDGTGVRDYIHVVDLAEGHLFALKKLFESSSNIGCEAYNLGTGKGTSVLEIVNAFEKASGKKIPLVMGQRRPGDAEVLFSSPAKAERELHWKAKYGITEMCRDLWNWASKSPYGYAASESPKLNGSSR

SEQ ID NO: 40262 - protein, 277 aa, Arabidopsis thaliana
MKTIILFVTFLALSSSSLADETETEFHYKPGEIADPSKWSSIKAEWKICGTGKRQSPINLTPKIARIVHNSTEILQTYYKPVEAILKNRGFDMKVKWEDDAGKIVINDTDYKLVQSHWHAPSEHFLDGQRLAMELHMVHKSVEGHLAVIGVLFREGEPNAFISRIMDKIHKIADVQDGEVSIGKIDPREFGWDLTKFYEYRGSLTTPPCTEDVMWTIINKVGTVSREQIDVLTDARRGGYEKNARPAQPLNGRLVYLNEQSSPSPTPRLRIPRVGPV

SEQ ID NO: 40263 - protein, 207 aa, Vibrio cholerae O1 biovar eltor str. N16961
MLRSKKMVLVGRKAPDFTAAAVLGNGEIVDNFNFAEFTKGKKAVVFFYPLDFTFVCPSELIAFDNRYEDFLAKGVEVIGVSIDSQFSHNAWRNTAVENGGIGQVKYPLVADVKHEICKAYDVEHPEAGVAFRGSFLIDEEGMVRHQVVNDLPLGRNIDEMLRMVDALNFHQTHGEVCPAQWEAGKAGMEASPKGVAAFLSQYSADLK

SEQ ID NO: 40264 - protein, 393 aa, Rhodococcus sp. RHA1
MRAVTWQGKRKVSVDTVPDPVIEQKTDAIVEITTTNICGSDLHLYEVLGAFMSEGDILGHEPMGIVREVGSEVTDVKVGDRVVIPFQISCGNCHMCDRKLFTQCEITQNRDEGTGAALFGYSKLYGSVRGGQAEYLRVPHVKNTHITVPDGPPDSRFVYLSDVLPTAWQAVEYADIPDGGSVVVLGLGPIGDMAARIAAHNGFRVIGVDLVPERLARPQARHIETVDLTDAEGELGDVIREMTGGRGPDSVIDAVGMEAHGSPGAKLLQQVTSYLPDALAGPLMSTVGIDRLHALYSAIDIVRRGGTLSLIGVYGGMADPIPMLTLFDKQIQVRMGQANVKRWVPDILPLLTDADPLGVDTFATHELPLDHAPHAYEIFQKKEDGAVKILLKP

SEQ ID NO: 40265 - protein, 224 aa, Brassica napus
  misc_feature (17)..(17): Xaa can be any naturally occurring amino acid
DLEGGSIHVDGEGTCLXTEECLLNKNRNPHMSKEQIEEELKCYLGVQTFIWLPRGVDGDVRTNGHIDNMCCFAKPGVVLLSWTDDETDPQYERSVEALSVFSNSIDARGRKIEVIKLHVPGPLYMTEEEASGIVQEGEAKPRIAGTRLAASYVNFYIANGGVIVPRFGDAKRDEEAIRVLSETYPHHSVVGIENAREIVLAGGNIHCITQQQPAEPISIADDGH

SEQ ID NO: 40266 - protein, 275 aa, Nostoc sp. PCC 7120
MNILTNLLSQTPKPSPAKKQRRGIEIKSPREIDIMRESAKIVATVLKEISGLVKPGMTTADLDAYAEKRIREMGATPSFKGYHGFTGSICSSINNEVVHGIPSHKKVIRTGDVLKVDTGAYFQGFHGDSCITIAVGEVTPDAAKLIRVAEEALYKGIEQVKAGAYLLDLAGAIEDHVKVNGFTVVEEFTGHGVGRNLHEEPSVFNYRTREMPNVKLRAGMTLAIEPILNAGSKHTRTLSDRWTAVTVDNSLSAQFEHTVLVTETGYEILTDRTKV

SEQ ID NO: 40267 - protein, 202 aa, Nostoc sp. PCC 7120
MIFWFCNQPPRMELFQCSWVPYSYSIVSTTSYWPSPDFSQAAFIAANAVVMGSVKIAAGASIWYGAVVRADVESIEIGECTNIQDGAILHGDPGLPTVLEDHVTVGHRAVIHSAHIERGSLIGIGAVILDGVRVGAGSIIGAGSIVTKNIPPLSLVVGVPGKVLRPITPEEAADLIQHAERYKKLALVHAGKGSDIGFYPQE

SEQ ID NO: 40268 - protein, 498 aa, Novosphingobium aromaticivorans DSM 12444
MSLNFNNYRRQWFTDGSTARRDILAGIVVALALIPEAIGFSIIAGVDPRVGLYASVAIAITIALIGGRPGMISAATAAVAVLVVPLVRDHGVEYLFAATILMGVIQIVAGLLRLNLVMQFVSRSVITGFVNALAILIFMAQLPQLTNVGWETYAMVAAGLAIIYLLPRITTAVPSPLVAILVLTAVAIGMGIDVNTVGDMGKLPEGLPSLALPQVPLTLETLRIILPYSLTMAAVGLLESLLTAQIVDDMTDTDSDKRQECAGQGGANIVAALFGGMGGCAMIGQSVINVTSGGRTRLSTFVAGAFLLFLLAVLGPYVGRVPMPALVAVMIMVSIGTFSWNSIPNLRRHPPTSSIVMLTTVIVVVATHDLSLGVLAGVLLSGIFFAGKVQRMFTVEREGSADGVLATYRVTGEIFFASVERFTRVFQAEDQAERVVIDVTRAHFWDISGVGALDKVVARLRRDGRQVEVIGYNQASADIIDRFALHDKTGVELGVVPH

SEQ ID NO: 40269 - protein, 349 aa, Solanum tuberosum
MAGSNINQPLLDQLPKTLQNVDSRRRRLRRLKSAPMPEFVPGEMNDIKDDQSLPRYESILDKLHPSFRKVILYLAIYLTIGTTCFYFVQNQIQGKKVNGVLDSVYFCVVTMTTVGYGDLVPNSATAKLLASFFVFSGMALVGMVLSKGADYLVEKQETLLIKALHMRDKVGPSVILEEIETNKVRYKCFVITATLVVLIVVGTVFLAEVEKLSTIDAFYCVCSTITTLGYGDKSFSTKAGRIFAIFWILTSTLCLAQFFLYVAEFNTERKQKELVQWVLSRKMTNVDLEVADLDNDRIVGAAEFVVYKLKEMGKISQDDVSLLLDEFECLDVDQSGTLSTTDLSLAQSS

SEQ ID NO: 40270 - protein, 596 aa, Oryza sativa
HTPLTILAPPPPRRSSRPAMAAATVEVTWDVEYVLWAPDCQQRVMIGINGRFPGPNITARAGDVISVTMNNKMHTEGVVIHWHGIRQFGTPWADGTASISQCAVNPGETFVYKFVADKPGTYFYHGHFGMQRAAGLYGSLIVLDSPEQPEPFRHQYDDGGELPMMLLSDWWHQNVYAQAAGLDGKDRHFEWIGEPQTILINGRGQFECTLGPARKSFEKLLNENCAPVVFNVEQGKTYRLRIASTTSLSLLNVKIQGHKMTVVEADGNHVEPFVVDDIDIYSGESYSVLLKADQKPASYWISVGVRGRHPKTVPALAILSYGNGNAAPPPLQLPAGEPPVTPAWNDTQRSKAFTYSIRARKDTNRPPPAAADRQIVLLNTQNLMDGRYRWSINNVSLTLPATPYLGAFHHGLQDSAFDASGEPPAAFPEDYDVMRPPANNATTASDRVFRLRHGGVVDVVLQNANMLREEVSETHPWHLHGHDFWVLGYGDGRYDPAAHAAGLNAADPPLRNTAVVFPHGWTALRFVANNTGAWAFHCHIEPHLHMGMGVVFVEGEDRMHELDVPKDAMACGLVARTAATPLTPATPLPPSPAPAP

SEQ ID NO: 40271 - protein, 450 aa, Campylobacter upsaliensis RM3195
MSLEKLRKKLKDENLASVFGEITKISATNIEIQGLKTGVGDIVRLISNENENLQTLAMVVEVKAQFSYLSPFSFIEGFKIGDRAFLSDAGMQIGVSDALLGRVVDPFMKPKDGKGAIEISKFMPIMRSPIDAMKRGLIEEIFPTGVKTIDGLLTCGVGQKLGIFAGSGVGKSTLMGMIVKNSKAPVKVIALIGERGREIPEFIQKNLGGKLDNTVIIVATSDDSALMRKYGAFCAMSVAEYFKEQGKDVLFIMDSVTRFAMAQREIGLALGEPPTTKGYPPSVLSLLPQLMERTGKEEGKGTITAFFTVLVDGDDMSDPIADQSRSILDGHIVLSRELTDFGIYPPINIQNSASRVMSDIISDTHKNNARKFKRLSSLLKENEVLLRIGAYQKGSDKELDEAIMKKDLMQKFLSQTPEQSVEFAETLELLSQINAQVAPQPVSIATLPNS

SEQ ID NO: 40272 - protein, 330 aa, Oryza sativa Japonica Group
MAVQIPDGIMGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGAGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 40273 - protein, 519 aa, Vitis vinifera
  misc_feature (243)..(243): Xaa can be any naturally occurring amino acid
MAVEVDSPKPMQPWDQSADPPDSTCAQVTQSWPEAFGNYQVPMTSSKDYQEQDDELDNVEMGKDLKIGVPRNSNLQLQDDVVGANKDKFHELTLKKDDEKLENRQMDLNSNKPNDELDKEAVDLMSVIANNTNPQKKSMGFKTPSGLSEVPETKDKAMYDKKEIPSLELSLKRLRDTGGTDTNPHDQIIWRHSDLSAFSRYNSASTAIQASTGNVGSCSPLDNSSEAAKTESMQNFQSNSNGXPPNQSSNGSSNNNMGSTTDDFYTKPAAFDDKPDSKSAVKHLQHSAFQPVQNTILADFANANTILAHPSAMPPQVQIQNHHYYYHHHVHNISQQQIRIHDDLALTNMAKSAPQCGSSNVLNAPVEGYACNHSLNGSASGSNHGSNGQNGSTTAVNAQGTNMESDDGIAGKGGAGGGSGSGSGSRSGVDQNQYAQREAALNKFRQKRKERCFEKKPVNVLGFDGTLCIAHAHAHAHSCTTTQQVRYQSRKRLAEQRPRIRGQFVRRVFHDINSEDADS

SEQ ID NO: 40274 - protein, 495 aa, Pyrus x bretschneideri
MASSASENRLLLSKIATNEKHGENSPYFDGWNKYNQNPFHLTENPEGVIQMGLAENQLSFDLVEERIRKNPKASICTAEGIEKFRNVANFQDYHGLPEFRQAIATFMSKARGGRVTFDPHRVVMSGGATGANELVMFCLADRGDAFLIPSPYYPAFYRDLGWRTGVQIVPVDCDSSNNFKITKEALEAAYEKAQNNNINVKGLIITNPSNPLGTTLDKDTLESLVTFINQKNIHLVCDEIYAATVFSSPKFTCITEVIQNMNCNPNLIHIVYSLAKDMGFPGLRVGIVYSYNDDVVNIGRKMSSSGLVSSQTQHMLASMLSDEDFVEKFLTTSAKRLAKRHGVFTDGLEEVGINCLKSNAGLFCWMDLRRLLKDQTFDGEMVLWRVIVNEVKLNVSPGSSFKCVEPGWFRVCFANMDDDTVEVALKRIRAFVGQGKKAQEQVQVKSPKKRWQSNLRLSFSSSSRRFEQEGVSVMSPRMMSPHSPMPHSPLLRATT

SEQ ID NO: 40275 - protein, 322 aa, Oryza sativa Indica Group
MAASASASAPPHSLLLAAVALAALASVAAARDENGVYDPCSDTRIQRGDGFSFGIAFASLGAFYSGGSVQLSPCDRRLSLASSGQLAVFRPKVDEISLLTINTTTGFNPNSHFSVTYCHVGPFLHPDIPVEGIGPGFLRANSLHSDIEALFCGYWLCKYATYEYFGDFVILYCGEGSLLVFLSPATAGGYMVAFAGRKYAARSVPTFVSNSSYTVSSFTLVLEFNKGRLQNLHWKKDGCGACAKSSSLVCIGKQTCAFRTQSCKSQGPVDCSIGIQLAFSGTDKHESVLNSWYEVSNLRQYSLYGLYSNLKDTLSGQFNKFF

SEQ ID NO: 40276 - protein, 771 aa, Physcomitrella patens subsp. patens
MASHTEMDTEEKQHKNTLQLGKSNRAKRESSPPRTPEKSSELVPKDESKSQGNGKWKDRFFPKWKTPTAAFNGNSNSHHTSSVENAVPADVEMEENSEITTTLKLLNKPDQHMAQGVYRDDGGGPSPLILLNTVTAARNAVKDFSKDFVALLKDMPDKGESFQKRMRDELNLVAQDAPEASDSKFVAQAYIALQLFSGFENASFCISNTGEKPWEVQHTRDCFDKFQECKDKSQTVAHLLETGLNTSFLSRFCFSKFASLIPKKLEEGLFGGKCPNHSEIARHRHPNTPFYKSFLFAAVSIWLLQRLVFSFEQRVITYSPFRSDNYQRKYMEPAIPGIGDNEEEDDDDFLEVLFTVFPGFRISQSIVKSNVYVVKKSCIQPVVKGLYPQVDDSSAVPENIQESTPDSQTEGLAPSPYSTTLPTQGEYSTPTGMDARTSPLSAVQSTTPGRDDRFTTAKIQSQDTDELETSSLPSKNDLKLRGDSLPNPSIPQRETSAIINAKSFSATSSPKSSKSNKTWKILTRLLRARKSFVKSEANVPANCQTPAGGGENYNTENTPTAKPPVRDESFSSAGADAAGAPAPSVPSVGPSPPTDEVGRGRNSTLVNDIRKQQILKSVFIALLLSSVTLPFRLKPSSISHATLSDVVRYVLQFIMAPLPKSPLTVNFDWLSSLAPPALSLFNNGSPQLYCASANVGKLNFLRERAGVPPAGEEIVSIDVDNTLSGFMSSMWKHRGKEIVTDLWSDRTEVKDQRRSFKGLKHDPLACSSEIQ

SEQ ID NO: 40277 - protein, 149 aa, Zea mays
  misc_feature (69)..(69): Xaa can be any naturally occurring amino acid
ASFPVSRKQSLDITSIASNGGRVSCMQVWPPINMKKYETLSYLPDLSDEQLLSEIEYLLKNGWVPCLEXFETEHGFVYRENHKSPGYYDGRYWTMWKLPMFGCTDATQVLAEGQEAKKAYPQAWVRIIGFDNVRQVQRIRFIGYKPEGY

SEQ ID NO: 40278 - protein, 376 aa, Saccharomyces cerevisiae
MSNVTTPWWKQWDPSEVTLADKTPDDVWKTCVLQGVYFGGNEYNGNLGARISSVFVILFVSTFFTMFPLISTKVKRLRIPLYVYLFAKYFGSGVIVATAFIHLMDPAYGAIGGTTCVGQTGNWGLYSWCPAIMLTSLTFTFLTDLFSSVWVERKYGLSHDHTHDEIKDTVVRNTAAVSSENDNENGTANGSHDTKNGVEYYEDSDATSMDVVQSFQAQFYAFLILEFGVIFHSVMIGLNLGSVGDEFSSLYPVLVFHQSFEGLGIGARLSAIEFPRSKRWWPWALCVAYGLTTPICVAIGLGVRTRYVSGSYTALVISGVLDAISAGILLYTGLVELLARDFIFNPQRTKDLRELSFNVICTLFGAGIMALIGKWA

SEQ ID NO: 40279 - protein, 377 aa, Yarrowia lipolytica CLIB122
MSTAVPSLGEINALNVPSLPGNLNTPNQTPAWTNNPLWAYVSETYNTIAAKRSGLNLVNPGTLENLNKEVSKDVFLTNYFFTGLRAEISKTFSMNPAFQVSHSFSLGSKVLPPYAFAAFFANDNFFMQGNIDNDYSVAARMQYSWSKECVSKVNAQLQNGQPAMIQLEQDLQGADFSINFKSLNPSVLSGGLSGVFIGSLLQSLTPKLAVGLEAMYSAQDPRIGEAAVSYFGRYVSGDWVASAQLQQMGMVQASFWRKITDKVEAGVEANLALLGKPNPMMGGVSGPEGTTTIGAKYEFRQSVFRGQIDSTGKVSCLLERRVLPVVSLLFAGEIDHVANTSKVGLGLQFEAGADEEMMAQQQQMMEQQQMMEQQQQM

SEQ ID NO: 40280 - protein, 494 aa, Aggregatibacter actinomycetemcomitans
MKAENCCIVIFGASGDLTYRKLIPALYNLYKIDRLGEDFSVLGVARTELNDKSFREKMRQTLIKNEGAKGECLEQFCSHLYYQAVNTADKADYAKLVPRLDELHDTYRTEGNTLYYLSTPPSLYGVIPECLGEHGLNKEDRGWKRLIVEKPFGYDRETAEALDIQIHRFFEEHQIYRIDHYLGKETVQNLLVLRFSNGWFEPLWNRNFIDYIEITGAESIGVEERGGYYDGSGAMRDMFQNHLLQVLAMVAMEPPVIINANSMRDEVAKVLHCLRPLTQEDVEHNLVLGQYVAGEVDGEWVKGYLEEKGVPPYSTTETYMALRCEIENWRWAGVPFYVRTGKRLPARVTEIVIHFKTTPHPVFSQNAPENKLIIRIQPDEGISMRFGLKKPGAGFEAKEVSMDFRYADLAGATVMTAYERLLLDAMKGDATLFARTDAVHAAWKFVQPILNYKAQGGRLYDYEAGTWGPTAADKLIAKSGRVWRRPSGLMKKKV

SEQ ID NO: 40281 - protein, 592 aa, Arabidopsis thaliana
MFRRKSRSISPRRHRSRSVTPKRRSPTPKRYKRQKSRSSTPSPAKRSPAATLESAKNRNGEKLKREEEERKRRQREAELKLIEEETVKRVEEAIRKKVEESLQSEKIKMEILTLLEEGRKRLNEEVAAQLEEEKEASLIEAKEKEEREQQEKEERERIAEENLKRVEEAQRKEAMERQRKEEERYRELEELQRQKEEAMRRKKAEEEEERLKQMKLLGKNKSRPKLSFALSSKMTTMSDLDEIMVAEILCRTPMTCLKTVRSVCKKWNALSKKWFFFGKAKQFLGFMMMDSRVCSLRFDLRKDLVVEPPSIKQVSILDQIEVSKIFHSDGLLLCIIKNDTTRLLVWNPYLEQTRWIQPRHNFHILDCYAIGHDKNRKHKILRFVDDFLPVENVVFGGNTYFFAKERYIFEGKGPEEIDITETEDFLLCFDFTAERFGPRLPLPFHSYYAETVTLSCVKEDQLSVLCQRQPSEPSEILEIWVSTNIQPNAVSWSIFLKVDMRPLTGFQFNDMAGSFFIDQENKVAVVFDLDPSQICRYQTAYIIGQEYGGYFNSVNIGEVPNLWIPGSVGYADTTSCIPPVCSSYVPSLVQIG

SEQ ID NO: 40282 - protein, 355 aa, Ralstonia eutropha JMP134
MKIAVLPGDGIGPEIVAEAVKVLNALDEKFEMETAPVGGAGYEAEGHPLPENTLKLAKEADAILFGAVGDWKYDSLERALRPEQAILGLRKHLQLFANFRPAICYPELTGASSLKPELVAGLDILIVRELNGDIYFGQPRGVREAPDGLFKGAREGFDTMRYSEPEIRRIAHVAFQAAAKRGKKLCSVDKANVLETFQFWKDIVIDVSKEYPDVELSHMYVDNAAMQLVKAPKSFDVIVTGNMFGDILSDEAAMLTGSIGMLPSASLDANNKGLYEPSHGSAPDIAGKGVANPLATILSAAMMLRYSLNKAEQADRIENAVKKVLAQGYRTGDILTPGCKQVGTREMGEAVLAAL

SEQ ID NO: 40283 - protein, 194 aa, Wolbachia endosymbiont of Drosophila ananassae
MVNNMFIQIEETPNPNTLKFLPGFEILNEGETTDFSNANEIKNSKLAANLFQIEHVVRVFFGHDFISVTKLGGINWDTLKVEILTTIMDHFTSGGKALDKEGVNDNNIPDEEFFDKNDIEIVNRIKELMESYIKPAVAQDGGDIKFRGYKDGIVYVELQGACSGCPSAAITLKQGVQNMLSYHIPEIAGIETTL

SEQ ID NO: 40284 - protein, 567 aa, Magnaporthe grisea 70-15
MPGTSRIPQSLRDGLISVKRNRPTSVVQLLSIDLLRNIVFTLFVLRWTRRAFWKLRGRGLLGWLAELYAAMRVTAYGWLLRAPGVRNKVRSEVDTALSKLSKKTLPPPEAPRYLQIPKQGWTNEAVRAELESLANMDHTRWEDGYVSGAVYHGEDELISLQTDAYGKFTVANPIHPDVFPGVRKMEAEVVAMVLSLFNAPVGAAGVSTSGGTESILMAVLSARQKAYNERGVTEPEIILPETSHTAFRKAAEYYKIKVNFVACPAPDYQVDVSRVRRLINANTIMLVGSAPNFPHGIIDDISGLSKLAVRYKIPLHVDCCLGSFLVPFLERAGFETRPFDFRLKGVTSISVDTHKYGFAPKGNSTVLYRTAELRKYQYFVCPDWSGGVYASPGIAGSRPGALIAGCWASMMAVGEAGYLAACVEIVGAAKKLVDHINASPSLAAELEIIGKPLSSVVAFRARNLNIYDIADAMGEKGWHLNSLQNPPAMHVAFTLPTAKVWERLATDLEACVEGEREKERARIAEGKGAKGAAVGDSAALYGVAGSLPNKSVVVELANGFLDLLYKT

SEQ ID NO: 40285 - protein, 499 aa, Enterococcus faecalis V583
MTNFLFVVFKLEILKEIAILKRDRHRIFHENSYYFRYLFKKVEILLRFFSLNEMRESMEKKQLKREITTFGALSTVMGTVIGAGVFFKAASVVGHAQSASLAIFAWVLGGALTICAGLTSAELATAIPETGGAVKYIEYTYGKLAGFLLGWAQSIIYYPANISALSIIFSTQLINLFHLSANLLIPIAILAGTSITIINLLGTKIASLVQSTTLVVKLIPIALISLVGLFTPGQVAVSLFPVETTANTGFLVAFSGALVATMFAYDGWLGVGNVAGEMKRPERDLPKAIIFGLLLITLIYALINFVFLKTLPIEQIAGNLNAASDASVAIFGPIGGKIVTIGILISVYGALNGYTMTGIRIPYALALDNLMPFSRQFQKLSKRFVVPYVAGIFQLAVAIIMMFFGTFDLLTDMLVFVMWLFNLLIFLAVFILRKREPELKRPYKVPGYPIIPIIASLGGIFILVTTSITQPILALIGIGITLLGIPVYLVNKQKTKPKT

SEQ ID NO: 40286 - protein, 78 aa, Vitis vinifera
MARLPKLRQFAEVENLKIISIADLIRYRRKRDKLVEKAAGAPIPTMWGPFKAYCYKSMLDGVEHIAMVKVSKSNFFYG

SEQ ID NO: 40287 - protein, 160 aa, Zea mays
SACVSEVGAARLYNVDDLKEVVEANKEDRLRKAMEAQTIITEELRRFEAWRDSLETVPTIKKLRSYADRIRASELEKCLQKVGEDALTKKMRRAIEELSTGIVNKLLHGPLQHLRCDGSDSRTLDETLENMHALNRMFSLDMEKAIIEQKIKAKVEKTQN

SEQ ID NO: 40288 - protein, 292 aa, Oryza sativa Japonica Group
MLRLLASYGVVRCATEAGPDGKARRSYAAAPVCKWLAAGSSSGEGSMAPLGLLNLDKVFMENWYYLKEAVSEGGTAFDKAYGTSLFQYLGQDGNEPSNTLFNQAMASHSVVITNKLLQFFRGFDAGAGVDVLVDVGGGVGATLRMITARHPHLRGVNYDLPHVIAQAPPVEGVEHIGGSMFDHVPSGSAILLKWILHLWGDEECVKILKNCYKALPAKGKVILVEYVLPASPEATLAAQEAFRLDVMMLNRLAGGKERTQQEFTDLAVDAGFSGDCKPTYIFTNVWALEFTK

SEQ ID NO: 40289 - protein, 563 aa, Photobacterium profundum SS9
MTEQKLSDNERLKRESNFLRGTIADDLQDRITGGFTADNFQLIRFHGMYQQDDRDIRAERAKQKLEPLHNVMLRARMPGGIITPTQWLAIDKFAEESSLYGSIRLTTRQTFQFHGVLKPNIKLMHQTLNSIGIDSIATAGDVNRNVLCTTNPIESELHQEAYEWAKKISEHLLPKTRAYAEIWLDGEKVEGGDEEPILGSNYLPRKFKTTVVIPPQNDVDVHANDLNFIAIADNGKLVGFNVLVGGGLAMTHGDKTTYPRRADDFGFIPLVNTLEVAAAVVTTQRDWGNRSNRKNAKTKYTLDRVGVDVFKAEVEKRAGITFEASRPYEFTDRGDRIGWVEGIDGKHHLALFIENGRLLDTPGKPLKTGVAEIAKIHKGDFRMTANQNLIVAGVPAADKNKIEKIARDHGLIDDGVSEQRKNSMACVAFPTCPLAMAEAERFLPDFVTDVEGVLAKHGLAEDDNIILRVTGCANGCGRAMLAEIGLVGKAPGRYNVHLGGNRNGTRVPKMYRENITVPQIMDEIDQLVGRWANEREDGEDFGDFTVRTGIIEPVLVSKRDFYA

SEQ ID NO: 40290 - protein, 484 aa, Oryza sativa Japonica Group
MAAARSVGMEAEVAALRGRFAAGGTRGAEWRAAQLRGILRMAAEAEAEVCRALHADLAKPYTESYVHEIALVKSSCKFALKNLKKWMKPQKVTAPLMTFPSTARVAAEPLGVVLVISAWNYPFLLSIDPIIGAIAAGNAVVLKPSEVAPATSSLLAELLPRYVDGSCIKVVEGGVAETTTLLEQKWDKIFYTGNGKVGRIVMASAAKHLTPVVLELGGKCPVVVDSNVNLHVTAKRIAAGKWGCNNGQACISPDFIITTKSFAPKLLEALEKVLEKFYGRDPLRSSDLSRIVNSNHFNRLKKLMDDENVSDKIVFGGQRDEHQLKIAPTIFMDVPLDSGIMKEEIFGPLLPIITVDKIHESFALINSMTKALAAYLFTKDSKLQEQYEAAISAGGMLVNDTAVHLTNQYLPFGGVGESGMGAYHGRFSFEAFSHKKAVLVRRFAGEAAARYPPYSPAKLKILRGVLKGNLGAMIKAILGFPRGK

SEQ ID NO: 40291 - protein, 288 aa, Vibrio cholerae O1 biovar eltor str. N16961
MICFGILPPAFSFFNIRWETRMHPMLNIAIRAARKAGNHIAKSLENAEKIQTTQKGSNDFVTNVDKEAEAIIVSTIKSSYPEHCIIAEEGGLIEGKDKEVQWIIDPLDGTTNFVKGFPHFAVSIAVRFRGKTEVACVYDPMTNELFTAQRGAGAQLNNARIRVQPIKDLQGAVLATAFPFKQKQHSESFMKILSAMFVECADFRRTGSAALDLCYLAANRVDGYFELGLKPWDMAAGELIAREAGAIVTDFAGGTDYMQSGNIVASSPRGVKAILQHIRENGNSAILK

SEQ ID NO: 40292 - protein, 585 aa, Sulfolobus solfataricus P2
MATVTSNNSTIGLGLSSNTLQLIIEVILTILFFLVPLIFWIYFSRRMMIGNTTKSRKPKIHIPNIRWDEVYDLKDVKMRLEEIAKIVQEGRAYGVILFGPPGTGKTTIAKALANKLGWAYFELRPSKILSKWYGESELLLDSFFDQVEINTPAVVFIDELDSLAMSRQSDLHEVTHRLVNIMLMRLQDLHDKNLRVIIIGATNVPQEIDEAFLRPGRFDEVIYVALPDEKSREEIWKGYIKREDIDYSLLAKKSERFSPADIKNVADKVISKNNSLKTEDFLREIENYKPSIQLSTIIKFENIARKYERSKLIIKTYGIPNISWNDLGDLEEVKRIIRESIVLPITNKEFAEKLGIYPVKGILLYGPPGTGKTSIAKALANDLRFNFIELSGEEVSGAGPLDAPKIIAEKFYIALDNAPAIIFIDEIDMIARNRMTNEWRNALTELLRQMDGLREIHNVIVVGATNRPWDLDPAILRAGRFDKIIYVPPPDKDGREKILQVLIKDLIINRNIISKVAELTENYTPADLKLVVEEVKRNLLKEASISGNLRTEVKLEDFMDVLKRVKASLDRQTLIMYEKFGFERR

SEQ ID NO: 40293 - protein, 346 aa, Photobacterium profundum SS9
MVTDALLNNQNDEIKTQDNSGYPMQRFSVAPMLDWTDRHCRYFHRLLSDNALLYTEMVTTGAIIHGKGDFLTFNEEENPVALQLGGSNPVDLAHCAKLAQERGYDEINLNVGCPSDRVQNGRFGACLMGEADLVALCVSSMREVVDIPVTVKTRIGIDEQDSYQFLVDFIGTVNEKSGCDNFTVHARKAWLKGLSPKENREIPPLDYPRVYQLKRDFPNIIMAINGGIKTFDEMEEHLKHMDGVMVGREAYQNPYLMAEVDQRLFGSSKPIIKRREAAEAMFPYIERQLANGSKLGHITRHMLGLFQGIPGGRQWRRYISENAHKPGSGIEVVQRALEKISNDLDV

SEQ ID NO: 40294 - protein, 272 aa, Pyrus x bretschneideri
QNWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSISSFYNPGDDAFISPAPAVLEKKTEDAPTYPKFVFDDYMKLYSGLKFQAKEPSF

SEQ ID NO: 40295 - protein, 127 aa, Vibrio cholerae O1 biovar eltor str. N16961
MAYSEKVIDHYENPRNVGSFDKEDPSVGSGMVGAPACGDVMRLQIKVSPEGIIEDAKFKTYGCGSAIASSSLVTEWVKGKSIDEAAAIKNSEIAEELELPPVKIHCSILAEDAIKAAVADYKKKHQH

SEQ ID NO: 40296 - protein, 256 aa, Pyrus x bretschneideri
VSHGIPTEFLDTVERLTKEHYKQCLEQRFKELVASKGLEGVQTEVKDMDWESTFHLRHLPQSNISEVPDLKDEYRNVMKEFALKLEKLAEQLLDLLCENLGLEQGYLKKAFYGTKGPTFGTKVSNYPPCPNPDLIKGLRAHTDAGGLILLFQDDKVSGLQLLKDGEWVDVPPMRHSIVINLGDQLEVITNGKYKSVEHRVIAQTDGTRMSIASFYNPGSDAVIYPAPTLVEKEAEEKNQVYPKFVFEDYMKLYAGV

SEQ ID NO: 40297 - protein, 185 aa, Burkholderia thailandensis E264
MGRVVCCGRTYRYEGPGMIQVGDTLPDVQIFEYLDDARAGCTLGPNAFGVREQTAGKRVVIFGLPGAFTPTCSAQHVPGYVAQAERLRSAGIDEIWCVAVNDAFVMGAWGRDLHTAGKVRMMADGGAAFTHALGLTQDLSARGMGIRSRRYAMVVDDGVVKTLLVEAPGKFEVSDAASVLASLTR

SEQ ID NO: 40298 - protein, 221 aa, Oryza sativa Japonica Group
MSDAQAQPIRPGDVYPPSAADHHQARRERDKAVAADQGGGGGDLRVTEADLPAAGKRVVTATAGGQVMAQFTVPVPSAEEETTDAVTIGEALQAAGSDDNEPVGLADAAAVQAAEMRTTGAGRRRPRRALRPRRRRPPRANIRRRPDGDDGENKATTTTLMKDVVGGAAEALPADMVATREDADRVAAAAARNAARRGGGGGKGVAEAVAAAAEMNEGRMV

SEQ ID NO: 40299 - protein, 87 aa, Zea mays
SVFFGPDFITVTKDNEELDWNLLKPDIYATIMDFFASGLLLVTEETPSGEAGSEEDDEVVAMIKELLDTRIRPTVQEDGGDVIYKGF

SEQ ID NO: 40300 - protein, 550 aa, Photobacterium profundum SS9
MLKNINPTHTQAWKDLTAHYEDAQDLQLSDLFANDSERFNKFSATFGSDILLDYSKNLITEETLTKLFALAEQTELKAAIAEMFSGEKINKTEDRAVLHSALRNRSNTPVVVDGEDVMPKVNAVLEKMKAFTARIVDGDWKGYTGQEITDVVNVGIGGSDLGPYMVSEALVPYKTRLNMHFVSNVDGTHIAETLKDLNPETTLFLIASKTFTTQETMTNAHSARDWFLATAQDQAHVAKHFAALSTNVGSVSEFGIDTDNMFEFWDWVGGRYSLCSAIGLSICLSIGFDNFVELLDGAHEMDQHFAQAPLEENLPVILALIGIWYNNFHGAESEAILPYDQYLHRFAAYFQQGNMESNGKCVDRGGNPVDYQTGPIIWGEPGTNGQHAFYQLIHQGTKLIPCDFIAPSISHNPLTDHHPKLMANFFAQTEALAFGKTKEQVEAEFVAAGKTLDEVKDLVPFKVFDGNRPTNSILIKQVTPKVLGSLMALYEQKIFTQGVIWNIFSFDQWGVELGKQLANQILPELNDADSIAGHDSSTNGLINAYKQWRK

SEQ ID NO: 40301 - protein, 217 aa, Yarrowia lipolytica CLIB122
MSSSPIPSNVNVLPQTRQLLGLYSIIRDKNTSRSDFIFYSDRIIRLLVEEGLNQLPVTDKLVKTPTGAEFKGLAFEGKICGVSIMRAGESMEQGLRDCCRSVRIGKILIQRDEETAQPSLFYDKLPEDISSRFVFLLDPMLATGGSAMMAVEVLIARGVPQERILFLNLIASPEGIAAFAEKFPNVQIITGVIDDGLDENKWIQPGLGDFGDRYYCI

SEQ ID NO: 40302 - protein, 327 aa, Burkholderia thailandensis E264
MFRRLPLTMPLNPKIAQVLDMIERAKRPDYHEQTPAQARAAYEKSAPILDVAPAPMFSIEELRVPSRDGGAFGARLYLPVEPSLAEPLPALVYYHGGGFTVGSVNTHDALCRMFARDAHCAVLSVDYRLAPEHKFPTAVDDAEDALVWLHAHASRFGIDQARLAVGGDSAGGTLATVCAVLARERGIALALQLLVYPGTTGHQQTASHARLAKGYLLSADTIQWFFDHYVRDASDRDDWRFAPLDGTRGAPSFERVAPAWIATAEYDPLSDEGDAYADKLRAAGNRVTLVAYAGMIHEFFKMGGFVPEVRLAHADAAGALRAAFDGA

SEQ ID NO: 40303 - protein, 238 aa, Mycobacterium leprae
MPPGSVDVVSRAALDKDPRDVVAMFDDVAHRYDLTNTVLSLGQDRYWRRATRSALRIGPGQKVLDLAAGTAVSTAELSKSGAWCVAADFSVRMLATGGARKVPKVAADATQLPFSDGVFDAVTISFGLRNIADYQAALREMARVTRPGGQLVVCEFSTPTNALVANVYTEYLMRALPQVARLVSSNPDAYIYLAESIRAWPDQVTLACQLSRTGWASPRWRNLTGGIVALHAADKPVR

SEQ ID NO: 40304 - protein, 462 aa, Marinobacter sp. ELB17
MTGDFVSDSADYDLIVIGAGSGGVRLARMSAQRGARVAVVESRYLGGTCVNVGCVPKKLFVYGAHVHDELEDAAGYGWQVPLADVKFNWPTLLANKNTEIERLKGIYGRLLENAGVTIINGSARLSGPNTVIVGDKSYSAKHITVATGSWPVVPDIPGKEHLLTSNEMFFLPELPQHAVVWGGGYIAVEFAGILAGLGVKTTLLYRGDLFLRGFDDDIRTFTAQEMMKKGVDLQFNVTIESVTGASGDYSVLLNNGETLKTGLVLAATGRRALVDSLGLAELGVALNDSGHVVVNDYFQTEVPSITALGDVIGTPQLTPVALAQAMVLSRRLFGDGEGEMDYAAIPTAVFCQPNIGTVGLTEQEARLAGHSLRVYRSEFRPMKYILSGRDERCMMKLVVDKRTDKVLGAHMVGPDSGEITQGLAVAIKAGATKAQFDATMGIHPTSAEEFVTMREPVQVDPD

SEQ ID NO: 40305 - protein, 338 aa, Mannheimia haemolytica
MAILVTGGAGYIGSHTLVELLNENREIVVLDNLSNSSEVSLERVKQITGKSVKFYQGDILDRDILRKIFAENQIESVIHFAGLKAVGETSENRYVTIKNNVTGSIVLVEEMLKANVNTIVFSSSATVYGDPQIIPIVESCPVGGTTNPYGTSKYMVERILEDTVKAFPQLSAVVLRYFNRVGAHESGLIGEDPNGIPNNLMPFISQVAVGKLPQLSVFGGDYNTHDGTGVRDYIHVVDLALGHLKALDKHQNDAGFHVYNLGTGTGYSVLDMVKAFEAANGITIPYKVVDRRPGDIAVCYSAPQKALEQLGWETERGLEQMMKDTWNWQKNNPNGYKG

SEQ ID NO: 40306 - protein, 463 aa, Aspergillus nidulans FGSC A4
MMTDNIVASLPLDELRSIMRSLLTIHPSVTPVFEEQTRNYLDETTSKYSKIANAASTHRGSLCTYRTAYAEWLGVDYATRLCRYCSDSDSEDLAHAYRDKGLTVEDTKSLWDLQRALPSCREVWEGRGGQFPSLVRIAETFTLDADVQLPRIFTGLLQISSLAWGSASRANIFEQFSRYVSRGFTAFNMADYYGDAEIIFGRYRSSSAYADSIFAATKYCVFHPITLSEEAMRASYEDDQYIMALQYLQQDPRAQLLGLCNFDTKHMRRVIESGVKIVSNQVQVRTDTRYTSIEASAADNDQFSLIDSRPIVKMAGFCSEHNIKLLTYGTLCGGLLAEKWLDQAPPDLYSEKITPSQRKYYASIRTWGAWPLFQELLRVLKVTAYKHSVTISKVVTRWVLDFPYVGAVIVGCRMGVSEQSAENLASLGWCLDEEDRQMIEGVMQRSQRKAMFESLGDCVGEYR

SEQ ID NO: 40307 - protein, 589 aa, Dunaliella salina
MGSRRITLLGALFAVLAVAIEGRTLLTHNLKAEAAETVDAVSSVVAGSAGRQLLVSEPHDYNYEKVGFDWTGGVCVNTGTSKQSPINIETDSLAEESERLGTADDTSRLALKGLLSSSYQLTSEVAINLEQDMQFSFNAPDEDLPQLTIGGVVHTFKPVQIHFHHFASEHAIDGQLYPLEAHMVMASQNDGSDQLAVIGIMYKYGEEDPFLKRLQETAQSNGEAGDKNVELNSFSINVARDLLPESDLTYYGYDGSLTTPGCDERVKWHVFKEARTVSVAQLKVFSEVTLAAHPEATVTNNRVIQPLNGRKVYEYKGEPNDKYNYVQHGFDWRDNGLDSCAGDVQSPIDIVTSTLQAGSSRSDVSSVNLMTLNTDAFTLTGNTVNIGQGMQINFGDPPAGDLPVIRIGTRDVTFRPLQVHWHFFLSEHTVDGVHYPLEAHIVMKDNDNLGDSAGQLAVIGIMYKYGDADPFITDMQKRVSDKIASGAITYGQSGVSLNNPDDPFNVNIKNNFLPSELGYAGYDGSLTTPPCSEIVKWHVFLEPRTVSVEQMEVFADVTLNSNPGATVTTNRMIQPLEGRTVYGYNGAAA

SEQ ID NO: 40308 - protein, 135 aa, Glycine max
MACTTDFRCLDEGFGGKTAKRKRESQEQAAADADEASMDIDSAHPPSAKRSAVASSEDPDKPVAVAAIGRPTYDGVIAGKVSGRNWKTPRTHRSSGRFVRNKGPDLEEMKRQREIKKAYRERKNELKEEIRSHKV

SEQ ID NO: 40309 - protein, 336 aa, Yersinia enterocolitica
MSILITGGAGYIGSHTVLTLLEQGRNVVVLDNLINSSAESLARVSKICGRKPNFYHGDILDRSCLKLIFSSHKIDSVIHFAGLKSVGESVEKPIEYYQNNVVGSITLLEEMCLANVKKLIFSSSATVYGEPEFVPLTEKARIGGTTNPYGTSKVMVEQILKDFSLAHPDYSITALRYFNPVGAHPSGLIGEDPNGKPNNLLPFITQVAIGKLSKLLVYGNDYDTPDGSGIRDYIHVMDLAEGHLSTLINLTSGFRIYNLGTGVGYSVLHMIKEFERITGKNIPFDIVSRRPGDIAECWASPELAHLELGWYAKRTLVDMLQDAWKWQKMNPNGYNC

SEQ ID NO: 40310 - protein, 383 aa, Cryptococcus neoformans var. grubii
MSTEGQVITCKAAIAWEAGKPLSIETVEVAPPKDGEVRIKILYTGLCHTDAYTLSGNDPEGAFPVILGHEGGGIVESVGKGVDEVKVGDHVVPLYTAECRECKFCKSGKTNLCGRVRATQGKGVMPDGTSRFKCKGQDILHFMGCSTFSQYTVVSKFSVVAINPKAPLKTSCLLGCGITTGYGSATKSPGIEGSNVAIFGVGCVGLSVLQGAKAKGCKRIFAIDTNPKKKEWAEKFGATDFVNPKDLPEGKTIVDYLIEETDGGLDFTFDATGNVGVMRNALEACHKGWGVCNIIGVAPAGAEISTRPFQLVTGRVWKGTAFGGVKGRTELPGIVEDYLAGKLWVNEFVTHNETLEGINKGFDDMHAGDCIRCVVDMGFNEAP

SEQ ID NO: 40311 - protein, 539 aa, Burkholderia vietnamiensis G4
MHDKILILDFGSQVTQLIARRVREAHVYCEIHPNDVSDAFVREFAPKAVILSGSHASTYEDHQLRAPQAVWDLGVPVLGICYGMQTMAVQLGGKVEWSDHREFGYAEMRAHGHTRLLDGIDDFKTAEGHGMLKVWMSHGDKVAELPPGFTLMASTPSCPIAGMADEARGYYAVQFHPEVTHTVKGRQIIERFVLQIAGAKPDWIMKNHIEEAVAKIREQVGDEEVILGLSGGVDSSVAAALIHRAIGDQLTCVFVDHGLLRLNEGKMVLDMFEGRLHAKVVHVDASEQFLGHLAGVTDPEQKRKIIGREFVEVFQAEAQKLSKAKWLAQGTIYPDVVESGGTKTKKATTIKSHHNVGGLPETLGLKLLEPLRDLFKDEVRELGVALGLPPEMVYRHPFPGPGLGVRILGEVKREYAELLRRADAIFIEELRGTTATAQDAAAGLCGEADVGKSWYDLTSQAFAVFLPVKSVGVMGDGRTYDYVTSLRAVQTTDFMTAHWAHLPYALLGRASNRIINEVRGINRVVYDISGKPPATIEWE

SEQ ID NO: 40312 - protein, 348 aa, Azospirillum brasilense
MTDQTAASPRVLVTGGAGYIGSHVLHALTDAGIPAVTIDDLSAGRREAIPAAVPLVEGDIGSAELLDRVMRDHRVDAVMHFAGSIVVPESVVKPLDYYRNNTANSLTLLGACLRAGIDKVVFSSTAAVYGAPESVPIREDAPTVPINPYGASKLMTEQMLRDAGAAHGLRSVILRYFNVAGADPAGRTGQATPVATHLIKVACQALLGRRPPLAIFGTDYDTPDGTCIRDYIHVSDLADAHVLALLHLRRGGGSLLMNCGYGRGASVREVVRTLEEVSGEQVPATFADRRPGDPPQLVAGADRIREQLGWVPKHDRLDGIVRSALSWERSLEQSVGQAGAPGGSASRS

SEQ ID NO: 40313 - protein, 535 aa, Shewanella oneidensis MR-1
MTQLSSRINARSDEFKAKSDDMAALVADLKTKLAKIELGGGPVALERHLSRGKRLPRQRVEKLLDAGSPFLELSQFAAFEVYDEEVPAAGIIAGIGRVSGVECMIIANDATVKGGTYYPITVKKHIRAQEIASRCHLPCIYLVDSGGANLPRQDEVFPDRDHFGRIFYNQAQMSAKGIPQIAVVMGLCTAGGAYVPAMADESIIVKDQGTIFLAGPPLVKAATGEEVSAEELGGADVHTKISGVADHLAQNDEHALELARRAVSRLNHQKEITLRLSPVKPPKFDISELYGIVGTDLKKPFDVKEVIARIVDDSDFDEFKANYGATLVCGFARIHGYPVGIVANNGILFSESAQKGAHFIELCCQRKIPLLFLQNITGFMVGKKYEHEGIAKHGAKMVTAVSCANVPKFTVIIGGSYGAGNYGMCGRAFEPTMMWMWPNARISVMGGEQAAGVLATVRRDGLARKGEEWSAEDEKAFKAPIIAQYDKEGHPYHASARLWDDGIIDPAQTRDVVGLALSAALNAPIEDTRFGVFRM

SEQ ID NO: 40314 - protein, 163 aa, Zea mays
MAQRDKKEEPTELRAPEIALCANNCGFPGNPATQNLCQSCFSASRSSSSSSQPSPTSSPSASAPAAAVPQPRPALLDAALQLAPPAAAAGQPVEASARTSANRCSSCRKRVGLTGFRCRCGDLFCGAHRYSDRHGCRYDYRGAARDAIARENPVVRAAKIVRF

SEQ ID NO: 40315 - protein, 398 aa, Nostoc sp. PCC 7120
MTNFTSRMQAVQSPIIPVVGELIQNSPGTISLGQGVVSYSPPPEAIELLPRFLADPANNLYKAVEGIPPLLNALTEKLSTFNNIEITTDNCIVVTAGSNMAFMNAILAITSPGDEIILNTPYYFNHEMAITMAGCRAVLVETDENYQLCPEAIAQAITPKTRAVVTISPNNPTGVVYCEDLLRNVNQICANYGIYHISDEAYEYFTYDGVKHVSPASFAGSSEYTISLYSLSKAYGFASWRIGYMVIPKHLLVAIKKVQDTILICPPVVSQYAALGALQAKPEYLQDHIGALAQPAVGIAQVRQIVFDYLKQLQGLCNITPADGAFYVFLKVHTQIDAFALVKQLIQEYKVAVIPGTTFGMENGCYLRVAYGALQKDTVKEGIERLVQGLKTILDTGK

SEQ ID NO: 40316 - protein, 508 aa, Shewanella oneidensis MR-1
MQNHSNLNDIGVIGLGVMGKNLALNIADNQYRVSVFDLDPVKVNGVLQQEKQERVGQELRITGCANLSEMLASLTKPRILVLSVPAGAPVDGVCAALISAGIEADDIVIDTGNSLWTDTVEREQHYQGQFIFFSSAVSGGEVGARFGPSLMPSGDLGAWQHVAPIWKAIAAKVNPQTGLPIERFEPGNPVTEGEPCTTYIGPAGAGHYVKMVHNGIEYADMQLICEAYQLLHDGLGMSAAEVGEVFERWNQGSLNSYLMGISAEVLKQADPLTGKPLVEMILDKAGQKGTGLWTAVSSLQIGCPAPTIAEAVYARAVSTQKSLRVELSKKLAGPLSPAMDENQKANLIDALESALYCAKVCCYAQGFQLMAMTALEQKWQLDFAEIAKIWRAGCIIRATFLQSITQAYQADANLSCLLMADTFASTLSEKQTEWRIAVAAAIMQGIPVPCISSALAYYDSYRSETLPANLLQGQRDFFGAHTFERLDKPAGEKYHLDWSAQERVLIKL

SEQ ID NO: 40317 - protein, 142 aa, Vibrio cholerae O1 biovar eltor str. N16961
MALERTFSIIKPDAVKRNLIGEIYHRIEKAGLQIIAAKMVHLSEEQASGFYAEHEGKPFFEPLKEFMTSGPIMVQVLEGENAIARYRELMGKTNPEEAACGTLRADYALSMRYNSVHGSDSPASAAREIEFFFPESEICPRP

SEQ ID NO: 40318 - protein, 526 aa, Emericella nidulans
MAASSSLDHLSNRMKLEWHSKLNTEMVPAKNFRRTSIICTIGPKTNSVEKINALRRAGLNVVRMNFSHGSYEYHQSVIDHAREAEKQAAGRPVAIALDTKGPEIRTGNTVGDKDIPIKAGHEMNISTDEQYATASDDQNMYVDYKNITKVISAGKLIYVDDGILSFEVLEVVDDKTLRVRCLNNGNISSRKGVNLPGTDVDLPALSEKDISDLKFGVKNKVDMVFASFIRRGSDIRHIREVLGEEGREIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPCEAVTMMSETCLLAEVAIPHFNVFDELRNLAPRPTDTVESIAMAAVSASLELNAGAIVVLTTSGNTARMISKYRPVCPIIMVSRNPAATRYSHLYRGVWPFYFPEKKPDFNVKIWQEDVDRRLKWGINHGLKLGIINKGDNIVCVQGWRGGMGHTNTVRVVPAEENLGLSE

SEQ ID NO: 40319 - protein, 428 aa, Nostoc sp. PCC 7120
MNIAVVGLSHKTAPVEIREKLSIPEPQTESAIAQLTSYPHIDEVAILSTCNRLEIYIVAGETDHGIREVTQFLSEHSKLPVHSLRQHLFVLLHEDAVMHIMRVAAGLDSLVLGEGQILAQVKNTHKLGQQYNGIKTILNRLFKQALTAGKRVRTETSIGTGAVSISSAAVELAQIKAENLAACRVTILGAGKMSRLLVQHLVSKGATQISIVNRSRERAQELAKQFSEHPIRTHLLPEMMTVIAESHLVFTSTSATEPILDRAKLEMVLAPNQPLMLFDISVPRNVHTDVNELVNVQAFNVDDLKAVVAQNYESRRKMAQEAERLLEEEIEAFDIWWRSLETVSTISSLRSKIETIREQELEKALSRLGSEFGDKHQEVIEALTRGIVNKILHDPMVQLRAQQDVEARRRCMQTLQMLFNLDVGEQFS

SEQ ID NO: 40320 - protein, 721 aa, Arabidopsis thaliana
MARCTNLVTVFLLWALLMFSWCKASRISPNVYDHSYKRFKSDSLIKRREDITGLRSFVRASLRTPTTVSVSDFGAKGDGKTDDTQAFVNAWKKACSSNGAVNLLVPKGNTYLLKSIQLTGPCNSILTVQIFGTLSASQKRSDYKDISKWIMFDGVNNLSVDGGDTGVVDGNGETWWQNSCKRNKAKPCTKAPTALTFYNSKSLIVKNLKVRNAQQIQISIEKCSNVQVSNVVVTAPADSPNTDGIHITNTQNIRVSESIIGTGDDCISIESGSQNVQINDITCGPGHGISIGSLGDDNSKAFVSGVTVDGAKLSGTDNGVRIKTYQGGSGTASNIIFQNIQMDNVKNPIIIDQDYCDKSKCTTEKSAVQVKNVVYRDISGTSASENAITFNCSKNYPCQGIVLDRVNIKGGKATCTNANVVDKGAVLPHSLNYSSTMAERGGERGVERGGERGDFGRGFGGRGGRGDRGGRGRGGRGGRRGGRASEEEKWVPVTKLGRLVAAGHIKQIEQIYLHSLPVKEYQIIDMLIGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLASKALSTSKPDPVVEDQA

SEQ ID NO: 40321 - protein, 507 aa, Ralstonia metallidurans CH34
MPESQVPPAASGAPTAATAVAAAPKLNIHWGLYAAVVVLIAVLLIPMPADLPVAGQRMLAILAFAVVVWITEAVTYETSAIMITSLMAGLIGFAPMVNDPNTLYGTSRALGMALAGFSNTALALVAAALFISAAMTVTGLDRRIALVTLSAIGTSTRRILIGTIAVTILLSLVVPSATARSACTVPIMMGVIAAFGVDKKSNIAAGIMIMVAQATSVWNVGIQTAAAQNLLTAGFMDKLLGERVTWLQWLIAGAPWAIVMSIVLYFLVRWLLPPETDAIAGGKEAVQRELAALGPMTGPQKRLAAVAIGLLLFWATEGKLHKFDTASITFVGLVILMLPRIGVMDWKTMQQRTPWGTLIVFGVGISLGTALLTTQAGQWLGKFVVTHSGLANHGTLLVFAVLAAFLILIHLGFASATALTSAMLPILISVLQTIPGDMNKVGMTMLLGFTVSFGFILPINAPQNMVCLGTDTFNGRQFARIGIPTTIIGYLLMLLFASTYWRWLGWI

SEQ ID NO: 40322 - protein, 395 aa, Candidatus Kuenenia stuttgartiensis
MTNPARVLIVEDKKTSRDILNERVNALGHISIPAENGLSALAQIREQPPDLILLDIMMPEMDGYEVLCHLKDSASWRHIPVIMISAIDDMKSIIRCIEKGADDYLTKPYNPVLLKARIGSCLMKKRLHDQEEQYRHLLEKKVQEKTSDLQKTNIALEKAYRLKSEFLATMSHELRTPLNAIIGFAEVLKDGLVGPINDEQREYVDDIYSSGKHLLNMINNVLDISKIEAGKLELKYEEICVKETIDDVLNTVSGIANKKNITIKNTIQSDIPTFVVDQLKLKQILFNLLSNAIKFTPKNGNVCIDTTLKDLYVQFAIADTGIGIKQEDIEKIFEAFSQVDSSLARNYEGAGLSLALTKRLVELHGGEIWVESFYGKGSTFTFILPLRPPNQKEMG

SEQ ID NO: 40323 - protein, 327 aa, Rhizobium leguminosarum bv. trifolii
MAGETVLVVGGAGYIGSHTCLDLANKGYRPVVFDNFSNGHREFVRWGPAEEGDIRDRARLDEVLAKHKPAAILHFAALIEVGESVKDPVSFYENNVIGTLTLLSAAQAAGINAFVFSSTCATYGLPQSVPLDETHRQVPINPYGRTKYIVEQALADYDQYGSLRSVVLRYFNAAGADFEGRIGEWHQPETHAIPLAIDAALGRRQGFKVFGSDYETRDGTCVRDYIHVLDLADAHVRAVEYLLKGGDSVALNLGTGTGTTVKELLGAIEEVSNRPFPVEYIGRREGDSHTLVANNDKARDVLGWVPQYDLSEIIRSAWDWHAKSNQH

SEQ ID NO: 40324 - protein, 152 aa, Candida glabrata CBS 138
MSNNERTFIAIKPDGVQRGLIGKILGRFETRGYKLVGIKLIQADQKLLEQHYAEHIGKPFFGPMTAFMSSGPILATVWEGKDAVKQGRAMLGATNPTQSAPGTIRGDFGIDLGRNVCHGSDSVESANREIGIWFKKEELVEWKPSNLAWIYE

SEQ ID NO: 40325 - protein, 515 aa, Candida albicans
MSVPTFDDLSFYSNDQELTKSRYLKLVEIFQSNFPNASIDFFARSPGRVNLIGDHIDYNFFPVLPMAISADVIVAVNVNDEPEIVITHTDSKNFAKETIPLTNNNDGFEIDSQHHSWANYFKCALIVANNYLTEQNLKGQLKGMKLTFDGNVPTGGGLSSSAAFCVASTLAILHANGVKDITKADLTRITVVCEHYVGVNTGGMDQCASVYGEPDKALLIQFKPKLIGKPFKFPVENLTFVITNSLQVSNKHETAPIHYNLRVVEMAIAADVLVKKLNLGTLVPQDSNIGTSSLRGVMDAVFNTCKWDGNDIDVGIDQLKKMIAIVETELNNNQEGYTVDQCLTVLDLSLDEFKSKYLQAYPVKFDVLKLYQRAKHVYQESLRVLETLKLLSTTQTSSNSKDDDESFLVKFGELMNQSQSDLDKLNESSNDKLNKICSIALQNGSYGSRITGAGWGGSIVHLTTLDKSKQLIQGLIKNYYQLEFPSIKLDELLNDAIIDSKPSMGSCIVTTKFLQ

SEQ ID NO: 40326 - protein, 489 aa, Candida glabrata CBS 138
MSADFGLIGLAVMGQNLILNIADHGYTVVAYNRSVDKVHQFLDNEAKGKSIIGAESIEDLVAKLKRPRKIMMLVKAGAPVDGLIAQLVPHLEKGDIIIDGGNSHFPDSNRRYEELKAKGILFVGSGVSGGEDGARYGPSLMPGGAEEAWPHIKEIFQSISAKSDGEPCCDWVGPAGSGHYVKMVHNGIEYGDMQLICEAYDIMKRIGGFTDKEISEVFGKWDTGVLDSFLVEITTNILKKDDVDGKPLVEKIMDSAGQKGTGKWTAINALDLGMPVSLIGEAVFARCLSALKCERVKASKTLPGPEIPKDLIKDRQQFIDDLEQALYASKIISYAQGFMLIREAAKTYGWKLNNPAIALMWRGGCIIRSVFLGEITKAYRENPDLENLLFHKFFKDAVTKAQGGWRRSLALAATYGIPSPAFATALSFYDGYRSERLPANLLQAQRDYFGAHTFRVLPECASDSLPKDKDIHINWTGHGGNVSSTTYDA

SEQ ID NO: 40327 - protein, 235 aa, Oryza sativa Indica Group
MAAAGLESAWEYLITHFSEFQLASIGTFLLHESVFFLSGLPSLLFERLGLFSKYKIQKKSNTPDYQNRCVVRLVLYHVCVNLPLTILSYRTFKFMGLRSTLPLPHCRYATPFGLTSEYAHPAEILFLGFATVAGPALTGPHLFTLWVWMVLRVLETVEAHSGYHFPWSPSNFLPLYGGRGLEHFSAEFHDYHHRVLYTKSGNYSSTFIYMDWLFGTDKDYRKTKALEEKERTKHL

SEQ ID NO: 40328 - protein, 1159 aa, Cryptococcus neoformans var. neoformans B-3501A
MRRVSAPPLRQRLLPPRRLLSRSPAPARTLQTTSAIAFPRSPTPRRTFAAASSPSQPPPPSPPPPPDAPPAATGRDLLSYATAVVPPSPPASAIPPDLQPALTHLATGFLPRNQHLAPDPATSPFTHVISFPPGAHGRAQTDPAREEEDSEPAPENVIALASPFEGGDVYVQEAVQALANEMEADVVRLDLVMGVALDGMAAPLGVFGPPALAHSLNPLYQAAPSPFPNLRKESREADDQEEGMGLGFTSMPVAVLGGGGLPMPQMGHMGQQEEDFVAGRANEEWIAFFSRIINAETAEAGKKRIVVLESPLAMSKTFPVWWPSLVEAVQRRRRGLITPGRKKMIPKNGSAEPSLVHPTSIVLQCTPSPLLPHTSPSMFAPTEKEDHELAAEEHVEDVDEQEEATHAAISALEDKFRSMGFNVHHHVEVVKPRSGAKLWWGNEESDPAGRREGDQSRLKAILGKGLSSVLPPFDGQSSDSGNQSRNPLQRLLMSRMGHVNRSEQNESSGAPLVWKAFPIVPLHRNFDAEKESRTLRRRIYSAALITRAVYQLGGELQDPLEILKLSESTGRPLTRKTGPSSVSKGWGNAVVSWSDALHIASIAVGRAVQNGQVDGGGATVHWADIIAARQAAVEEKTMTADQISKHIPAALKRDGAGPAAKGAKKEEAQQVVDPVVENLRKDKKLSQHEKRLLNCIVDPSKLASTTFRDVHLPEKTIDGIRSMISLPLLFPEAFRGGVLKDHATTGALLFGPPGTGKTLLARAVAAESGARMLAIQPSDVNDMYVGEGEKLVKAVFSLARRLSPCVVFLDEVDALFGARISRGSSGSMSHNLILTEFMQEMDGLSSAIANKDKRVVVIGATNRPFDLDDAVMRRLPRRLLVDLPGVEDRKAILEILLRGEQLGEDVHLDQIAKETDGFSGSDLKHLCVSAALSAVKDTVSVPWRHLSPSSVVSSSLGSEERPRTPLPGGDGRGRGGGGGGLGNEVLVMAPTEGGGGGGGGRKKVRVKKEKASATASYGEESISSAAREESESPDEEQEQLGVGEVPEQVEEEQLLSADRTRDASPSEDAPEPAKPPPIEEEQTVPKRVLMHKHFKTALEEIRPSASEEGSLPELRKWAEQFGEGGKRRGKKSGFGKGFGFSDEPVRDRDTGYGKVRQDD

SEQ ID NO: 40329 - protein, 220 aa, Vitis vinifera
MKFKKTYIALTVCPMRLEKPPVEPGSVNDNVTQAASSSTDPGLPEFPSKDINRRIAVVSSLAAVGLFLSKRLDFGVSLKDLSAAALPYEEALSNGKPTVVEFYADWCEVCRELAPDVYKVEQQYRDRVNFVMLNVDNTKWEQELDEFGVEGIPHFAFLDKEGNEEGNVVGRLPKQYFQENVEALAHGEASIPHARVVGQYSSAESRKVHQVVDPRSHGRG

SEQ ID NO: 40330 - protein, 311 aa, Triticum aestivum
TTEQVCTKKQAATGPEFPGYRRPTRPAVIGILPCTILIPGLFFIPESPRWLAKMNKMEDFETSLQVLRGFETDITSEVNDIKRAVTSANKRAAIRFQELNQKKFRMPLILGIGLLVLQQLSGINAILFYASSIFKAAGITNSDLATSGLGGIQVLATLVTTWLLDRAGRRILLIISSAGMTISLLAVAVIFFIKDTVSQDSHLYYILSMVSLLAIVAYVIAFSFGMGAIPWVIMSEILPVSIKSLAGSFATLANWLTSFGITMTANLLLSWSAGGTFVSYMLVSAFTLVFVILWVPETKGRTLEEIQWSFR

SEQ ID NO: 40331 - protein, 496 aa, Zea mays
MGEVVAASSLALVLLFFCSCGPASGLLSPKGVNYEVQALMMIKNYLKDPHGVLKNWDQDSVDPCSWTMVTCSPENLVTGLEAPSQNLSGILSPSIGNLTNLETVLLQNNNINGLIPAEIGKLRKLKTLDLSSNHFSGEIPSSVGHLESLQYLDLSYNNLSGPIPGSLTRTFNIVGNPLICAATMEQDCYGSLPMPMSYGLNNTQGTVIPAKAKSHKVAIAFGATTACISLLFLAVGSLFWWRCRRNRKTLFNVDDHQHIENGNLGNMKRFQFRELQAATENFSSKNILGKGGFGIVYRGQLPDGSLVAVKRLKDGNAAGGEAQFQTEVEMISLAVHRNLLRLYGFCMTASERLLVYPYMSNGSVALRLKGKPPLDWITRKRIALGAARGLLYLHEQCDPKIIHRDVKAANILLDDCCEAIVGDFGLAKLLDHRESHVTTAVRGTVGHIAPEYLSTGQSSEKTDVFGFGILLLELITGQTALEFGKSSNQKGAMLDW

SEQ ID NO: 40332 - protein, 297 aa, Triticum turgidum subsp. dicoccoides
  misc_feature (89)..(208): Xaa can be any naturally occurring amino acid
GFLGLSGAILVQVQRTLHIDPGSFILMLAILPTAIALLLMYFVDVHSAHQRYNKKFLDAFSLMAVTVAGFLMVVIICDQVFMISSAGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 40333 - protein, 514 aa, Bacillus amyloliquefaciens
MIQKRKRTVSFRLVLMCTLLFVSLPITKTSAVNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDHPDVVAETKKWGIWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSRHPEKAVTFVENHDTQPGQSLESTVQTWFKPLAYAFILTRESGYPQVFYGDMYGTKGTSPKEIPSLKDNIEPILKARKEYAYGPQHDYIDHPDVIGWTREGDSSAAKSGLAALITDGPGGSKRMYAGLKNAGETWYDITGNRSDTVKIGSDGWGEFHVNDGSVSIYVQK

SEQ ID NO: 40334 - protein, 297 aa, Triticum turgidum subsp. dicoccoides
  misc_feature (136)..(155): Xaa can be any naturally occurring amino acid
GFLGLSGAILVQVQRTLHIDPGSFILMLAILPTAIALLLMYFVDVHSAHQRYNKKFLDAFSLMAVTVAGFLMVVIICDQVFMISSAGQSVCFAILLLLIMSPVTIVVRAQRSESKQREEPTSEEQTGLLLHEETAXXXXXXXXXXXXXXXXXXXXMSSDKAENLNVVQAMCKLDFWLLFLAMACGMGSGLATVNNISQIGGSLGYTSRETSTLVSLWSIWNFSGRFGAGYVSDNFLRSRGLGRPFFIAATLLVMGVGHAIISSGFHASLYVGSVLVGLCYGSQWALMPSITSEIFGL

SEQ ID NO: 40335 - protein, 286 aa, Raphanus sativus
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 40336 - protein, 297 aa, Triticum turgidum subsp. dicoccoides
  misc_feature (128)..(201): Xaa can be any naturally occurring amino acid
  misc_feature (205)..(205): Xaa can be any naturally occurring amino acid
GFLGLSGAILVQVQRTLHIDPGSFILMLAILPTAIALLLMYFVDVHSAHQRYNKKFLDAFSLMAVTVAGFLMVVIICDQVFMISSAGQSVCFAILLLLIMSPVTIVVRAQRSESKQREEPTSEEQTGXXXXXXXXXXXXXXXXXXXXXXXXXXXXXXXXXXXXXXXXXXXXXXXXXXXXXXXXXXXXXXXXXXXXXXXXXXSLGXTCRETSTLVSLWSIWNFSGRFGAGYVSDHFLRSRGLGRPFFIAATLLVMGVGHAIISSGFHASLYVGSVLVGLCYGSQWALMPSITSEIFGL

SEQ ID NO: 40337 - protein, 528 aa, Nostoc sp. PCC 7120
MDAKALWQRYQEWLYFHEGLGLYLDVSRMRFDDAFVKSLLPKFDKAFADMAELEKGAIANPDENRMVGHYWLRNPDLAPTPEIAQEIVQTLEQIEAFAEKIQTGAIHPPKANRFTDIISIGIGGSALGPQFVAEALAPEFPPLKIHFIDNTDPAGIDRILTHLRNHLASTLVLVISKSGGTPEPRNGMIEVKKAYAGQNLDFAQYAVAITSTGSNLDKVAQSEGWLATFPMYDWVGGRTSEMSSVGLVPAALQGIDVRAMLEGAKEMDDATRVPEVKNNPAALLALSWYYSGNGKGEKDMVVLPYKDSLLLFSRYLQQLVMESLGKEKDLDGNTVYQGIAVYGNKGSTDQHAYVQQLREGVPNFFATLIEVLEDRHGASPEIDPGVTSGDYLSGFLLGTRQALYENQRDSITVTIPQVNARTVGALVALYERTVGLYASLVNINAYHQPGVEAGKKAAAVILDLQTKVVGLLQKEKTALSLEQIAEKIGAADQVEAIYKILRHLQANQRGVVFQGNLGQPSSLKISLS

SEQ ID NO: 40338 - protein, 190 aa, Zea mays
FCKQLDNSVVGIRSPIITLSQLLRSHAEELWRHLEVVTKANPQFYAFRGIPLLLTQEFQFRDCLTLWDPLLGAPGGPRVPLLGVCCGMLIFFRGRLLAGDFPGNFKLFQNYPPPNLDPFLPIVTKLGGPLPFCPVGSLAYFVPVYGFVLDYVFPGKESCVKNFFKMTLKKKKKKKKKKKKKKKKKKGRPL

SEQ ID NO: 40339 - protein, 483 aa, Pseudomonas fluorescens Pf-5
MIPVILSGGSGSRLWPLSRKQFPKQFLALTGEHTLFQQTLERLVFEGMDTPIVVCNKDHRFIVNEQLAARKLESQRILMEPFGRNTAPAVALTAMMLVNEGRDELMLVLPADHVLDDQKALQRALALATVAAERGEMVLFGVPATKPETGYGYIKSTNDALLPEGVSRVSHFVEKPDEKRATEFVQAGGYFWNSGMFLFRASRFLEELKKHDPDIYDTCLLTLERSQQDPDTVTIDEATFACCPDNSLDYAVMEKTQRACVVPLSAGWSDVGCWSSLWDVHEKDANGNVSKGDVVIQDSKNCMIHGNGKLVSVIGLENIVVVETKDAMMIAHKDKVQGVKQMVNTLNEQGRSETQNHCEVYRPWGSYDSVDMGGRFQVKHISVKPGACLSLQMHHHRAEHWIVVSGTAEVTCDENVFLLTENQSTYIPIASVHRLRNPGKIPLEIIEVQSGSYLGEDDIERFEDIYGRSTPVERGVSVKTIAQ

SEQ ID NO: 40340 - protein, 202 aa, Bacteroides thetaiotaomicron VPI-5482
MEITSAEFVISNTDVKKCPTGVFPEYAFIGRSNVGKSSLINMLTARKGLAMTSATPGKTMLINHFLINQSWYLVDLPGYGYARRGQKGKDQIRTIIEDYILEREQMTNLFVLIDSRLEPQKIDLEFMEWLGENGIPFSIIFTKADKLKGGRLKMNINNYLRELSKEWEELPPYFISSSENRTGRTEILDYIENISKEVYKNK

SEQ ID NO: 40341 - protein, 517 aa, Vibrio cholerae O1 biovar eltor str. N16961
MTKNIHDQRILILDFGSQYTQLVARRVREIGVYCELWSWDVEEADIREFNPDGIILSGGPESVTEANSPRAPQYVFDSGVPVFGVCYGMQTMAEQLGGRVATSDEREFGYAQVKISGESALFKDLDLTQDVWMSHGDKVVEIPADFVKIGETDTCPYAAMANEEKKYYGVQFHPEVTHTKNGLQMLENFVLGVCGCERLWTSESIIEDAVARIKEQVGNDEVILGLSGGVDSSVVAMLVHRAIGSKLTCVFVDNGLLRLNEGEQVMEMFGDKFGLNIIKVDAEERFLKALEGIDEPEAKRKTIGRVFVEVFDEESKKLSNAKWLAQGTIYPDVIESAASKTGKAHVIKSHHNVGGLPDDMKMGLVEPLRELFKDEVRKIGLELGLPYNMLYRHPFPGPGLGVRVLGEVKKEYCDLLRRADAIFIEELHAADLYNKVSQAFTVFLPVRSVGVMGDGRKYDWVVSLRAVETIDFMTAHWAHLPYEFLGKVSNRIINEVNGISRVVYDISGKPPATIEWE

SEQ ID NO: 40342 - protein, 1300 aa, Shewanella oneidensis MR-1
MKTKIALAVSMALLSSAANAQTVLSHSGETVQFDISPELAASTVRGSLSIEANEVKFVPEVDLDDSEYTYIVRLRDSAAANYQGEIAGFKATSPQHTSSRISSQFSGNVKLDAAKPEVKNYVSYLKVKQNRFLTNASAAIGSPIEALTTYQYALNGMAIRMTQAQAIKMAELPDVVFIERERIEQLETDVSQSLIGSPKIWDGSATGTKAMGEGVIVGIIDSGINSDHASFADIGGDGYDHSNPLGQGIYIGDCKTDFTSMCNDKLIGVRSYSEITNNYDDAKVFGDKPPAKNGEDYGGHGSHVASTAAGNILLNVPYVQGEAGKLEAEGIPTDIKFAQISGVAPHANIIAYQICNPGNAGDTYSGCPTAPILKAIDDSIKDGVDVLNFSISGGGNPWNSATEQGFLAARNAGIFTAVAAGNTRPATATSAAITQTPYSTPKNAPWYTSVANSTHDRDIVSAVEFNGKNYSFTAGSGPALTEVLSGIPVYAGSLDSTNFEACKAFATDAFKGKIAVIKRGGCTFDVKVAAALNAGAKGVVVFNREGEGNTRLSMSGLEKFNIPAVFIGNTDGLALIDAITANPSLELVISPLPKVVTKEADVLNASSLIGPNATNDVLVPFVAAPGTDIYAAYADQQFGHDKTGTDPADFTLMSGTSMASPHVAGAGALLKSLHKDWTPDQIRSALMLTATTAQAMKKADAKTIADPFDVGAGRIRVDLAAKTGLVMDELGLSYDIANPAKGGDPRKLNIPSMADSRCIDNCTWTRTVTATADGTWTAKGVAVTDKLVVTASPERFSLKKGQSQVITVTANVAEVGENWGFGNLVLESDAFPTASMPIAAKIAKRDLPTALNILAARDADERNFNHLKAIDMPGVSAKVTALALSDTLESRVKQDSDNNSAFDNLEDGVKVFTFNVEDNALFFNVSIGETTSPDLDMFVFLDKKDGSKLSRVGSSALNGSKERVSIKNPVKGQYIVIVQNYEASAANAEDTFSLKQVTLYNGAGDNLTAALSGDSKDFSINLAWKQAMLVGSDGLAQLTLTSSDEKVAPVAIPLLFERTIDDVLPPLGSTISSELTPGVPKVIKTRIAANSTPEMRVYTLEAQIPEGHEVANISHKGAHQANKISWTIDMASAAAAQDITFELVPRKASQENQLILTNKVNNGSAEILKQEYQFDVTEVAPVAMIEAPASVQEGKPLFIDASKSADANNDPLTYKWTQLGGASFNFDPTAAKLNLVAPNVDGAAQTVSFQLTVSDNHGNRDSSVVSVSITDTPPKKDDGGALGWLSLLLLPFAFGRRKLR

SEQ ID NO: 40343 - protein, 289 aa, Triticum aestivum
  misc_feature (211)..(211): Xaa can be any naturally occurring amino acid
  misc_feature (240)..(240): Xaa can be any naturally occurring amino acid
  misc_feature (243)..(243): Xaa can be any naturally occurring amino acid
  misc_feature (261)..(261): Xaa can be any naturally occurring amino acid
  misc_feature (264)..(264): Xaa can be any naturally occurring amino acid
  misc_feature (266)..(266): Xaa can be any naturally occurring amino acid
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPXSTGAAKAVGKVLPELNGKLTGMAFRVPTXDVXVVDLTVRLAKPATYDQIXAAXQXESEGNLKGILGYVDEDLVPLTSG

SEQ ID NO: 40344 - protein, 286 aa, Physcomitrella patens subsp. patens
LYVWDLDETLIIFQTLRNGRYAELYKGSKDPREACELGRRWESLILDICDDYFFYKQVENYNEPSLLSLQDFDDGADLSQYNFDGDNLTVPVDTANKNKLAYRHRFIGELYEKGLEKLLTQDQLTEWNNLYEATDIFTDGWLTAANQHLNEKQHKAESLNTGNCDPILQASTCVKNYNILVTSGTLVPSLVKCMLFRLDSYFHHLNIYSSREVGKLQCFYWIRERVQGLPVRFCVVGDGIDECEAAQWLAWPFVKINIGPDADNRLPIMSMEILEQNMRTIYKLDQ

SEQ ID NO: 40345 - protein, 110 aa, Zea mays
  misc_feature (63)..(63): Xaa can be any naturally occurring amino acid
VAPRTSLPFFPSIPTGTYQRTQINDATSSPREPFAAREDPSDAPTAKPYWPAKLAPHDTTPVXYAGFLRVAFGLLREMLRYNVCSRIAIVLCHPALLNVNNFENGLKQLS

SEQ ID NO: 40346 - protein, 347 aa, Guillardia theta
MPRLILLLVVLGICSANYASRNAPMAGPRKFLGDGELPSVLNSRELLPESQTTVPQALRLRGGGLPYRYQDNWSDIVVRMPIDEPIKSKDIHYKLTPSMLELGLKGQEPFIKDELWGLVKVDECLWEIEMDNKLGRHVALQLKKAKGEKWDFLLKKEDIPPDMTVTEKCFLDIQIDGEAVGRIVIGLYGKTCPRTAYNFRALCTGEVQVDPEKHKRTQAANATLTYKGTKFHRIIPSFMVQGGDFTKGDGTGGESVYGGRFEDESFQIKHSREGLVSMANAGADCNGAQFFITTASAAHLNGKHVVFGEVLEGYEFVQKIEDCGSNSGKPSRRSSLWIAALSASRNR

SEQ ID NO: 40347 - protein, 461 aa, Oryza sativa Indica Group
MGGKLLPAAAFAGSAPPLSQVSTSAAHGEDSPYFAGWKAYDEDPYHAVDNPDGVIQMGLAENQVSFDLLEAYLRDHPEAAGWSTGGAGAGSFRDNALFQDYHGLKSFRKAMASFMGKIRGGKARFDPDHIVLTAGATAANELLTFILANPGDALLIPTPYYPGFDRDLRWRTGVNIVPVRCDSANGFQVTVAALQAAYDEAAAVGMRARSVLITNPSNPLGTTVRRKMLDDILDFVSRNDIHLISDEIYSGSVFAAPDLVSVAELVEARGGGGIAGRVHIVYSLSKDLGLPGFRVGVVYSYNDAVVTVARRMSSFTLVSSQTQKTLAAMLSDEAFAGEYIRTNRRRLRERHEHVVAGLARAGVPCLRGNAGLFVWMDMRRLLLGGGGVGGELRLWEKLLRQAKLNISPGSSCHCSEAGWFRVCFANMSLDTLDLALHRISRFMDTWNGTKQQASCQQQEQQ

SEQ ID NO: 40348 - protein, 499 aa, Vitis vinifera
  misc_feature (481)..(481): Xaa can be any naturally occurring amino acid
MDYTPLVLLLLLPCFVWLCFHFLILGSTHRKSFQARLPPGPRPLPIIGNLLELGDKPHHSFTTLSKKYGPLMSLKLGSITTIVISSPETAQQVLNKKDQTFSGRTVPNAIQVANHQHFSIGFLPASAHWRNLRKICSMQIFSLQRVDAFHGLRRKVVQQLLDHAHESCSSGRAVDIGRTAFTIALNLLSNTVFSVDLAHYDSNLSQEFKELIWSILVEVGKPNLADFFPGLRLVDPQGIHKRMSVYFNKLFDVFDSFINQRLQLRASSTDNDVLDALLNLNKQHDHELSCNDIRHLLVDLFSAGTDTTSSTIEWAMAELLNNPKAMAKARDELSQVVGKDRIVEESDISKLPYLHAVVKETFRLHPPAPFLLPRKAEMDSEILGYAVPKNAQVIINVWAIGRDSKTWSDPHSFGPERFLECDIDVKGRDFQLIPFGAGRRICPGLLLGRRMVHLVLASLLHSFDWKLEGGMKPEDMDMSEXFGFSVRKAQPLRVVPIKP

SEQ ID NO: 40349 - protein, 324 aa, Enterococcus faecalis V583
MTENYQDDTLRIFSLNANRPLAEKIAASVGTELGKSTVRQFSDGEIQINIEESIRGDHVYIIQATNAPVNDHLMELLILIDALKRASAKTVNVILPYYGYARQDRTAKPREPITAKLVANMLVEAGATRLLTLDLHTVQVQGFFDIPVDNLFTMPLFAHYYRQQALVGEEIVIVSPKNSGVQRARSLSEYLDATLAIVDHEEIDGVRQEGYVIGNVAGKKCILVDDILNTGQTLATAAEVLMKNGAQEVYACASHGLLSEGAKATLENAPIKEISITDSVYTTADRQPATLNIISCAELMGEALLRIHENKPMSPLFRLEPKGE

SEQ ID NO: 40350 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPRSDLPERLVQNRSFNTFDLTKEDFEEIAKLDIGLRFNDPWDWDNIPIFV

SEQ ID NO: 40351 - protein, 512 aa, Enterococcus faecalis V583
MSILTIEHLTHRFGEKVLYEEASLQVNKGDHLGLTGQNGVGKSTLIKILTGEVLPDEGTIQWQKNCKIGYLDQHVSVEQSLTMVDFLKQAFQELFDKEAKLTKLYEEYSQTASEKLLEQAGKLQTDLDESNFYQIDTIIQDLANGLGLQAIGLDKKLGELSGGQRSKVILAKLLLEAPDVLLLDEPTNYLDDTHIQWLVRYLNNFEGSFLLVSHDYQFLNEVTNCIADIEFGKLTKYTGNVEKSFAQKEQNKQTYLKQYQAQQEKIEKMEAYIRKYKAGNRATMAKSRQKQLDRLERLTPPGSLTKPAIEFPYQGLVATQALTTQKLVVGYREPLLEPLDLMVHVGEKVALKGFNGIGKSTLIKTLTKVIPSLDGEFHYPLNTKIAYFTQDLAWPNEQLTPLDYLSDRFPDTTIKERRSHLARAGLPDKLAMQSLALLSGGEQTKVKLAELMMQTSNLLFLDEPTNHIDEAAKKSLQEAIHVYPGTVFLVSHEADFYEEIVDRVIDIEELVK

SEQ ID NO: 40352 - protein, 221 aa, Glycine max
  misc_feature (217)..(217): Xaa can be any naturally occurring amino acid
MGVTPKIAPSMLSSDFANLASEAQRMLHMDIMDGHFVPNLTIGAPVIESLRKHTKGYLDCHLMVTNPLDYVEPLAKAGASGFTFHVETSKDNWEELIQRIKSHGMTPGVALKPGTPIEEVYPLVEAGNPVEMVLVMTVEPGFGGQKFMPEMMDKVRILRKKYPSLDIEVDGGLGPSTIDVAASAGANCIVAGSSVFGAPEPVQVISLLRNSVEKAQXTLIQ

SEQ ID NO: 40353 - protein, 216 aa, Citrus sinensis
MADEVVLLDFWPSMFGMRVRIALAEKGVKYEYKEEDLKNKSPLLLQMNPVHKKIPVLIHNGRPVCESSIIVQYIDEVWKDKAPLLPSDRYQRAQARFWVDFIDKKMYDASTKTWTTEGEEQEAAKKEFFEALKTLEGQLGDKPFFGGDNFGYLDLSLIPFYYTYETFGKSSIEAECPKFKAWVKRCLQRETIAKALPDEKKVLEHASGMRKNLVLE

SEQ ID NO: 40354 - protein, 281 aa, Campylobacter jejuni
AIINRLKNANLGLLDQNAIEAIYQEIFAVSRNLEMPQTIAYLGPEGTYTHQAARSRFGAMSRYIALANIEDVFKELSNKEAKYGVVPIENNTEGAVGITLDCLGKYNELKIFGEIYMDIHHSFVGINENLKEIKRIYSHPQGYNQCRKFLESHELSAIEFVPSKSTANAAYLASQDKYAAAICSRIAAKLYNVPVLFDKIEDNAANKTRFLILSDIKNPKMPNCKTSILAHTAHKPGGLSFLLEQFKKENINLTKLESRPVKSKEFLHSFYIDFEGHIDDE

SEQ ID NO: 40355 - protein, 681 aa, Cryptococcus neoformans var. neoformans B-3501A
MPDTPPHKHHYTSLRSLMHSPDPGNPAKRDSLTPRQPRPSRNSSSSRSRERRLDPPRKADKDKGRLSTWKLMCLTVSMGGSQIAWTVELGYGTPYLLSLGLSEQLTSLVWLAGPISGLIAQPLIGAISDSSHSRYRRRYWIVTSTMLLVFSGLGLAFTEPIAKALVDLIGGGQGDWDPKTIRLVKNTAIGIAVFSFYCLDFALNALQASLRNLVLDITPGEQLATANAWHGRFNHVGNIVGFTMGFLNLSHVPIIRLVGGGQFRKVCIVALVLLVMTVWITCWTQEEKETDSIFGERRSKIRDVVGTIYEAVLHLPKPIRRVCIVQIAAFMGWFPYLFYSTTYVAEVMAKELHHKPDIDRATRAGSLALLIYSFVAIIAGTLLPYLAARDRRLLKPTSEKLRDGEIEIENEDEEDEEHVEMERIREMVQQWKAEAAREGRPLKLPTMPFMLRNIWTAGLVIFGCLMMSTFFITKVWQATVMIALVGICWAIACWVPFAIIMEFLKELDDKPPPRISDGRPRPTHARTTSTPLGWRSHPTSPAGRASPDERTPLARSYSTADLDGANEMEYTGQGPVAGGTIMGIHNLAIVFPQFIASLILSPFLRYQLIVVVLADTQPDIQPTSPEIGGPHGQDKNGVAWVLRFGGLMAFVGALVSRKVPPTKTEKAMRRRLADMREESAE

SEQ ID NO: 40356 - protein, 281 aa, Campylobacter jejuni
AIINRLKNANLGLLDQNAIEAIYQEIFAVSRNLEMPQTIAYLGPEGTYTHQAARSRFGAMSRYIALANIEDVFKELSNKEAKYGVVPIENNTEGAVGITLDCLGKYNELKIFGEIYMDIHHSFVGINENLKEIKRIYSHPQGYNQCRKFLESHELSAIEFVPSKSTANAAYLASQDKYAAAICSKIAAKLYNVPVLFDKIEDNAANKTRFLILSDIKNPKMPNCKTSILAHTAHKPGGLSFLLEQFKKENINLTKLESRPVKSKEFLHSFYIDFEGHIDDE

SEQ ID NO: 40357 - protein, 340 aa, Prochlorococcus marinus str. MIT 9301
MKIGINGFGRIGRLVFRALWDRADIEITHINEIAGDSNAAAHLLEFDSVHGRWVKDIKVKEEEIIIDGKKLTYTSFKNYLDIPWEKSSVDIILECTGKNKKPDKLNPYFDTLGMKRVIVACPVKGIVAEAESLNIVYGINQSLYDPTKHKLVTAASCTTNCLAPIVKVINENFSIKHGAITTIHDVTNTQVPVDFYKSDLRRARGCMQSLIPTTTGSAKAIAEIFPELKGKLNGHAVRVPLLNGSLTDAVFELNKEVTTEQVNMALKEASETYLKGILGYEERPLVSADYVNDSRSSIVDSLSTMVVNSNLLKIYAWYDNEWGYSCRLADLTEYVIKKEI

SEQ ID NO: 40358 - protein, 435 aa, Oryza sativa
MAAAATAAVPLDEAKAKEVLRQVEFYFSDSNLPRDNFLRKTVEESEDGLVSLALICSFSRMKKHLGLDADVKQETMPEETVLAVAEVLRRSSALRVTEDGKKVGRSIELSKLDEIMEQVDSRTIAASPFPYNVKLEDVQSFFAQYGKVNSVRLPRHIADKRHFCGTALVEFSEEEEANAVLKNTLVFAGADLEIKPKKEFDTEREAKKEAYEKSQPTKNGHDEGYPKGLIVAFKLKIIQIDGGMAENGGDKEGETDDANKSRTGHDEKIPENSDIKEDLSDDVEKSKEAAAQSVKKGESPSENADDPISREDFKEEFGKFGTVRYVDFSIGEDSGYIRFEDSKAAEKARALAAISDEGGLIMKGHLVTLEPVSGQAEKDYWSAIKGGQGKYRDNRSNRGRDWKNNRGGRHFGGKRGRHSDGHERANKARKVDAAA

SEQ ID NO: 40359 - protein, 428 aa, Microcystis aeruginosa PCC 7806
MNIAVVGLSHKTAPVEIREKLSIPEAKIESALTHLKGYPHIQEVAIISTCNRLEIYSVVTDTEKGVVEITQFLAEIGHIPLNVLRRYLFTLLHQDAVRHLLRVSAGLESLVLGEGQILAQVKNTHKLAQKYNTISQLLDRLFKQAMTAGKRVRTETSIGTGAVSISSAAVELAHAKVADLSGKKIAIIGAGKMSRLLVTHLLAKGSQQIAIVNRSQRRAQELAREFPNVPIQLYGLEEMMATVAASDIVFTSTGATEPILTKNLLTEVTITATSLMLIDISVPRNVHTDVKELAQVQAFNVDDLKAVVAANQESRRQMAREAEALLEQEVEAFELWWRSLDTVPTISCLRSKIEDIREQELEKALSRLGTEFAEKHQEVIEAMTRGIVNKILHEPMVQLRAQQDIEARKRCLQSLQMLFNLSVGEEYS

SEQ ID NO: 40360 - protein, 411 aa, Nicotiana tabacum
MGSLRAILKNPDDLYPLVKLKLAARHAEKQIPPSPHWGFCYSMLHKVSRSFALVIQQLPVELRDAVCIFYLVLRALDTVEDDTSIPTDVKVPILISFHQHVYDREWHFSCGTKEYKVLMDQFHHVSTAFLELRKHYQQAIEDITMRMGAGMAKFICKEVETTDDYDEYCHYVAGLVGLGLSKLFHASGKEDLASDSLSNSMGLFLQKTNIIRDYLEDINEVPKCRMFWPREIWSKYVNKLEELKYEDNSAKAVQCLNDMVTNALSHVEDCLTYMSALRDPSIFRFCAIPQVMAIGTLAMCYDNIEVFRGVVKMRRGLTAKVIDQTRTIADVYGAFFDFSCMLKSKVNNNDPNATKTLKRLEAILKTCRDSGTLNKRKSYIIRSEPNYSPVLIVVIFIILAIILAQLSGNRS

SEQ ID NO: 40361 - protein, 280 aa, Synechococcus sp. WH 8102
MPTRIAYLGPAGTYGEQASRALAELEGLTEVSFLPCVGLRAVVECLAQAGADAAVVPVENSVEGGVTATLDALWAHSDLGIRRALVLPIRHALLGSGSLQDVTEVLSHPQALAQCSGWLAAQLPQALQLPTSSTAEAARMVAGSRFRAAIASRKAGLEHGLEELAYPVNDVAGNRTRFLLLHRGERRLEGDVASLAFSMHRNAPGALLEALACLAEQGLNMSRIESRPSKRELGEYVFFVDVELPAQQPEALSTLVAALTPLCEHLAHFGAYPSSELVSG

SEQ ID NO: 40362 - protein, 611 aa, Physcomitrella patens subsp. patens
MGSMPEGRKCISCLGQPIAGPRRPYIGKPSRLLRHLLSPLEVQQIMKAEKECPANQLRPEQVVVNNRPLSHEELAVLLGCQLPPGRLKPGKYWYDGQTGLWGKEGHRPDRIVTPSLKVGGNLQPNASNGKTQVFMNGRELGKLELKMLKFAGVNCVPNTLLWVEHDGSYSEEGFKNVKGNIWAKEGNLWEKAKILYNDGFTPEEYASFKTLIQANIYKYMAILLEGREHFEEEDDELANVSAKNHLDDTSVVSKENGDPSSSSTGDNIYRLEPNLKELSDWFMDNMVCGNLESMSTSTSAHLQDHASKIEQLWLSSAVQATFQRRSELPFLPDLASFFLNRVVDVCRSDYEPAEIDILRTEGLSQGSGLVQIEITLDDNPGSWQDTLAGSQTLPQFRCRYQVIRVGGKGMSDRHKWLDMFEDVRAVVFCVALSDYNSLWNDRSGNPSNKMIQTRDLFESILRHPCFQDTPFVLLLNKYDVFEDKIEQGVPLTTCTWFSDFRPVGTSHYTAQNQAQQAYQYIAHKYKELFNSVDCTGRKLFTFQLNALDKTTVSGAFNYVKQILKWDEQKAAGWGIIPDEMSSYSTDISSFSRHSSHSMTRQPDLFRRQHHY

SEQ ID NO: 40363 - protein, 186 aa, Haloarcula marismortui ATCC 43049
MVDPKESIDIENVVASTGIGQELDLESVAMDLEGADYDPEQFPGLVYRTQDPKSAALIFRSGKIVCTGAKSTDDVHQSLRIVFDKLRDLNIQVDDDPEIVVQNIVSSADLGSSLNLNAIAIGLGLENIEYEPEQFPGLVYRLDEPDVVALLFGSGKLVVTGGKRKEDAEEAVDTIVERLSDLGLLD

SEQ ID NO: 40364 - protein, 195 aa, Leuconostoc mesenteroides subsp. mesenteroides ATCC 8293
MVDYPQLDAANYSGPVAIFKTNKGDIRIKLFSDIAPKTVENFITHAKNGYYNNGIFHRVISDFMIQGGDPEGTGMGGESIWGGSFEDEFSDRLFNTYGALSMANAGPNTNGSQFFIVQASNFPSQMVSALRDLPAEVADFYRQKGGTPWLDGKHTVFGQVIEGLNIVDEIAKVKVDMADKPRVDVVINTIEIAGA

SEQ ID NO: 40365 - protein, 297 aa, Physcomitrella patens subsp. patens
MGNPTCSKGSTFEDIDADESDPQMCSTYATDIYEHLRMAEIKRRPATNFMEVMQRDISPSMRGILIDWLVEVAEEYKLLPDTLYLTVAYIDRFLSCNTVTRQRLQLLGVSSMLIAAKYEEICAPQVEEFCYITDNTYRREEVLEMEMKILRELKFELTTPTTKSFLRRFVRAAQSSCQAPALVLEFLGNFLAELTLTEYSMLGFLPSMVAASAVYLAKLTLDPSKCPWDASLQHYTGYRASELEKCVKVIHDLQRNTSSCILPAIREKYRKHKFKCVEMLTPPSVIPPEFFIDSERC

SEQ ID NO: 40366 - protein, 219 aa, Enterobacter cloacae
MTQDELKKAVGWAALQYVQPGTIVGVGTGSTAAHFIDALGTMKGQIEGAVSSSDASTEKLKSLGITVFDLNEVDRLGIYVDGADEINGHMQMIKGGGAALTREKIIASVADKFICIADASKQVDILGNFPLPVEVIPMARSAVARQLVKLGGRPEYRQGVVTDNGNVILDVHGLEILDAIALENAINAIPGVVTVGLFANRGADVALIGTADGVKTIVK

SEQ ID NO: 40367 - protein, 396 aa, Escherichia coli
  misc_feature (246)..(246): Xaa can be any naturally occurring amino acid
MFENITAAPADPILGLADLFRADERPGKINLGIGLYYDETGKIPVLTSVKKAEQYLLENETTKLYLGIDGIPEFGRCTQELLFGKGSALINDKRARTAQTPGGSGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSXNFGLYNERVGACTLVAADSETVDRAFSQMKAAIRDNYSSPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 40368 - protein, 396 aa, Escherichia coli
  misc_feature (246)..(246): Xaa can be any naturally occurring amino acid
MFENITATTADPILGLADLFRADERPGKIDLGIGVYKDETGKTPVLTSVKKAEQYLLENETTKNYLGIDGIPEFGRCTQELLFGKGSALINDKRARTAQTPGGSGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSXNFALYNERVGACTLVAADSETVDRAFGQMKAAIRDNYSSPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 40369 - protein, 438 aa, Symbiobacterium thermophilum IAM 14863
MRGVTNGGKEMGGAQNPFLIAQQQVRNAVAALGESEELFELLKAPAHFIEVQIPVRMDDGSLRVFTGYRSQHLTTLGPAKGGIRFHPAVTADEVKALSMWMTFKTSVVGLPYGGGKGGVVVDPRKLSLGELERLSRGYVRAIWPYLGPDKDIPAPDVNTNAQIMGWMTDEYETIVGASCPAVFTGKPLSMGGSLGREEATGRGTVITIREALAYLGLPVAGARVAVQGFGNAGQHAARLLEELGAVLVAASDSRGGIVCPGGMRVADLIAYKQATGSVVGFPGSRATDQFGVLTADCDILVPAALENQIDAEVARSIRARVVAEAANGPTTPDGDHVLAQRKIFLIPDILANAGGVTVSYFEWVQNRNQYYWTAEEVNARLEQRMVASFRDVVAMAERHGAYTRTAAYMYAIHRIAESLRMRGLLRAPARQALRAAAG

SEQ ID NO: 40370 - protein, 364 aa, Bacillus caldolyticus
MKRQLILEDGSFFVGERFGSLKETTGEVVFNTGMTGYQEILSDPSYCGQIVTMTYPLIGNYGINRDDFEAIRPHVHGFIVKEACVKPSNWRGELTLDEYLKEKGIPGLSGIDTRKLTRLIRQYGTLKGMICGLDVDPVEAAAKLRAMEWPRDQVRRVSTKSAYPSPGRGERIVLIDFGMKHGILRELNKRNCDVIVLPYNATAEEVLGWHPDGVMLSNGPGDPKDVPEAIEMIRGILGKVPLFGICLGHQLFALACGANTEKMKFGHRGSNHPVKDLRTGKVAITSQNHGYTVTHESLSGTRLEVTHIALNDGTVEGLRHLDVPAFTVQYHPEASPGPEDANPLFDEFLALIREFNKKGEVIHA

SEQ ID NO: 40371 - protein, 618 aa, Zea mays
MSAPLDRLARPCFEGFVHNDERKESRSDADNSEGDKKTKIGSFKKKAINAGNKFRHSLRRRSKKKTERGDSIKDIRDIKELQDVETFRQCLIDEDLLPPQHDDYHMMLRFLKARKFDVEKAKNMWSDMLKWRKEFGVDKIEEFEYAELDEVKKYYPQFYHGVDKEGRPVYIELIGKVDANKLVQVTTLDRYVKYHVKEFERCFQIRFPACSIAAKKHIDSSTTIFDVQGVGFKNFSKSARELITRLQKIDNDNYPETLCQMYIINAGQGFKMLWSTIKSFLDPKTASKIHVLGNKYQHKLLEIIDECELPEFLGGKCKCIEGCERSDKGPWKDPNIIKRVLNGEANYGRQIVTISSTDGRIVSYAWPVHPNRKGSDASAESGSEVEDVTSPTASRNLITHPILTPVHEESKLSAHGSSSVVHASIGENIPVVDKIVDDGWGSPRSSPQAASSGSLSLRNLHGTFQGLRAQTITWLTFLMMTLFAMLCSVPSKMARRISNQSGKHDDYHVEYPQEQECKEEFRPPSPAPSYTENDVISSMLRRLGELEDKVQVLETKPSEMPFEKEELLNAAVRRVDALEAELISTKKALYDALMRQDELLAYIDRQELIKFRKKKFCF

SEQ ID NO: 40372 - protein, 233 aa, Brassica napus
MAPSSSSGLTFKLHPLVMLNISDHFTRVKTQLNPPSSSCAPGNIPAAVGATFPQNFRVYGCVIGAQRGRTVEIFNSFELVFDPTTDSLDGAFLEKKQELYQKVFPGFYVLGWYSTGSEANESDMHIHKAPMDINESPVYVLLNPAINHAQKDLPVTIYESEFHVIDGIPQSIFVDASYTIETVEAERISVDHVAHLKPSDGGSAATQLAAHLTGIHSAIKMLNSRIRVLFRYL

SEQ ID NO: 40373 - protein, 214 aa, Wolbachia endosymbiont of Drosophila ananassae
MVQATYASMSLPGISSVEDVLEDARSGKLFILVDDENRENEGDLIVLAEKIKPEHMAFMVRYGTGVVCLAMTKFHMKRLGLNFMEKKNIGENHTAFTTSIDARYGITTGVSAEDRTKTIHAAINKDGTQDDIITPGHVFPVIAHKGGVAQRAGHTEASVEMAKLVGFDHSAVICELVNDDGSMMRLPQLLKFAEQHKIKLTTIDKLISYVKNLN

SEQ ID NO: 40374 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVTVKDRFG

SEQ ID NO: 40375 - protein, 171 aa, Escherichia coli
IGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVE

SEQ ID NO: 40376 - protein, 396 aa, Escherichia coli
  misc_feature (246)..(246): Xaa can be any naturally occurring amino acid
MFENITATTADPILGLADLFRADERPGKIDLGIGVYKDETGKTPVLTSVKKAEQYLLENETTKNYLGIDGIPEFGRCTQELLFGKGSALINDKRARTAQTPGGSGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSXNFALYNERVGACTLVAADSETVDRAFGQMKAAIRANYSSPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 40377 - protein, 231 aa, Agrobacterium tumefaciens str. C58
MDARQMKIKAAEAALSHVQDGMRLGIGTGSTAEEFVRLLAEKVAAGLKVEGVPTSERTARLCVELGVPLKSLDELPELDLTIDGADEVDHVLRLVKGGGGALLREKIVAAASGRMIVIADQSKVVETLGAFPLPIEINPFGQVATRIAIEKLAARSGLSGELTMRSSGDGAFMTDGGHLILDASFGRIPDAEALARELNTIPGVVEHGLFINLASLAIIAGPEGARMMQAV

SEQ ID NO: 40378 - protein, 432 aa, Sulfolobus solfataricus P2
MIYFFMVDAVELSRKYEGKIEIYPKVPITSYNDFALIYTPGVAEVSKAIYKDPDKSFELTSRWNTIAVVTDGTRVLGLGNIGPTAAMPVMEGKSLLFKYLGGVDAIPLPINVKSADEFTNVVKALETSFGGINLEDIESPKCFYILEKLQSMLNIPVWHDDQQGTAAAILAGLINAMILTNKDPKESKVVFYGAGASNIAAARILAKYGFKYENIVMIDSKGPLYADREDVDHLMLHHKWKYELAIKTNKWEAKEIKDAFSGADAVVAASTPGPNVIKKEWISLMNKEAIVFALANPVPEIWPQDAKEAGAKIVATGRSDFPNQVNNSLIFPAIFRGVLDSRAKAITDEMTIAASEALAKYARDRGINENYIIPRMDEWEAFYEEAAAVASKAVELGLARVKKSREEFREIAKERIIRARKIMNLVISTWSP

SEQ ID NO: 40379 - protein, 253 aa, Zea mays
  misc_feature (88)..(88): Xaa can be any naturally occurring amino acid
  misc_feature (180)..(180): Xaa can be any naturally occurring amino acid
FQAVELWIADRAVLPVENSLGGSIHRNYDLLLRHRLHIVGEVQLPVHHCLLALPGVRRELLTRVISHPQALAQCELTLNAMGLNVARXGLRDTAAIASARAAELYGLQVLAAGIQDDAGNVTRFVMLAREPIIPRTDRPFKTSIVFAHDTDGTSVLFKVLSAFAFRDISLTKIESRPHRXHRPIRLVDDANVGTAKHFEYMFYIDFQASMADVRAQNALAEIQEFTSFLRVLGSYPMDMTPWDAALSSRASQY

SEQ ID NO: 40380 - protein, 278 aa, Debaryomyces hansenii CBS767
MDYSYDNVVPSFRLDGRLAILTGGSGGLAAVVSRALLAQGAQIALLDMNLERTKAAAKELETWGQESLKGAHESPVGAVSAWSCNIGDFEQVEECFKNINEHHDMVADLLINTAGYCENFPAEEYPSANAEGILKVNGLGAFYVSQAFARPLISSNKKGSIILVGSMSGTIVNDPQPQCMYNMSKAGVIHLTRSLACEWAKFNIRVNTLSPGYILTPLTRNVISGHSDMKEAWESKVPMKRMAEPKEFVGSILYLASESASSYTTGHNLVVDGGYECW

SEQ ID NO: 40381 - protein, 687 aa, Coprinopsis cinerea okayama7#130
MFPPSKLGEYTVIADIAEGTFGKVKMAIHTVTGHKVAMKYISKAVIQREKTKTRVRREFEYLRTLRHPHIIKLYEVISTPTDIIFVLEYAGGELFNYIVANGRMSEAQARRFFQQIISGIEYSHRLKIVHRDLKPENVLLDDDLNVKIADFGLSNEISDGDFLTTSCGSPNYAAPEVIRGGVYAGPEIDVWSSGVILYVMLCGRLPFEDDDVQMLFHKISQGQFHCPSYLSKDAQSLINSMLVVDPVKRATITDIINHPFFKVDLPRYLTPLPPPPGPVLGMLTTLVAPPKQLDYEIIDGLGRIEEDVVEQLAARMIGVSKDDIWECLRRDDGAQGNAVKVAYMLLRDKNRLGKDLAVFAEAERDAQLAAQDPLTGLLSPTALSPAATEIDSNPFEAELNAEYEEEEEYLSEDELDSFIAAPPATDPTFAVLNSSLPEQLPEQHHLTSYVSAKRSARSGEKKQHRTKWHFGIRSRSPPMEVMLEIYRTLKTLGMEWKEKKNLGGLGGLKARRQHHHHQYHHHERGRASIERAREYDGDGGVDLKAAAGIYCVETRCRVQDVVVLMNLQLYMVDSINYLVDFHHKKTYKASTEPGAGKFDMAHFEIPSDSCSESERSVKEKEGCFGIGGREDEVVSPFVFMDVACRLILELAGGGELVEGRGRGVVTEEVGCGGSRREKETGLRGDAM

SEQ ID NO: 40382 - protein, 395 aa, Shewanella oneidensis MR-1
MSIEIKVPVLPESVADATIATWHVKVGQQVSRDQNLVDIETDKVVLEVVAPEDGHIGEFLFHEGDTVLGEQVIAKFIAGAVSGQEVTKAQAEAAAPAVASDESNDALSPSVRRLLAEHNVDASKVKGTGVGGRITKEDVEAFIKSAPKAAASAAPVVQPLAAGRSEKRVPMTRLRKTIANRLLEAKNSTAMLTTFNEVNMKPIMDIRKQYQDIFEKRHGIRLGFMSFYVKAVTEALKRFPEVNASIDGDDIVYHNYFDVSIAVSTPRGLVTPVLRDTDTMSLADIEKAVRDLAIKGRDGKLTVADMTGGNFTVTNGGVFGSLMSTPILNLPQSAILGMHAIKDRPMAVNGQVEILPMMYLALSYDHRIIDGRESVGFLVAIKDFLEDPTRLLLDL

SEQ ID NO: 40383 - protein, 569 aa, Vitis vinifera
MAHALHFSISLSPPPPPFLSKRLSSKPYACSAGSPISSVHSVSPVSENRLPLSKAPAPVVLQPTTVDSGVMHLDVAMEVELRENGPRSSRRTKLVCTIGPATCGLDELEALAAGGMNVARLNMCHGTREWHRTVIERVRWLNQVKGFSVSIMMDTEGSEVHMGDLGGLTSAKAEDGDIWTFSVRAFNSHRPECTISVNYDGFAEDVKVGDELLVDGGMVRFEVIDKIGPDVKCRCTDSGLLLPRANLTFWRNGSLVQARNAMLPTISSKDWLDIDFGIAEGVDFIAVSFVKSAEVIKQLKSYIAGRSCESDVAVIAKIESFGSLKNLKEIIQASDGAMVARGDLGAQIPLEEVPSIQEKIIRLCRQLNKPVIVASQLLKSMIEYPTPTRAEVADVSEAVKQQADGLMLSGESAMGQYPEKALAVLRSVSLRIERWWREEKHNDNMELPDIACTSLESVSEEICHAATKMANKLEADALFVYTKTGHMASLLSRCRPDCPVFAFTPSPSSQRRLNLHWGLIPFCLSFTNDMESNLDRSFSLLKARGMIKSGDLIISVSDMLQSVQVVNVP

SEQ ID NO: 40384 - protein, 388 aa, Shewanella oneidensis MR-1
MNLHEYQAKSLFAEYGLPVSEGFACDTAQEAVEAAGRIGGNLWVVKCQVHAGGRGKAGGVKVTGDKEEIRAFAEYWLGKNLVTYQTDEKGQPVAKILVESCTDIANELYLGAVVDRATRRVVFMASTEGGVEIEKVAEETPELIHKAIIDPLTGPQPFQARDLGFKLGLNPTQMKQFTKIFMGLATMFVDHDFALLEINPLVITTEGNLHCLDGKIGIDGNALFRQPKIKAMHDPSQDDAREAHAAMFELNYVALDGNVGCMVNGAGLAMGTMDIVNLHGGKPANFLDVGGGATKERVAEAFKIILSDSNVKAVLVNIFGGIVRCDMIAEGIIGAVKEVGVKVPVVVRLEGTNAELGREVLAKSGLDIIAANSLTDAAELVVKAAEGK

SEQ ID NO: 40385 - protein, 241 aa, Photobacterium profundum SS9
MKTRTLHVLAFAMVTTWATTSYAAEWSYTGEHGTEHWGDSFATCAEGVNQTPIDINQTTQAELAPLHLDYEGQVTELVNNGHTIQANLTGKNTLTVDGKTFELKQFHFHTPSENYLKGKQYPLEAHFVHATDKGELAVVAVMFDFGPRSNNELTTLLASIPSKGQTVELKEALNPADLLPRDREYYRFNGSLTTPPCSEGVRWFVMQEPQTSSKAQTEKLQAVMGNNARPLQPLNARLILE

SEQ ID NO: 40386 - protein, 642 aa, Arabidopsis thaliana
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATHGGILFKYF

SEQ ID NO: 40387 - protein, 332 aa, Microcystis aeruginosa PCC 7806
MSQVKPTILVTGGAGYIGSHAVLALKNAGYSVIVLDNLSYGHAEIIKDILKVELIVGDTRDRSLLDNLFASRDIAAVMHFAAFIAVGESVQEPAIYYQNNVSGSLTLLQAMIAADVKKFVFSSTCAIYGMPKEIPMTENHPHHPLSPYAASKEMVEQILRDFDRAYGLKSVAFRYFNASGADPSGLLGEDHQPETHLIPLALLTALKKRDSLSIFGTDYDTPDGTAVRDYIHVNDLAQAHVLGLEYLLNGGESNVFNLGNGNGFSVREVIETAQAVTGLDIPVIESPRRAGDAPILIGSSDKAKQVLGWHPQYADLKVIVEHAWNWHQKRHA

SEQ ID NO: 40388 - protein, 372 aa, Haloarcula marismortui ATCC 43049
MDYTEPQFFRVMQYAARADRDVVDMVSGNPDWDPPEGLRDGLRDYAEASADDYQYPPSVGLTPLRDEIAARRGVDRNRVLITNGAGEANHLAMTGGLHHFDGNEILLTDPVYPYYAGRANFIGADISFVPVDEHNRLAPADVRAAASEETAVIVVNSPNNPTGAVYDAEAMAEFAAIAEEYDALLLSDEVYDHFDYAGRFSSALRADSDHVVATNSFSKTMAITGFRVGYVIFPPEDGPTGTLLERARTQHMLTNVTGSRPAQYAVLRALKTTSPDYYAACRRRLERRVDDFCAALAAAGAEYNRPDGGFYVMARFPDFPGSFENVYELIDEAGVAGMPGEAFGESRSDWIRFALVTSRVDEAAQRLANYFG

SEQ ID NO: 40389 - protein, 355 aa, Trichoderma asperellum
MSRSNAPNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 40390 - protein, 985 aa, Magnaporthe grisea 70-15
MFRGRATGKVLGGSDTMLLEQDNEIREPPPDQEHGGNYYSASQAGDSSSGSSLQTKLLRRESKVSLALRALTNRSSSISVLERPASPDGVATSHRPSPPRGSPMSIVKKVSSSIFKPSIEHTVMHRSKHKARLSLEAARTASTVAVASSEPAAVFLPVSSSTLNAASNNNIGTNDSKPAGRSSQLFSAPNTTSTGMTSLDSKFSGSTKSKDKEAAAHSKEKDGADTPDRPDEPVCRKSIVPARRRVPMTRSSPEGPLAPIQEAKPLENTAAPEVRRQLYTHSFNRVESDHLREIRVMKARSIRALNPPKDCNLTVTPAVCENDYEVLKILGKGSFGVVRLVRDRREAQQPLQQQYCRTPGAAVYAMKVIRKSTMLRTSQEGHLRAERDFLVASEGSRWIVPLIASFQDAANLYLVMEYMPGGDFLGLLIRETTLTEQVARFYAAEMVLCVEAAHALRCIHRDVKPDNFLISASGHLRISDFGLAFDGHWSHDTAYYNNHRYSMLRRLGLSVEGDEQDQREGRSVRMTMKWASSIMNGMEKHERKDSAPGEEADFDGNCNRMAGTDGGVREPLLAWRNRCGNRTWATSVVGTSQYMAPEVVRGEKYDGRCDWWSVGVILYECIYGHTPFLSDEGRHQTKQNIVNHHSTFAFPSQPAVSPRCQQLMMSLITDKQHRLCSRRYIFKDIAAAGASGVTGSELASNGGSNSSTDLAGRFVFPYDAEDIKAHRWFRHIPWEHLHKLTPPFVPQIRSADDTKYFDEDEDSISDWSDTEPSTPGGCEAETTIVGTAVATTISTVDAVNGTTTAISVAVDSPLDSPRTSRNYNGGVVTALTRQQVREAEIATWLRGFQRSIQKAARHWVQVPYDALRLRNIDLRIESLPDLTIEQREILRRFVRLYGRKEKKRPRDRLLRDRQTKGVVLELRKRNAFLGYTWRRMRPGALQEMASAAKAEAVVKARALDANEFERYDSGCDGDDRSLLGHGNIL

SEQ ID NO: 40391 - protein, 314 aa, Candidatus Kuenenia stuttgartiensis
MQVGILKDNDMPRKVRCNSILERIGNTPLIRINKITKELQKRNVEIYVKAEWFNPGGSVKDRPALRIVEDAEKSGKLGGDKILIDSTSGNTGIAYAFIGAVKGYEVNLVMPLNVSEERKRIVSAFGTKTIYTDPLLGSDGAMNEAKRLVNETPAKYFYGNQYNNPSNWMSHYETTGVEIWKQTEGNLTHFIACLGTSGTLMGTGKRLKKFNSNIQVISVEPDTSIHGLEGMKHMETSITPGIYNEDFPDRKMYVETEDAYKLVKRLAAEEGFFVGYSSGAALAASLKVADEIKNGMIVTIFPDRGDRYLSTSFW

SEQ ID NO: 40392 - protein, 440 aa, uncultured archaeon GZfos10C7
MEEEKRKEGKKHLRTINKHEPEKVASEYHSYYRGKIEIGLKAPVRSYDDFAIWYTPGVAEPAREIKNSRERVFEYTNKGNSVAIVTDGTRVLGLGDVGAEAALPVMEGKAMLFKYLGGVDAFPLCLDTSDAEDIINTVKWVAPTFGGVNLEDIESPKCYYILERLQEELGMPVWHDDQQGTALVILAGAINALKVVGKRLSEIAISLVGAGAANMNVAKYLCLAGAKEGNMVMVDSKGILNRERVEDVKQDENKRDMCEKTNREGRKGGIKEAMRDTDLCIALSTPGPGVIKKEWVVDMADDAIVFACANPVPEIWPVEAEEGGARIVATGRSDFNNQVNNSLGFPAVFRGALDVRAARITDEMCIAAANAIARYTEEGGKGISESRIIPRMEESEMYVCEAVAVGMKAIEQGVAEKGMSMKALEERVREKISDKTTKPF

SEQ ID NO: 40393 - protein, 300 aa, Dehalococcoides sp. VS
MAARIRKAVFPVAGLGTRFLPATKTVPKEMLPIIDRPLIQYAVDEAIEAGCDTLVFITNRYKHAVADYFDKAYELEHKLERSGKTEQLELIRNVLPPGVRAVFVTQAEALGLGHAVLCAKDVIGNEPFAVLLPDDLIWNRGGAGALKQMADAAEASGASTIAVQDVPREQTGSYGIVATSNFDARQGRITAIVEKPKPEVAPSNLAVVGRYVLNPRIFELLENTTPGAGGEIQLTDAIATLLQQEAVNAYRFQGTRFDCGTHIGLIEATIRYALDHEKLSDSARQMMQNALNELGVEDLA

SEQ ID NO: 40394 - protein, 162 aa, Aspergillus nidulans FGSC A4
MATDVTFDTSMGSFTVELYNSHAPKTCKNFATLAQRGYYNNVIFHRIIPNFMVQTGDPTGTGRGGSSIYGEKFEDEIRSDLKHTGAGILSMANSGPNTNGSQFFITLAPTPWLDGKHTIFGRVKSGMRIIQRMGLVKTNNEDRPLDEVKILRAKVVEAGSEE

SEQ ID NO: 40395 - protein, 417 aa, Geobacillus stearothermophilus
MMKGCRVMFVLLGLWLVFGLSVPGGRAEAATSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFATERTYRGALTGNYYPELGMNAFSAVVCAPFLGSYRNPTLGIDDRWLENDGIVNTVSMNGPKRGSSDRIVPYDGALKKGVWNDMGTYNVDHLEIIGVDPNPSFDIRAFYLRLAEQLASLQP

SEQ ID NO: 40396 - protein, 160 aa, Clostridium perfringens
DRFGEIINTKNDCYILSGEGILGLEAACASLTEKGDKVLVLDNGLYGRWFDGFVTMYGGEVTYFSGDYTKEIDVEALSKFLEKNNDFKYATVVHCDTPTGVLNPIDKICPLLKSYGILTVVDSVSAMVGEEFKVDKWQIDIALGGSQKAFSADQGLLWVV

SEQ ID NO: 40397 - protein, 427 aa, Nostoc sp. PCC 7120
MSLQTLIEQATNPPESGSAASSPFSTDSFDASVMSTYGRFPLALERGAGCRVWDTQGKEYLDFVAGIATCTLGHAHPAMVEAVTRQIQKLHHVSNLYYIPEQGELAQWIIQHSCADRVFFCNSGAEANEAAIKLARKYAHTVLDIEKPIILTANASFHGRTLATITATGQAKYQKYFDPLVPGFHYVNYNDISAVEAAISELDEGDYRVAAILIEPLQGEGGVRPGDVEYFQKLRQICDDTGILLMFDEVQVGMGRSGKLWGYEYLGVEPDIFTSAKGLGGGIPIGAMMSKKFCDVFQPGEHASTFGGNPFACGVALAVCQTLERENILQNVQDRGEQLRSGLRAIAAKYPHHLTEVRGWGLINGLELAADIPLTAADVVKAAINEGLLLVPAGPKVVRFVPPLIVTEAEINTALKLLEKALATVTA

SEQ ID NO: 40398 - protein, 409 aa, Vitis vinifera
MDTHSTHPTAPVRSRSSQSPSHSASASASASATSSIHKRKLTSDDHAPPFSADITSNDDLDSISARAGGPGSDSDDDSEEDAVVDDEEDDFDNESMRTFTTARLDNSATASAAVRNTKIKPENSTVKVESSEIGKDGGSSAAAPVGTSSVPAIVVKEDATKIFTENMQTSGTYCAREESLKREEEAGRLKFVCLGNDGVDQHMIWLIGLKNVFARQLPNMPKEYIVRLVMDRSHKSVMVIRRNQVVGGITYRPYVSQKFGEIAFCAITADEQVKGYGTRLMNHLKQYARDIDGLTHFLTYADNNAVGYFIKQGFTKEISLEKDRWQGYIKDYDGGILMECKIDPKLPYTDLSTMIRRQRQVSGDLLLWQFEILGIVLDPDLLHYFLLDTPNVAKQLSFKFLLYIIFITS

SEQ ID NO: 40399 - protein, 189 aa, Vitis vinifera
MSRGKGWIGPLSLVRVTLSIYKSSNMELFQAVPLFKKINPPLEVLRNIQRIIKVEEIPGLKEAGWTPDQYGHSRFRTTRSRKASMTWYNEILKAAKLMHDHPDAWPFKEPVDARDVPDYYDIIKDPMDLKTMSKRVESEQYYITLEMFLTDVRTMFKNARTYNSPDTIYYKCATRHIFHSSSCSLTQYV

SEQ ID NO: 40400 - protein, 328 aa, Parvularcula bermudensis HTCC2503
MTIAVTGATGYLGSHMLLSLHDRGVDAVGVAESGTLPPALLNHVLLSILSSADVQGLATVFETHDVTGVIHFAGNDATPAGSLIDPMAQYDQILTPTLTALRAATLRGIEHFVFSSTASVYGVPQRMPIREETPLSPISPFGAAMGMAERIVADVCRPACIGTAILRYFNVAGADPNARAGETGHPRHLIKAAAQIATGVLNEPLKIYGNDYNTPDGTCIRDYIHVSDMAEAHATALDHLMAGGGSVTLNCGYGRGISVHEVIAAVQRVTGKTLPTQYAARRQGDAPLLIADTAAIRTALSWVPRYDDIDVIIRSAIQWEEQSRVRAA

SEQ ID NO: 40401 - protein, 326 aa, Vitis vinifera
MIWLIELKNLFSRQLPDVPREYIVRLVLDINHKSIMIIRRNQVVGGITYRPYLSQQFVEIAFGAIMADEQIKGCGARLMNHLKQHARNMDGVTHLLTCADNNAVDYFIKQGFKKITLEKERWQGYIKAYDGGILMECELHPKFPYSYLTTMISHQRQAINERIREVSNCEIVYPGIDFQKGDDGVPARPIKLEDIPGLKDAGWTPDQYGHSRQAFKSIYAWPFKEPVDSDNAPGYYDIIKDPMDLKTISKRIESEQYYITLEMFLADVRRMFANARTYNSPHTIYYKCATRQEFSYFNSSFLFLLFFLCIHAQICSVYIYITGSSL

SEQ ID NO: 40402 - protein, 236 aa, Zea mays
AARGGGPDLPVMLTFLEFYETLLGFVNFELYHSINVNYPPILDPRLEALAAELYALSRYMSSGRLPGNPESNGLIEDKETENNKESSKTDESELRLAQLQHQLPANEPGALMHLVEESTADDTEEESVKECRTLFKDLKFYLSREVPRESLLFIIPAFGGTVSWEGEGAPFDETDQDITHQIVDRPTQSHVFLSRHYVQPQWIFDCVNILKVIPTDDYIVGRVPPPHISPFVDNDK

SEQ ID NO: 40403 - protein, 304 aa, Debaryomyces hansenii CBS767
MSSSVFHDYSGFSNATTFGEVYNNFNQIDLLNWMEKLWGSYYYYMGNDLFATGLLFFTLHEAMYFGRCIPWMIIDRIPYFNKYKIQDAKIPSNKEQWECLKSVLTSHFLVEAFPIWFFHPLCQQIGISFEIPFPDISSMLIQLAVFFVCEDAWHYWFHRALHHGVFYKYIHKQHHRYAAPFGLTAEYAHPIEVMLLGFGTVGIPIVWCLITKNLHLFTVCIWITLRLFQAVDSHSGYEFPWSLHHFVPFWAGADHHDEHHHFFIGSYSSSFRWWDFVLDTEAGPKGKSSREQKMKTKAESKKQL

SEQ ID NO: 40404 - protein, 581 aa, Candidatus Kuenenia stuttgartiensis
MTQTTIPEQGIRALLDLDWLRENIRCQHRCPAHMDVPGYIRLISQGKFEESYRLMKETNPFPAVCGYVCPHPCESKCKRGDFDRPVAIDALKRFVTDYVFKNKIKIPAPAVVKKKQKVAIIGAGPAGLTAAFDLAGMGYKVTVFEKEAQVGGMMMWAIPSYRLPRDQIMFDVSHILERGVQIKTNTPIGGKGKSFSDLLEMGYDAVFIAVGAQIGKRLEIAGEEGTDGVMDCLVFLKNVSAGDTRKPGENIVVIGGGNSAVDAARTAKRLSKNVSIVYRRTREEMPALSWEVEEAEHEGVSFHFLAAPVKIVTENGKAKGLECIKMRLGKPDESGRRRPEPIPDSTFIIDTDCVISAISQEPDLKFLGDKHGLKVNKWGTIAVDGNLATSKKGIFAGGDVTLGPSTIIECIAQGHLAANSIDRFINGEPLEEPKKKVWVTLLDSEIDLREENYDATLRQDMRLLPEHEREGNFDLVELGLDEFQAAREANRCLKCDLTINVETNECVLCGRCSMVCPVGALKQVDAFDQSKEHKPFMSKDGIVIKYTDKCIRCGNCKDCPVNVISMKRVLWKPNEDVNKFL

SEQ ID NO: 40405 - protein, 216 aa, Bacteroides fragilis YCH46
MKPIISPSILSADFAYLAKDIEMINRSEADWVHIDIMDGVFVPNISFGFPVLKYVAKLTSKPLDVHLMIVNPEKFIPEVKALGAHIMNVHYEACPHLHRVVQQIREAGMQPAVTINPATPIALLQDIIRDVYMVLVMSVNPGFGGQKFIEHSVEKVKELRELIERTGSKALIEVDGGVNLETGARLIAAGADALVAGNAIFAAENPEGMIHAMKGL

SEQ ID NO: 40406 - protein, 572 aa, Debaryomyces hansenii CBS767
MMIARNLLKGIHKPVNRRVCIPKIGSLTSAKFYSTQSTVQQFPELQEADFTPEGEPDYIKLILTSRVYDVVDEGGSPLTHAVNLSQKCNTNIFLKREDLLPVFSFKLRGAYNMIAHLHSNSKSPVSGVIACSAGNHAQGVAFSASKLKIQSTIVMPTATPSIKYKNVSRLGSQVVLYGDDFDSAKKECDRLSSLNGLTNIPPFNHPYVIAGQGTIALEITRQLRLDKLDALFVPVGGGGLIAGIAVYLKKIAPHVKIIGVETFDADALYQSLQNHQLKTLDQVGVFADGTAVKVLGDETWKLCHKYVDEVVRVLTDELCAAIKDIFEDTRLIVEPSGALSVAGLKRYLSDNSEIDHRNKNYVPILSGANMNFDRLRFVSERAVLGEGKEVSLAVTIPERPGEFAILQNIIDPRAITEFSYRFNNSGPANIFVSFNVTNKDKELAPIVESMKSNDYEVIDISENELAKTHGRYLVGGKSTTANCNKISKERLFRFEFPERPGALTKFLQTLKYDWDITLFHYRNHGHDVGKILCGFVLPEGTSDEDFQDFLKKIGYNFVDETDNVVYKKFLQS

SEQ ID NO: 40407 - protein, 555 aa, Oryza sativa Japonica Group
MATTATLPFSCSSTLQTLTRTIPLRLRLHRRRFLHHLPSLAALPRLPLPRPPLLPHARRHVSASAAPNGASSEGEYDYDLFTIGAGSGGVRASRFASTLYGARAAVCEMPFATVASDDLGGVGGTCVLRGCVPKKLLVYGSKYSHEFEESHGFGWVYETDPKHDWNTLIANKNTELQRLVGIYKNILNNSGVTLIEGRGKIVDPHTVSVDGKLYTARNILIAVGGRPSMPNIPGIEHVIDSDAALDLPSKPEKIAIVGGGYIALEFAGIFNGLKSEVHVFIRQKKVLRGFDEEVRDFIAEQMSLRGITFHTEQSPQAITKSNDGLLSLKTNKETIGGFSHVMFATGRKPNTKNLGLEEVGVKLDKNGAIMVDEYSRTSVDSIWAVGDVTDRVNLTPVALMEGGAFAKTVFGDEPTKPDYRAVPSAVFSQPPIGQVGLTEEQAIEEYGDVDIYTANFRPLRATLSGLPDRIFMKLIVCATTNKVVGVHMCGEDAPEIIQGVAIAVKAGLTKQDFDATIGIHPTSAEEFVTMRNATRKVRRSTTDEVESKDKVVTQN

SEQ ID NO: 40408 - protein, 293 aa, Ashbya gossypii ATCC 10895
MDYSTGQYSDIWSYKYTSSVSKEWSRLAADGVNSRFYVEQFNENIRSIEDVLQGLTTVIQRSDYDTSSSEFSSDAEFAVSNTTQGNTSVGNAQDLLPGSAVEAGTVSQARKYAEAYPMYRRMPAPAGVSGGAAAIVPEGSRFFVIKSFNLENIKASFKHGVWTSTKRGNKRLSKAYVGLPAGARIFLFFSVNKSGKFCGVAEMKSNILQGDSRNKIWQCEAGHQFNDLFLVEWTCVCDVHNRLLKHFNIMDTEGSFKPVTHARDADEVDIEIGRTILKLFTNTKKNRSSFLED

SEQ ID NO: 40409 - protein, 379 aa, uncultured archaeon GZfos10C7
MLSKRLTRIEESATMKMGSIAKKLQAEGKSVLNFSLGEPDFKTPGHICEAAKRALDLGYTHYVSSAGVDELREAIAGKIREENEVDVSAENVIVTPGAKQAIYELMMSVLDDGDEVILLDPAWVTFESAVKLAGGNPKWVKRLEEEVNYESLESAVSENTKLIVINSPNNPAGYVLSEKEQKEIAEFAVDHDLLVLSDEIYEKIIYGRKHVSIASFDGMQARTVIINGFSKTYAMTGWRIGYAVAPAEILKGMLKIQQHSVSCAPSIAQSAALTALSSPQDCVNEMVEQFKRRRDVIVKRLNEIGLRCLNPEGAFYAFVNTSNHGNDVGFTERLLKEAYIVVTPGSAFGVAGKNYVRFSFAASIEDILEGMGRIEKLYG

SEQ ID NO: 40410 - protein, 469 aa, Bacillus clausii KSM-K16
MKLFINGEWVSEELDVFDVVNPATGEVVGSVPKGGAKEAKVAADGAYESLPAWAERSAYERSAILEAWHDLIAEQKEELARLMTMEQGKPINEARGEIAYANSFIKWYAEEGKRIYGETIPASSPDKRLFVVKQPVGVVAAITPWNFPAAMITRKVAPALAAGCTVLIKPASQTPLTALKLAELAEKAGLPKGVLHVVVGSTSDISKAWQEDERVRKLTFTGSTEIGRTLMSEAGQTVKKISLELGGHAPVLVFEDADIDNAVQETIASKFRNGGQTCVCANRIYVHESIAEAFITKMKQAVEQLKVGNGLNEETDIGPLIDEEAVDKVLTHIRDAKDKGAEVLTGGNSSDGLFIEPTVIAGVTDDMACMSEETFGPLAPISTFKTEEEVVKRANDTIYGLAAYLFTTDLSRGIRVAEKLDYGVVGLNDGGPSVAQAPFGGFKQSGIGREGGHEGLEEFLESKYVSLKM

SEQ ID NO: 40411 - protein, 873 aa, Wolbachia endosymbiont of Drosophila ananassae
MGEKLIHYFSQGKCEGNAEMKNLLGGKGANLAEMCNVGIPVPPGFTISTSACKVYYQDNRSSVIQVSDYSDPEKNVVTHWNDICSGIKNYMTMLENDIGCKFGDLNNPLLVSIRSGSVSSMPGMLDTILNVGLNDETVVGLAKKSGERFAYDSYCRFIMMYSNVVLQLDHHLFQDVIDNEQQKSGAKSLADLDVDVLKRIVNDFKKIVYEKTEKHFPQNVEEQLLNSVNAVFASWKNDRAVSYRRIHNIPENLGTAVNVQAMVFGNLNDNSATGVIFTRNPSTGEKKLFGEFLVNAQGEDVVSGVYTPMPIDGEQKNTMEKLLPSVYRELCVVCEKLERHYKDMQDIEFTVQDGKLWILQTRSGKRTAEAAIRIIVDMVNEGTITKEEGILRIDPKTFDNLLHPVLDVKSDQKVIGKGLPASPGVASGYVVFSASDAEKAAEQGKKVILVRSETSPEDINGMNAASGIVTARGGMTSHAAVVTRGMGKPCICSVSGLYIDKDGTFFSVGDTKVNKGEPITINGGTGEVMLGILPTISPELSQEFKTVINWIDEIKTVKVRANADTPKDAKIAKEFGAEGIGLCRTEHMFFASDRIEFIQKLIIADDENERANALIKLEEMQKSDFKEIFSIMEGREVTIRLLDPPLHEFLPNDQSTIEKIAKSLSKSVESVKNKIAQLSEKNPMLGHRGCRLAISHPEIYSMQIRAILSAASELKKEKKIEVEPEIMIPFIMSEKEFILICELAKKESSVISQTQIPASRAGMTSDKAYSIGTMIELPRAALIADKLAKHAEFFSFGTNDLTQTTMGLSRDDSVNFLDSYKKNNIFDNDPFEVLDIEGVGELIKMAIERGKKYHSFQSFYRLSSTYKTKLNFK

SEQ ID NO: 40412 - protein, 193 aa, Glycine max
  misc_feature (158)..(158): Xaa can be any naturally occurring amino acid
ARATVYVASGIGSHFSIHVARSLQKWNLQNPNAVWEKKTELKDGRFSREAIDAVGWKQKLCMVNVKGDAAKEGVVYDVAEDAWKEMPEGMLYGWRGPVAAMEEEVMYVVDEAKGVLRRYVEEQDAWEDILENKRLQGAEQIVAQRGKLCVVSPSSGIXVVHVPAVPPRIVPILLPEEFDPVAVHILPRMPADQ

SEQ ID NO: 40413 - protein, 459 aa, Mycobacterium avium 104
MPQHPSLPAHAIAPAYTGRLFTAPVPALRMPDESMDPDAAYRFIHDELMLDGSSRLNLATFVTTWMDPEAGRLMAETFDKNMIDKDEYPATAAIEQRCVCMVADLFHAEGLNDADPYSACGVSTIGSSEAVMLGGLAMKWRWRAKTKDWKKRTPNLVMGSNVQVVWEKFCRYFDVEPRYLPMEEGRYVITPEQVVDAVDEDTIGVVAILGTTYTGELEPVADICGALDKLAARGGVDVPVHVDAASGGFVVPFLHPELKWDFRLPRVVSINVSGHKYGLTYPGVGFVVWRSKEYLPDELVFRVNYLGGDMPTFTLNFSRPGNQVVGQYYNFLRLGREGYTKVMQTLSGTARWLGEQLRVSEHCELISDGSAIPVVAFRLAKDRGYTEFDVSHELRTYGWQVPAYTMPDNATDVSVLRIVVREGLSADLARALHDDAVSALTSLDKVKPGGHYDAQHFAH

SEQ ID NO: 40414 - protein, 590 aa, Coccidioides immitis RS
MNCPSRTDNPSDNPGWNQSPPLLTADLTTRKDLNGMANMRVRKGKGTGPNGTELNPGQDIPSKSPDEDEPGAHSAGKDAHGSTVGEREVGLEEDVDNRRISSSSWPNFHGYSGGAGSGNLGKFGPRELIHRLVKTLRKFGQFIGPGFLIAVAYIDPGNYATDVAAGASTKYSLLFIIFMSNVIAVFLQSLCIKLGSVTGLNLAENCKAHLPKWLNILLYVLSEAAIIATDIAEVVGSAISLNLLFNIPLVAGCAITLVDVMVILIFYKPHGTMRALRAFEFFVMALVFGVVGCFCVQLSLIKESSVGEIFKGYLPSEAIVKDNGCGILGATVMPHSIFLGSGVVQSRLREYDINRGYIDPSVQYGNTYEDKYRPTVHAIRGCLKYSVLELVLSLFTFALFVNSSILIVAGASLSGSEASDADLFGIHRLLSETISPAAGTVFAIALLLSGISAGIVCTIAGQMVSEGMLNWSVAPWLRRLITRSISIIPSVIIAAAVGKEGLNAALTASQVVLSAMLPFVSAPLIYFTSRSRYMTVEAGLMTGNSNPEGQEVKGVSMKNNWLVTILGVLIWIAITVLNIALLVLVGMGKA

SEQ ID NO: 40415 - protein, 384 aa, Synechococcus elongatus PCC 7942
MLDTVPIDRLRLEHKHPSRPDAMTAGSPRRSLPPALRKVVIGGLFFLATQAIAILGYWLSGWSLLDAIYMVVITIFGVGYGEVRPINTPALRIFTIFVILAGTSSAVYLIGGLAQLVTEGEIRRALGVRRMTREIRTLQRHVIVCGFGRIGQTLARKVTEASLPVIVIDTDETRIRQAEEQGFLALRGSATDEAILIDAGVERAATIATALPDDAANVFITLTARGLNPNLTIIARGELPATEKKLLQAGADRVVLPATIGALRMAHLITHPAALNLLESSDSHQTLNELLGELDIQMDELAIAPQSPLIGHRLGAIEVSGKGAFIIVALRRATGEMILRPGSDLFLHAGDTLIVIGHSGDLPRFAKHYALQRQVQYRGVRQRS

SEQ ID NO: 40416 - protein, 255 aa, Nostoc sp. PCC 7120
MDWKEIRGNWVLVPRNPVGIIHFLGGAFVATAPHLTYRWLLEQLGNKGYVVIATPFVNTLDHIAIANSVLLNFERTIERLHDSGALRKLYLPTYGIGHSMGCKLHLLIGSLFPVERAGNILISFNNYAAKDAIPLVEQFNTTLAIEFTPSPLETNKLVQESYNVRRNLLIKFNNDNLDQSAALTKILQVRFPEMVTAQTLPGTHTTPLGQDVKWQTGSSFTPFDALGQWFKQEVYRDLNQLNRAMLLWLNPLSPP

SEQ ID NO: 40417 - protein, 408 aa, Synechococcus elongatus PCC 7942
MLFAAIAVPIQAPLPAMALLLMTALFLPPLFRALKLPELLGLILAGVLLGPSLFNILEPKADTVVLLAGIGKLYLMFLAGLEIDLSQFQAARDRSLRFGFATFAIPLLVGLLIGLGFGFGWNSAFLIGSLLASHTLLTLPIVEHYGLLRQRAVAATLGATIFTDIGALLVLAVCLAVQSGDGGLIAIVRDLLIFSVFITLVLYGVKPLSRWFFRLAHNNERNQFLFIFLVLLLVSLGAQAIQLDMIIGAFLAGLAVNETLQDEPVREKVDFFGKVMFLPCFFIDIGLLLNPAAFWETLTTAGSLTFAIVGGLFGSKFLAAIAVKQWEGYSWPEVRLMWSLSLPQVAATLAAAQAGLQAQLLSPAVFDSIIALVLITVLVGPLLTDRFAQQICSVPKREGRSAPVPSLD

SEQ ID NO: 40418 - protein, 297 aa, Zea mays
MEDLSVEELASNLSTYKEQLREVKKLIKEKKDDAGISEYIDMEKELQEVITLTEEILATAKQTESAQNVAGLSPPSYSAGVQSEGLDDLSHSHKFAVGTRVQAVWSEDGEWYNATVEALTPNGYYVAYDGWGNSEEVDPDNVRLLEEEAADALGQAEKEAEATKMAIKRKIEQAATSDFQARSLPAKLRIEPSDPEDVKAAKRKKIHAFKSKSRFEQLEFAQNKRQNAWQQFQTKGKAKKVGFFSGRKKESIFKSPDDHRGKVGVTGSGKGLTDFQRREKHLHLKGGSGDAADDDEE

SEQ ID NO: 40419 - protein, 392 aa, Escherichia coli
KITLQNGKLNVPENPIIPYIEGDGFGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVINFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 40420 - protein, 144 aa, Physcomitrella patens subsp. patens
SVRGCIVSPDLSVLNLVIVKQGDNDLPGLTDIEKPRMRGPKRATKIRKLFNLTKEDDVRKYVNTYRRSFVSATGKKRSKAPKIQRLVTPLTLQRKRRRVAIKKARVAKAKTEAAEYQKLLALRIKEQREHRSESLAKKRASRAS

SEQ ID NO: 40421 - protein, 392 aa, Escherichia coli
KITLQNGKLNVPENPIIPYIEGDGFGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGSPSPVKHPELTDMVIFRENSEDIYAGIEWKADSADAEKVINFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 40422 - protein, 599 aa, Ralstonia metallidurans CH34
MRRQRRSHPCPLLSRRQSSGAATLPIPGWLLTYRKEWLAPDVIAGLTAAAVVIPKALAYATIAGLPVEVGLYTVFAPMLIYALLGSSRTLSVSTTTTLAILVAAAFRHVGPSPSAETLITASATLTFLVGAVLLVARLLRLGFVADFISEPVLIGFKAGIGLVIVVDQIPKLLGMHFPKGPFFHNVLAIIQNIPHASVATAAVGILMVLLLLGMEHRFPRAPAPLIAVAVGIIGVWLLNLTAHGVAIVGAVPTGLPPVTLPDPTMMERLWPEALGIALMSFTETIAAGRAFTQVGEHAPAANRELTATGLANLGGAFLGAMAAGGGTTQTAVNRLSGARSQLAGLVTALAALGTMLLLAPLVGRLPEATLAAVVIVYSVSLIKPAEFLAILGIRRTEFIWALVALAGVVALGTLQGIVVAIVVSMLALAYQTSDPPVYKLARKPGTNVFRPQSDAHPHDETVPGLLMLRPEGRVYFVNARRIGHKLRPMILHDKPKVVALDLTAVSDMEYTALHMLTDAERVLREEDGVMLWLVGMNPDVLDMVRRSALGQTLTHERMFFTMDLAAVRFQTEHADAVWGPMTQPGTPPDTPPPESRPPG

SEQ ID NO: 40423 - protein, 355 aa, Arabidopsis thaliana
MMKGISSVSQSINYNPYIEFNRPQLQISTVNPNPAQSRFSRPRSLRVLSLSADPSANRNPKSAVDAHAPPLVVVGSANADIYVEIERLPKEGETISAKTGQTLAGGKGANQAACGAKLMYPTYFVGRLGEDAHGKLIAEALGDDGCGVHLDYVRSVNNEPTGHAVVMLQSDGQNSIIIVGGANMKAWPEIMSDDDLEIVRNAGIVLLQREIPDSINIQVAKAVKKAGVPVILDVGGMDTPIPNELLDSIDILSPNETELSRLTGMPTETFEQISQAVAKCHKLGVKQVLVKLGSKGSALFIQGEKPIQQSIIPAAQVVDTTGAGDTFTAAFAVAMVEGKSHEECLRFAGCNTEHA

SEQ ID NO: 40424 - protein, 488 aa, Oryza sativa Japonica Group
MASGLWFLGISLAVLLLCYVGTNRRGDGQRPPGPRTLPIVGNLLDLRGGNLHHKLASLAHAHGPVMTLKLGLVTTVFISSRDAAWEAFAKHDRRLAARTVPDTRRALAHAERSMVWLPSYDPLWKTLRSIAVTHVFSPRSLGVARSARERKVHDMVDSFRRRAGQEVDIGQVLYHGMFDLLANVLLSVDAHPNLRDLMEDIVAILAKPNASDFFPLLRPLDLQGIRHWTAIHMSRVLHILDSIIDCRLAQGTDDQCKDVLDSLLVLMSTGKLSRRDVKILLFDILAAGTETTKITVEWAMAELLRNPNVMATTRAEMKAALGGNGTITEADVVNLPYLQAAVKESMRLHPVAPLLLPHLVVEDGVRIGGYAVSKGTTVIFNSWAIMRDSTAWERPDDFLPDRFLGKTELDLWGKQAKFIPLGSGRRLCPALPMVELVVPFTVASLLHAFEWHLPKGMSAEEVDVTERYTSNDILVMATPLKAVPLIVT

SEQ ID NO: 40425 - protein, 84 aa, Brassica napus
MASQQEKKQLDERAKKGETVVPGGTGGKSFEAQQHLAEGRSRGGNTRKEQLGSEGYQQMGRQGGHSTRDKTDEEDAEDESSIRT

SEQ ID NO: 40426 - protein, 394 aa, Parvularcula bermudensis HTCC2503
MALFDRLDPRPADPLLGLLAAFRADDRTDKIDLGVGIYKDDAGRTPIMEAVREAETRLAKSGETKAYEGSRGNVAFAEAIEAQILGTERTTPRISFATPGGCGALSLAFFLYHRLNPEGQVWLSDPTWPNHKHIATTAGVPQRTYPYAEPTAPGVDLDRTLDGLAAANPGDAVLLQGPCHNPTGIDLTTDQWAEIGKFVAEKKLIALIDVAYHGFASSLEGDRAGIAAFLDAAPEALISYSCSKNFGLYRDRAGCLIAVSETERAAEAIATHMADISRALWSMPPAHGPAIVAEILGTADLEGQWRRELTEMRERMLDLRRGLATALRPRGNTYDPAVLTAQNGMFSQLPLTKEQTVELREKHALYIPGSGRINVAGLSPAIIDRVAEILSPYL

SEQ ID NO: 40427 - protein, 535 aa, Ralstonia metallidurans CH34
MPTIETKLNARSESFKANAETMQALVADLRQKITKLAEGGGEAARDKHLSRGKLLPRDRVQQLLDPGTPFLELSQLAAYGMYDDAAPGAGIITGIGRVAGQECVIVCNDATVKGGTYYPMTVKKHVRAQEIAEQNNLPCIYLVDSGGANLPNQDEVFPDRDHFGRIFYNQANLSAQGIPQIAVVMGSCTAGGAYVPAMSDESIIVKNQGTIFLGGPPLVKAATGEEVTAEDLGGADVHTRLSGVADYFAQNDHHALSLARNIVQHLNRRKPDQIRLHEPAEPLYPPEELYGVIPTDTRKPYDVREVIARIVDGSEFDEFKARYGTTLVCGFARIWGYPVGIVANNGILFSESALKGSHFIELCCQRKIPLVFLQNITGFMVGRKYENEGIARNGAKMVTAVATAQVPKFTVIIGGSFGAGNYGMCGRAYSPRFLWMWPNARISVMGGEQAASVLATVRRDGIEAKGGEWSPQEEEAFKAPIRDQYELQGHPYYASARLWDDGVIDPAQTRTVLGLGLSASLNAPIGDMKFGVFRM

SEQ ID NO: 40428 - protein, 274 aa, Solanum lycopersicum
MARNGSLEEFLGVAVDAAKRAGEIIRKGFHETKHVVQKGQVDLVTETDKACEDLIFNHLKQHFPSHKFIGEETSAATGDFDLTDEPTWIVDPVDGTTNFVHGFPSVCVSIGLTIGKIPTVGVVYDPIIDELFTGINGKGAYLNGKPIKVSSQSELVKSLLGTEVGTTRDNLTVETTTRRINNLLFKVRSLRMCGSCALDLCWVACGRLELFYLIGYGGGPWDVAGGVVIVKEAGGVLFDPSGSEFDITSQRVAATNPHLKEAFVEALQLSEYVS

SEQ ID NO: 40429 - protein, 265 aa, Solanum lycopersicum
MEEFVECAIEAAKKAGEIIRHGFYKSKHIEHKGVVDLVTETDKACEVLIFNHLKQCFPSHKFIGEETTAAASGNFESTDEPTWIVDPLDGTTNFVHGFPFVCVSIGLTIEKKPVVGVVYNPIIDELFTAIYGRGAFLNGKSIRVSSESQLVKALVATEVGTNRDKAIVDATTGRINRVIFKVRSLRMSGSCALNLCGVACGRLDLFYEIEFGGPWECAAGALIVIEAGGLVLDPSGSEFDLTARRVAATNAHLKDAFINALNESE

SEQ ID NO: 40430 - protein, 340 aa, Physcomitrella patens subsp. patens
MVRARRSVVTCSAASDRMRGTASFERVCDCLVYPSLDQNGRTKGVIHFIGGAFIGAAPDVIYSVLIELLAKEGYLIVATPFSLSFDHTVSAQGIHTRFNTCLDYLSNTGFAGLSAGDISTLPVYSVGHSLGALMQVVIGSTCSGGRLPKASALISFNNKPASDAVPFFDQMGPTLAQVAPIVESSPATEFARAFSCTCLFVIVYYCLLLSFRQFLDQIPAVFDQVSQGVSEFTPTPAQNRAAASLSYAVPNNLLVKFTQDAIDETDVLEEILGPRSEALGGKLTKVVLTGNHLTPVAPDVKWQAGREYTPADAVAQVLRNVALADLRVLSRNIADWFSSL

SEQ ID NO: 40431 - protein, 244 aa, Oryza sativa Japonica Group
MLLLRAARASPAMAAVVRCKPTRLTPIAGLSSSSGGGRRKKAGRRGEAKPPPPPPPQLRGGETKKKKKPDARTAAEAAQGLQRHEVERRKKPPPPPPPPKQEKAKRVVRWKCAAGCGACCKLDKGPDFPSPEEIFAEHPEDLKLYKSMIGADGWCINYDKSTRTCNIYEERPVFCRVEPKVFEEYFGVPSRPSTFDREACSACVDTIKMVYGEESAELTNFKRVIREESKKHEASLNQDKLLDT

SEQ ID NO: 40432 - protein, 290 aa, Zea mays
RSTLKQSVPAPICTASMKEYIARFGHGSAKLARQAQSKEKTLAKMERGGLTEKVVRDRVLVFRFTDVGKLPPPVLQFVEVKFGYTPDNLIYKSLDFGVDLDSRIALVGPNGAGKSTLLKLMTGDLAPLDGMVRRHNHLRIAQYHQHLADKLDLDMSALAYMMKEYPGTEEEKMRAAVGRFGLSGKAQVMPMKNLSDGQRSRVIFAWLAYRQPQLLLLDEPTNHLDIETIDSLAEALNEWDGGLVLVSHDFRLINQVAQEIWVCENQEVTRWEGDIMDFKAHLKSKAGLSD

SEQ ID NO: 40433 - protein, 297 aa, Vitis vinifera
MESPFRGDILKGKVALLTGGGSGIGYEISRQLGKHGASIAIMGRRRQVLDAAVSSLHSLGIPAIGLEGDVRKQEDAVRVLESTIKHFGRLDILVNAAAGNFLVPAEDLSPKGFQTVIDIDSVGTFTMCHEALQYLKKGGPGKSPSTGGIIINISATLHYTATWYQIHVSAAKAAVDSITRSLALEWGTDYDIRVNGIAPGPIDDTAGLSKLAPEDVVRKAKEHEPLFKLGEKWDIAMAAVYLASNAGKYINGTTLTVDGGLWLSKPRHLSKEAVKQLSRAVERRSRKILVGVPKSKL

SEQ ID NO: 40434 - protein, 413 aa, Candidatus Kuenenia stuttgartiensis
MGLIVQKFGGTSVADAERIKAAARRVTETYDAGNKVIVVVSARGQTTDELIELANEIIDKPSTREMDMLLSTGEQVSIALMAMAIHALGYPAISFTGGQVGIVTDSFHTKARIRNINADRIRKELDNGSIVIVAGFQGIDVNENITTLGRGGSDTTAVALASILHADRCDIFTDVDGIYTADPRKVPNARKLNKISYDEILELASLGAQVMHSRSIEFAKKYNVPLYVRSSFNNSEGTLICKEIDDMENIVVSGATVSKNDAKITIRSIPDVPGQAAKIFHEIAKKNINVDMIIQNASVEGRADVTFTVPRSDLKNALETAEKIKKDLWAMEVLYDDKIAKLSVVGIGMRSHCGVAEKMFSILAEEKINIQMISTSEIKISCIIDEAHAERALNAVHKIFGLNLVKNEVAAKV

SEQ ID NO: 40435 - protein, 561 aa, Candidatus Kuenenia stuttgartiensis
MSNQPNKVIYSMNSVSKFYEKKPVLKDISLSYFYGAKIGVLGLNGSGKSSLLRIMAGVDENYNGQVTLSQGYTVGFLEQEPLLDETKTARQIVEEGVQELVDLHNEYNRINEQFAEPMSGDEMNALIERQGAVQEKIDALNAWDLDSRLEMAMDALRCPEGNTPVKILSGGEKRRVALCRLLLKKPDILLLDEPTNHLDAETVAWLEQHLLKYEGTVIAVTHDRYFLDNVAGWILELDRGYGIPWKGNYSSWLDQKQKRLQQEEKQETERQKTLQRELEWIRMSPKGRHAKSKARINSYESLLAQQTEKQIKELEIYIPPGPRLGNLVIEADKVFKSYGDRILIENMTFSLPRGGIVGIIGPNGAGKTTLFRMITGQEKPDNGTIRIGESVKLAYADQSRETLDPNKTIWETISGGNDIIQIGSREVNSRAYVARFNFSGADQQKPVNAISGGERNRVHLACMLKEGANVLLLDEPTNDLDVNTMRALEDALENFSGCAVVISHDRWFLDRIATHILAFEGDSKVIWFEGNYTEYEEERKRRIGSASDQPHRIKYRHLTRA

SEQ ID NO: 40436 - protein, 302 aa, Lactobacillus sakei subsp. sakei 23K
MKKVIVLGSTNVDTILNVQRFPQPGETLAMDGRAVAGGGKGANQAIAAVRSGAQTAFISKVGKEGAADFMIDTFKKDGMNVDHVRCSETAGTGQAYIMVDAHGQNSILIYGGANQDVTVEDVHEAETAIKAADRIVAQFEVPIPAIIEAFKIARANGVQTILNPAPAIKNIPTELLAVTDMIVPNETEAEIITGIKVTDEASMQANAEAMFKLGIKVVIITVGSKGSFYATPTATGFVPAFKVNAVDTTAAGDTFIGALSTKLELDYSNIEAAMTYANKASSIAVQTKGAQNSIPYEKDIQL

SEQ ID NO: 40437 - protein, 362 aa, Glycine max
MNGTTTLSTTPHHCFHSNTPTSFLNTVSPIQFLSFRNHTHNLRVLCFSSNPSQPPPVVVVGSANADIYVEIDRLPREGETLAAKSGQTLAGGKGANQATCSAKLSYPTYFVGQVGNDAYGSLLADALRGGGVRLDNLAVVASAPTGHAVVMLQSNGQNSIIIIGGSNMSGWPSTLPRQHLDLVAQAGIVLLQREIPDAVNVQVAQAARNAGVPVVFDAGGMDGPLPPQLWNFVDILSPNETELARLTGMPTESFEEIAQAALKCHELGVKQVLVKLGEKGSALFVEGEKPIQQPAILAKTVVDTTGAGDTFTAAFAVALVEGKSKKECLRFAAAAACLCVQVKGASPSMPDRKSVLDLLICQ

SEQ ID NO: 40438 - protein, 293 aa, Anabaena variabilis ATCC 29413
MDLYSSIFRCFCIVEAQVNSYMTNTVIITGASQGIGKATALLFARQNYNVVLAARQPDRLEAIATEIRELGQEAIAIPTDVKDATQVNNMIQKAIAHFGQVDVLINNAGIFCLGSVENFSLEDRHQIIDTNLWGYIHTIYAILPYFLQRCAGTIVNVSSIGGLEPIPYHVPYTASKYAITGLTKSLHAELSPKGIHVSGIYPSFISTQLMERAIFRGKDEEIAQARTELVGKAIQMPVLEKPEDVAKAIWSAVKNKRSDVVVGSANFWKAAYQLTPSLIQSLVRRVFGMEERK

SEQ ID NO: 40439 - protein, 229 aa, Lactobacillus sakei subsp. sakei 23K
MAKLVFIRHGQSEWNLSNQFTGWVDVNLSEEGVRQAQNAGALLKKEGILFDQAYTSVLTRAIKTLHYALEGSDQLWIPETKSWRLNERHYGALQGQNKAEAAEKWGDEQVHIWRRSYDTLPPLLDASDEGSAANDRRYAHLDPKAIPGGENLKVTLERVIPFWEDEIAPKLIDGQNIIVAAHGNSLRALTKYIENISDEDIMDVEMATGEPVVYDLDENLNVVSKKKLN

SEQ ID NO: 40440 - protein, 86 aa, Symbiobacterium thermophilum IAM 14863
MPFSIYVGNLPWSTTPEDLRALFEPYGEVENARIITDRETGRSRGFGFVDMADEEAARRAIAELHNYEYGGRPLTVNEAQARQGGM

SEQ ID NO: 40441 - protein, 622 aa, Symbiobacterium thermophilum IAM 14863
MPHHGPTLGSLVLVAILAFVVPLLLNRLKRVRIPIAAGEILAGVLVGKSGLGLVQSDDLLSIFNFLGIGALMFLAGMEIDLAALVGGGARPKGRPAWLARLHHPLALGVALFLLTTYGAWWFAGLLQRRGLVEEPLFLTLIIATCGLSIIMPVLKDRQMLTDPFGQVLFSTAVIADFLPMLGLSVLAAVKVNGSALEALWILALIAAGAAVYLAARWLSRFNLLEGLTGGTAQIGVRAAWALMLVFLALAQTVGVEAILGSFLAGLLLSMLAGSHREEITHKLDALGFGFLIPIFFVMVGVEFDLRALLGDPAALALVPLLLAGTLVVKAVPGVLLAIWHPPRKTLAGMVLLTTQMSVTIAASAVAYTVGAYGASTHAAVVLVAITTAILGPVLFNRILGEPADAPVRRAVVLAGMNRLSLHLGRRLVAQGVPVRAVDEHPERAAEFTAAGIQAVVADPASAEGLRQAGAEDARALVALTSDERSNLAAARLGRGEFGIPRAILFATSPDGLAEARQEGLEAVNPDLAPALLVESLLSSPAATELFTGGDQDVQIQDFLLAGGPLAGTALRDAPLPAGVLVVSVKRGAEKIVPHGHTVLQRGDLLTVVGPPEAWEEMRRLTG

SEQ ID NO: 40442 - protein, 367 aa, Arabidopsis thaliana
MESDSEMVALPLLPTPIESNYRACTIPYRFPSDNPRKATPTEISWIDLFSNSIPSFKERAESDTTVPDAPVRAEKFAKRYAEILEDLKKDPESHGGPPDCILLCRIRELILRELGFRDIFKKVKDEENAKAISLFPEVVRLSDAINDEGKRIENLVRGIFAGNIFDLGSAQLAEVFSKDGMSFLASCQNLVSRPWVIDDLDNFQARWLKKPWKKAVIFVDNSGADIILGILPFAREMLRLGMQVVLAANELPSINDVTYIELAEILSKLNDENGQLMGVDTSNLLIANSGNDLPVIDLARVSQEVAYLSSDADLVILEGMGRGIETNLYAQFKCDSLKIGMVKHPEVAQFLGGRLYDCVIKYNEVQI

SEQ ID NO: 40443 - protein, 841 aa, Cryptococcus neoformans var. neoformans B-3501A
MGNDQSRTSSGDGKQVDEKPPDYYELLQVDEEAGYDEIKRSYRKLALINHPDKNPHRIEEATKLFADLQHAYEVLSDPQERAFYDSHRNAPVAATDDDIFEHVRTGDKATNDPKSKLNRRRQGDPGVTIAQLMRFFDPKIASKMDDTSEGFYSIYRTLFALLASDEALHTTSTTPLSYPSFGNSSTAYAPPPGLTRAQKDSQVWARDFYAVWGEFVTEKKFEWLNKWDAERGDDRMVRRAMEKENKKAREETRKEYNETVRQLVVFIQHRDPRYKAHQTKLAQERAASKSAKTSGASTPAGKPVVDAEAAKRRHEERLRAAAQYEEQDWQKFSSRNSDDEEMEEEEPEEELGDGTGVRLDDGQGGEIFECVACGKTFASEASWINHERSKKHKQAVWRLKKEMRAEAKAMGLTEPQSEEEPGDERAEDADAGEGEIGGETKGVGMTEEEQLAELQALEAEMIDLALEESEDVDYGNKKSKKKGKKNRRDGVIDEVDAATGLSPSRNESQPDASNTPSAAVSDDGVARESDKTSELSKRDKRRAREARKKIEEEERKAAFKEARKAAKKAGASVETFASPRQSDRKDKVDDDGFVAPKQKGKNSIKSGKGTKGGREQGENDYSDERVAKVVAGIQEKREKMVEKWGDTWADLVSKLKHLLSGDSHLPLSILCLGLGKPFSDRTAQIQLALALELADALNCTVHDLEMYDPVWDEGDKKVLSSIGVTLLQDNLLGRHTLETGRPYLLYLPHAPKQLYESILSTNYAPSLCGNKPGRILLGNDLAEYLPGFVRPSQKKEPSGEADGDGEFVKPKKKRRGRGEVKPQIKDGVLSRVGESHSALLR

SEQ ID NO: 40444 - protein, 392 aa, Escherichia coli
KITLQNGKLNVPENPIIPYIEGDGIGVNVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 40445 - protein, 337 aa, Nostoc sp. PCC 7120
MKVRVGINGFGRMGRLALRAAWDWPELEFVHINEIKGGAVAAAHLLKFDSVHGRWTPEVEAEGERVLIDGTPLSFSEYGKPDDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSATAIALIYPELKGKLNGIAVRVPLLNASLTDCVFEVTRPTTVEEINALLKAASEQAPLQGILGYEERPLVSIDYKDDPRSSIIDALSTMVVDETQVKILAWYDNEWGYVNRMVELARKVALSLK

SEQ ID NO: 40446 - protein, 559 aa, Vitis vinifera
MAAATSLSTPRLTFSSPKLQTLYRNFPISLSLNFSSSLSHSKTLTLAPGSLSQRTSSFSPRRCFAVRAESENGAEPRHYDFDLFTIGAGSGGVRASRFAANFGSSVAVCELPFATISSETTGGVGGTCVLRGCVPKKLLVYASKFSHEFDESGGFGWKFEAEPKHDWSTLMANKNAELQRLTGIYKNILKNAGVTLIEGRGKIVDPHTVDVDGKLYTARHILIAVGGRPFIPEIPGSEHAIDSDVALDLPSKPKKIGIVGGGYIALEFAGIFNGLNTDVHVFIRQKKVLRGFDEDVRDFVAEQMSLRGIEFHTEESPQAILKSADGSLSLKTNKGTVEGFSHIMFATGRRPNTKNLGLETVGVKMTKTGAIEVDEFSRTSVPSIWAVGDVTDRINLTPVALMEGGALAKTLFGNEPTKPDYRSVPSAVFSQPPIGQVGLTEEQAIQKYGDIDVYTANFRPLKATLSGLPDRVFMKLIVCAKTNKVLGLHMCGEDSPEIVQGFAVAVRAGLTKADFDATVGIHPTAAEELVTMRTPTRKIRNSSPPEVCVRQNLFIGYLS

SEQ ID NO: 40447 - protein, 392 aa, Escherichia coli
KITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 40448 - protein, 509 aa, Schizosaccharomyces pombe
MSSSAVSPKQWVAGLNSELDIPAVNRRTSIICTIGPKSNNVETLCKLRDAGMNIVRMNFSHGSYEYHQSVIDNARKASATNPLFPLAIALDTKGPEIRTGLTVGGTDYPISSGHEMIFTTDDAYAEKCNDKVMYIDYKNITKVIQPGRIIYVDDGILSFTVIEKVDDKNLKVRVNNNGKISSKKGVNLPKTDVDLPALSEKDKADLRFGVKNGVDMIFASFIRRAEDVIHIREVLGEEGKNIKIICKIENQQGVNNFDSILDVTDGIMVARGDLGIEIPASQVFVAQKMMIAKCNIAGKPVACATQMLESMTYNPRPTRAEVSDVGNAVLDGADLVMLSGETTKGSYPVEAVTYMAETARVAEASIPYGSLYQEMFGLVRRPLECATETTRVAAIGASIESDAKAIVVLSTSGNTARLCSKYRPSIPIVMVTRCPQRARQSHLNRGVYPVIYEKEPLSDWQKDVDARVAYGCQQAYKMNILKKGDKIIVLQGAVGGKGHTSIFRLTVAE

SEQ ID NO: 40449 - protein, 220 aa, Brassica napus
MMISDLPRDMVEEVLCKLPMTSLRRARFTCKRWNNTLSKDWRFTRKYNGEAAKRKEFQVVMILEYKVYLMSVNLHNPSPSIEPIGKLHDAGVDIINVFHCQGLLLCVTKDGTRLVVWNPFTGQTRWIKPRDSYHRCDRYALGYENRNNYPLKVLRFVDDYDRNLKRRVYKFEIFNLNSSPWKVVDFNPDWDYTVFFYRGLVFQGQYFTGFAEKLGCTQAK

SEQ ID NO: 40450 - protein, 87 aa, Vitis vinifera
MVGASSSWSRALVQISPYTFFAIGIAIAIGVFVLGAAWGIYITGSSLIGVSIKAPRITSKNLIRCVLQLSFFFSRWFYGSLMWYYMD

SEQ ID NO: 40451 - protein, 710 aa, Oryza sativa
MDPAPATPRWNLERPYLTGRFHQEAKVAAAAQGAGSKPYSLDSFSRGGGGGGAESVIGSYAVSVQELLVIDDLLSALVGIEGRYISIKRVRGKEGYVVFQIDSSMDLALQELTRRIFPLCEDFVLVYHFVESRSHFKSGLVNHALAAALRAFLLDYQAMVAQLEHQFRLGRLSVQGLWFFCQRMMSSLNALAVLVEKAISNNTSGSATLNLLQSQAKAMAGDSAVRSLLEKMTECASAAYLRMLERWVYEGVIDDPYGEFFIAENKSLQKESLTQDYDAKYWQQRYSLKDGIPSFLTNVAATILTTGKYLNVMRECEYTVQVPLSESSKLMGFGSNHQYLECIKSAYDFASGELLTLMKDKYDLIGKLRSLKRYLLLDQGDFLVHFMDIAREELTKKPEEISVEKLQSLVDIALRSTAAASDPSHEDLTCCVERSSLLKKLSTLKDLDCAYPSDKLVAADVDHPMPLSVTGLETFCLSYKVQWPLSLVISRKALTKYQLIFRLLFHCKHVSRQLCTAWQIQQGFRSVKILGTPVLRSSILCRSMLKFVNSLLHYLTFEVLEPNWHLMHDRLQTARSIDEVIQIHDFFLQKCLKECLLLLPELLVKIEKLKALCLQYATSIQLLIPSIDVAKPENTSKSRMPRSKIKETKNRGQQLKLASENVVMSESILKFEAEFNSELQSLIPTLSNSSQAEPYLTHLGQCIIGVGVDQ

SEQ ID NO: 40452 - protein, 135 aa, Vitis vinifera
MASITASTPTSSLPRVGLRPNGGTVGTSSAILGLPVMAKKGRVTCSMKEKPSVEDGSLKMGMGASLMAAACAATMSSPAMALVDERMSTEGTGLPFGLSNNTLGWILFGVFGLIWALYFVYTATLEEDEESGLSL

SEQ ID NO: 40453 - protein, 138 aa, Clostridium perfringens
HLIPLILQVALGKRDKIMMFGDDYNTKDGTCVRNYIHVSNLASAHSLALERLMNGGESRIYNLGNGTGFTVKEVVEVARKVTGHPIPAEVAPRRAGDPAILIASSDKAIEELNWKPKFNSLETIIETAWNWHKNHPNG

SEQ ID NO: 40454 - protein, 381 aa, Ashbya gossypii ATCC 10895
MSETQGKPIQCTAAVAYAAGEPLRIEKVTVDPPKAHEVRIKIVNSAICHTDAYTLSGSDPEGLFPCILGHEGSGIVESVGEGVTNVKPGDHVVPLYTAECQQCKFCVSGKTNLCGAVRATQGKGVMPDGTSRFRNGKGETLYHFMGCSTFSEYTVVADVSVVAVDQQAPLETVCLLGCGVTTGYGAAVKTADVQEGDTVAVFGAGTVGLSVVQGAKARNASRIIVVDINDAKREWASKFGATDFINPKTDLKEGETIVARLIEMTDGGLDHTFDCTGNTKVMRDALEACHKGWGQSIIIGVAAAGQEISTRPFQLVTGRVWKGSAFGGIKGRSEMGGLVRDYLNGTLKVQEFVTHKRPFEEINSGFEDLHHGDCLRTVLSL

SEQ ID NO: 40455 - protein, 732 aa, Candida albicans SC5314
MNFDQLTDEQKQQLYLQHLQQQQQLQQQQQQLQQQQHQLQQQQQSYHLQQQQAAYQQQNQAQLQQDDSYMDEDTSELINQPPVQLDHGSPIRQQPQMSAFMPSPRFAQSESFDNHLNVDPNNTERFTSMDSMNFQPPASTFTQLGNGSSTNLSEISSGQNSLLSNHSVNNLPTALTSDTSPPVQQHPQFQPQQQQQQQQPQQQQIFQQQQQQQQQQQQPQQSRAVANQSVSTEAANSDMTGSNTKYVYFERKPNLLSKTTQDKAASIKLTLENYYTSSVSHAIERNQRRLELENKIANEDIGSSEERKNRQLQNLGKKESQFLRLKRTKLALEDFHTVKVIGKGAFGEVRLVQKKDTGKIYAMKTLLKSEMFNKDQLAHVKAERDVLAGSDSPWIVALYYSFQDSQYLYLIMEFLPGGDLMTMLIRWEVFTEDITRFYIAECVLAIEAIHKLGFIHRDIKPDNILIDNRGHVKLSDFGLSTGFHKTHDSNYYNKLLEKEPSNTHLQPNQLTSGRNSVMVDAIHLTMSNRQTMQTWRKSRRLMAYSTVGTPDYIAPEIFIHQGYGQECDWWSLGAIMFECLIGWPPFCSENPHDTYRKILNWQESFQIPEDVHLSPEAEDLIKRFLTSAENRIGRYGGAEEIKQHPFFRGVDWDSIRGVQAPFVPRLSSMTDTRHFPTDDLASVPDNPAMSKAMEQRELDAKNGGGRKNPKEDLPFIGYTYSRFDYLTRKNAL

SEQ ID NO: 40456 - protein, 182 aa, Glycine max
  misc_feature (119)..(119): Xaa can be any naturally occurring amino acid
  misc_feature (126)..(126): Xaa can be any naturally occurring amino acid
  misc_feature (148)..(148): Xaa can be any naturally occurring amino acid
  misc_feature (170)..(170): Xaa can be any naturally occurring amino acid
KEKQIASSMISSPAVTTVNRAGAGMVAPFTGLKSMAGFPTRKTNNDITSIASNGGRVQCMQVWPPVGKKKFETLSYLPDLDDAQLAKEVQYLLKKGWIPCLEFKLEHSFMYHEHNKSPXYYYGHYXTMWKLPMFGCTDASQVLKELQXANTTYPNSFIHIIRFDNIHQIXYISFITYKLPSF

SEQ ID NO: 40457 - protein, 481 aa, Hedera helix
STLEKKNLGNITQIIGPVLDVAFPPGKMPNIYNALVVKGRDTVGQQINVTCEVQQLLGNNRVRAVAMSATDGLTRGMEVIDTGAPLSVPVGGTTLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEME

SEQ ID NO: 40458 - protein, 464 aa, Solibacter usitatus Ellin6076
MPYDLIVIGSGPGGYSAAIRAGQYGLKTALIEKQPRLGGTCLLVGCIPTKSLLHTADVWDHFVHAEADGIVAENPRLDFPKVQARKDGIVSKHSKGVEFLLKRAKVERISGYATIKGGGKIEVKTDAGVQTLEARNIIIATGSEARMLPGMQPDPEFILTNIEILNLAAVPKSLIIIGAGAVGVEFASIFKRFGTDVTVIEMLPRIVPVEDEDISKELERVFKKQKIRVETGARAENIQKTGTGVKLTLTTKDGKQEQLEAEKLLVAVGRKPNTDAIGLENTKVQLDRGFIKVDQYQQTGEPGVYAIGDVVAGTPQLAHVATREGMIAVAHMAGKPAVPINKNRIPGATYTTPGIGSVGLTEAQARAQGYQVKVGKFPFAGDSRATILGQHEGFIKVVADEKYGEILGVHIIGPDGFELIAEAVAAMEAEATVDVMMQTIHAHPTLYEAVGEAFNAVYGLSINA

SEQ ID NO: 40459 - protein, 151 aa, Chlamydomonas reinhardtii
HRLETAETAALKYEKRDKKGGPTGWGVFAPENLYQAHLKRAEAGVAAAYSVEDYERAKAADPEFYRGADSLKYGQQPKLPAANVEKMVAELQERDRKKDEFSRRRAHNDGSDVDFINDRNAHFNKKIQRAFGQYTTEIKGNLERGTALPDR

SEQ ID NO: 40460 - protein, 277 aa, Nicotiana tabacum
GAFGIVYKGELSSSNSRTVVAVKKLDKLANDGENEFKTEASVIARTHHKNLVRLVGFCDEGPEKKLLVYEFMSHGSLADFLFSQSRQQWNKRIRIAYGVARGISYLHEECSTQIIHCDIKPQNILLDDSFEARISDFGLAKLLMKGQTRTLTGIRGTRGYVAPEWFRNTAVTAKVDVYSYGIVLLETICCRKCMDIAMENEEEILLIEWVYDCIHSRTLHKLVKDDEEALSDMKQLEKLVKVAIWCIQEDPNVRPSMRRVVHMLEGVVEIPMPPFPN

SEQ ID NO: 40461 - protein, 442 aa, Solibacter usitatus Ellin6076
MTDVVMPQMGESIVEGTLTKWLKKPGERIERDEPLFEISTDKVDTEIPSPAAGTLAEVLVEEGKTVGINTVVARISEGGSADGGAAAAKPVAAPAPPPPAAAAPPAAQAPVAPPPPPVQAAPPPPPAEAESPSGPLSPLVKKMAREMNLDLAQVKGTGAGGRITKQDVEAYVAAGKPAAAPPSPAPAATPVQAAAPAPTPAPAMAPLAPAGQAKTRIEPMSTMRIKIAEHMVMSKRTSPHVTTIHRVDMTKVAKMRERFKAQFQANYGFGLTYLPFITRATVAGLRQYPLLNASLDGNNIIYHNEIHIGIAVALENGLIVPVVRSADEKNVLGLQRSIVDLAARARSRQLKPDEIQGGTFSITNFGSFGSLVGTPVINQPQVAILGVGTVDKTPVVIDDAIAIRSICHLSLSFDHRLIDGALADQFMTKVKQVLENWSEEVL

SEQ ID NO: 40462 - protein, 540 aa, Hordeum brevisubulatum
MGWGLGDPPADYGSIMAVGLFVALMCICIIVGHLLEENRWMNESTTALLLGLGAGTVILFASSGKNSRLMVFSEDLFFIYLLPPIIFNAGFQVKKKQFFRNFMTITLFAVVGTLISFSIISLGAMGLISRLNIGALELGDYLALGAIFSATDSVCTLQVLSQDETPFLYSLVFGEGVVNDATSVVLFNAIQNFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSITLSSIILALVLVARAAFVFPLSYLSNLTKKTAGEKISIRQQVIIWWAGLMRGAVSIALAYNKFAKSGHTQLPSNAIMITSTIIIVLFSTIVFGLLTKPLIRLLIPARHLTREVSALSEPSSPKSFLEQLTVNGPETDVENGVSIRRPTSLRMLLASPTRSVHHYWRKFDNAFMRPVFGGRGFVPFVPGSPTESSVPLLAHGSEN

SEQ ID NO: 40463 - protein, 392 aa, Escherichia coli
KITLQNGKLNVPENPIIPYIEGDGIGVNVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 40464 - protein, 206 aa, Nicotiana tabacum
VRLATRSLQYEARERPNAKSLVNSLMTIQKETEVPSHVLLGIRHGTATPPQPLLLTTTGEACLRMDLTALHEILQETGYKDDEGIANELSFQMWTNQMQETLNSKQQGDAAFRAKDSITAIECYTQFNDGGTMVSPTIYARRCLCYLMSDMAQEALGDAMQAQVISPEWPTAFYLQSVALFSLGMENDAQEALKQATKLEAKRNKN

SEQ ID NO: 40465 - protein, 392 aa, Escherichia coli
KITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 40466 - protein, 276 aa, Triticum aestivum
  misc_feature (209)..(209): Xaa can be any naturally occurring amino acid
  misc_feature (245)..(245): Xaa can be any naturally occurring amino acid
  misc_feature (253)..(253): Xaa can be any naturally occurring amino acid
MASPSVFAGIAQGPEDPILGVTVAYNKDPSPVKVNLGVGAYRTEEGKPLVLNVVRRAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATRGLDFQGLLEDISSAPSGAIVLLHACAHNPTGVDPTLEQWEQIRQLMRXKALLPFFDSAYQGFASGSLDKDAQSSAQCSSADGGXFAQWLKSXSKEHGDLLWEEAWLGFPVWGLLI

SEQ ID NO: 40467 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNEMILVYDYIENGNLRSHLYGPDLPTMSWEQRLEICIGAARGLHYLHTSAVIHRDVKSINILLDENFVAKITDFGISKKGTELDQTHLSTLVQGTIGYLDPEYFIRGQLTEKSDVYSFGVVLFEVLCARPAIVQSLPREMVNLAEWAVDSHNKGHLEQIIDPDLAAKIRPESLRKFGETAVKCLALSSEDRPSMGDVL

SEQ ID NO: 40468 - protein, 176 aa, Triticum aestivum
MADAQNDAPATAPFKAVQVEALVIMKIAKHCSSAFPSVATGAIVGMESEGLLEVTNTFPFPTVDPATTDGHQSDASQLAAAAPRQQKNITYQNEMIRHLKEVNVDANNVGWYTSATMGNFVNMNFVENQFHYQSANENAVALVYDASKSSQGNLTFRAFRLSPAFLSAHQEGKFTT

SEQ ID NO: 40469 - protein, 581 aa, Yarrowia lipolytica CLIB122
MDGSTDAPIHHPTPPAMSWKRHFNGSVIRDELYFPWSARDKARDQQSKDPVYQDAEAAEGLPGTHYDAHVEDVNEDGTPRTVWGKNGKAWPVMTAGAGLFSDGYVNNSMGTVTTVLKRIYGKEYSASRKSQILPAIVFVGTVVGMLVFGYVADYHSRKLGMVISTMILIIFTILCSGSWGAGGKKNMDGMLAALITYRFFMGIGLGGEYPAGSVACAEASAIMGRGTRNRWFILFTNFMIDFGFVCSAFVPCVLWWIFHDRHLQAVWRLTLGLGAIPPLGLFYLRTKFKENPSFMKNNFKRTRFPYWLAIKYYGVRLACVSLIWFIYDWASYSYGLYASSILDNLNPNQSLIKNFGYTTIINLWYLPGSFLGAICADYLGPRLTLIIGVVAQAVVGYIMAGIYTHLSKPENVAGFICMYGVFLALGEFGPGDQIGLIASKTCATPIRGQYYAIAAAIGKIGAFVGTYCFPAIQKSVGHGDPDSVEGQQGPFWVSCSMNILSAVLAYFLLPSITQETIQDEDRLFREYLVGHGFDVTLMGDAEFADGANASSEDQTEFKEGHEPQHSSDEQEHLPSKLEAIQ

SEQ ID NO: 40470 - protein, 187 aa, Klebsiella aerogenes
MILLIDNYDSFTWNLYQYFCELGAEVLVRRNDELTLADIISLAPAKIVISPGPCTPDESGISLAAIRHFSGQTPILGVCLGHQAIAQVFGAAIVRAAKVMHGKTSPVSHTGQGVFLGLNNPLTVTRYHSLLIDPRTLPECFEVTARSEEGEIMGIRHRVFDLEGVQFHPESILSEQGHQLLANFLNR

SEQ ID NO: 40471 - protein, 263 aa, Physcomitrella patens subsp. patens
RYTDIDNDHFEPQMCTTYAADIYEHLRVAEVKRRPKADFMESMQQDINPTMRGILVDWLVEVAEEYKLFPDTLYLAVSFIDRYLSAHVVTRQRLQLLGVACMLIAAKYEEICTPQVEEFCNITDNTYCREEVLEMEREVLNVLKFELTTPTTLTFLRRFTRAAQTSYKAPTLSLEFLGSYLAELTLLEYEFLPFLPSMIAASSVYLAKITLDSSTCPWDATLQHYTGYRPSELEHCVKAIHELQLNTKSCSLPAVREKYRQHK

SEQ ID NO: 40472 - protein, 301 aa, Aspergillus oryzae
MTPETSRTDGGLPDLNHIHDSLIEIAYKAGEIIMGALPTTDGIGSKKNSADLVTQYDRAVEEMIRTALKEKYPDYQFHGEETYDPGHPLTTAPTFVIDPIDGTINFVHGFPHACVSLGFAVDRVPVVGVVYNPFDNTLYSAIRGQGAFLNRSVKLPLKGTDLEPLQGLQNSLIGVEWGSDRKGRNWETKVRTLEKLGQAKDEGGAMVRSMRSMGSAALNLCAVAAGTLDLYWEGGCWAWDVCAGWVILTEAGGIMVDGNPGGWQAVIDGRVYLAVRASPSQIGQRELVEEFWANIQGKLEY

SEQ ID NO: 40473 - protein, 698 aa, Polaromonas sp. JS666
MLKPMAGDPEKHQEAPTRTRVERLFGDWVRQVSPVTLRADAMAGLLGAVLVLPQGIAFATLAGLPPEYGLYTAVIPCIIAALFGSSWHVMSGPTNANSLALFAMLSPLAMAFSPQYIQLALAITVMVGVMQWLIGALRLGVLANFISPATLFGFTSGAALLIAVHALPDLLGLPAAPEHSAAAVLRHVFTQLYLVQPVALAVGAITIGVALLLRRLRRSWPHMLIGLVVATALAWLWSHFLNAGSATPSFALRTVGQIPVPWPRFELPRISWAQATDLVGLAFALTIVALGQAISIAKTVALRSGQRIDANREFRGQGLSNIVGGFFSCYVSCGSMNRSMPNLQAGARTPLASVFSALLLLVLVAVSAPLLALIPMAALAGLLVLVAVALLDFARWRQLFSLSRSDFAVALATMVATVTIRLEIAILLGMILSLMSFLYRTSRPAMRTMGFDSRGLDRQFVVIDSTPDAGLETEMTLPQKADDDSERREGPPQASSAPFPRERGSATPKAREATSVGASERSAGPPQASSAPSGGSVVREATSVGATFLPECPQLKLLRMEGEVYFGATQHVADILHALRHQPQPQKHLLVMGKSMNFIDLAGAELWEAELAARRAMGGDLYFHRPRPEVIRMWRKTGFTRVLGPEHQFPDKFTAIATIFNKLDPAICRRCTARIFWECQSVPGPDTDTDTDTDTHPV

SEQ ID NO: 40474 - protein, 586 aa, Ashbya gossypii ATCC 10895
MVSGLSKKKTTAKQLSKLTINTMSEITLGRYLFERLRQIEVQTIFGLPGDFNLSLLDKIYEVEGMRWAGNANELNAAYAADGYARLKGMSCLITTFGVGELSALNGIAGSYAEHVGVLHVVGVPSISAQAKQLLLHHTLGNGDFTVFHRMSANISGTTAMISDITSAPAEIDRCIRTCYITQRPVYLGLPANMVDLKVPASLLETPIDLNLKPNDPEAEAEVVETVLEMIAAAKNPVILSDACASRHDVKAETMKLIDVTQFPAFVTPMGKGSIYEQHPRFGGVYVGTLSSPEVKEAVESADLVLSVGALLSDFNTGSFSYSYKTKNVVEFHSDHIKIRNATFPGVQMKYVLRKLVDNVAEVIKSYVPVPVPSKPANNEEIDSATPLKQEWLWNQVGKFLREGDVVITETGTSAFGINQTHFPNNTYGISQVLWGSIGFTTGACLGAAFAAEELDPNRRVILFIGDGSLQLTVQEISTMVRWGLKPYLFVLNNDGYTIERLIHGETAQYNDIQPWQHLNLLPTFGAKDYEAVRVSTTGEWDALTQDKAFNENSKIRMIEVMLPVMDAPSNLVKQAELTAATNAKQE

SEQ ID NO: 40475 - protein, 840 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSAARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQERSVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGEILLP

SEQ ID NO: 40476 - protein, 653 aa, Yarrowia lipolytica CLIB122
MKFQVVTAALALAGLCSAQLAPIGKNDKYYNFTATWVNANPDGVHERRVIGINDQWPIPTINVTKGDRVIVDLYNDLGTQNVSLHWHGLFMEGQNAQDGPVWITQCPQSPEDSSFAFRYNFTVEQAGTYWYHSHVGGQYPDGLRGVFIVNDPEDPYKDEYDEHIWFTVSDWYHEEIPDLLPDFLSVYNPTGAEPIPSNILFNDTLNTTIKVEPGKTYKLSIINIGAFVSQYVEIMNHTMEVIEIDGVYTEKSDPIDLLYITSAQRYSVLLKTKDDASTNFPIMTTIDGTMLDLTPEDLVLYQTNWLQYNDDPNDRPEGPENYYWHTDKEGDGADDEFEERRFDDMDLVPLDGMKLLPDPDMTITVNVTMNNLNNGINYAFFNELTWVAPKVPVLYTVMSSPDGMETDATIYGDNTHTYVLKHNDVIDIVLNNEDAGTHPFHMHGRVFQVPYRSEAYEDDDMTPFDPEDEDIKFAEVPMRRDTVYVKPNGNMVMRFRADNPGVWFFHCHIEWHMEQGLAFTLVEAPEELKKQYVPPNHFDACKIAEVPTVGNAAGNDTDFLNLSGQNLQEKDLPAGFTARGIVALVFSCIAAFLGMGAVAWYGASDIKNQEIRMIQEFEREAGEEVDGAESLQDVQDEPVHIPHPHLHHNNATN

SEQ ID NO: 40477 - protein, 103 aa, Ashbya gossypii ATCC 10895
MVSEIKSLSEFESAVGSDKLVVVDFYATWCGPCKMIAPMIEKFATQFQEASFYKVDVDAAAEVAHKYQITSMPTILFFKNGQAVDKVVGADVQSIRTKIAQHL

SEQ ID NO: 40478 - protein, 341 aa, Schizosaccharomyces pombe 972h-
MSQTTTETIIPLDSSVKDKLDPEYVNFYNKYVCSNLPIVKTHTYPVDFLRNNGNVMPGQSELLPVESTEDITIPRKHTKAPSGVPSRIFRPHGTAPEGGWPCFLWFHGGGWVLGNINTENSFATHMCEQAKCVVVNVDYRLAPEDPFPACIDDGWEALLYCYENADTLGINPNKIAVGGSSAGGNIAAVLSHKVAASPANFPPLVLQLLVVPVCDNTANAKTHKSWELFENTPQLPAAKMMWYRRHYLPNEKDWSNPEASPFFYPDSSFKNVCPALICAAGCDVLSSEAIAYNEKLTKAGVESTIKIYEGCPHPVMAMDAVLEKGRILNKDATNALLAAFA

SEQ ID NO: 40479 - protein, 783 aa, Neurospora crassa
MAHGDAAPEAHSEAAQQQAQDDSRSTSSSSTPPPVDNEESDFFLAANDSQSSLGVPNIENMQVADEECRVAPINRLPNELLIAIFVKLTTSSDILHVMLTCKSWARNAVEILWHRPACSSWERHTIICQTLSAPRPYFAYRHFIRRLNLSALAPELNDGSVESLEMCSRVERLTMTGCKRITDAGLLKLLRNNTGLLALDISGMEDITETSINAVAEKCSRLQGLNISNCTKISIASLVQLAQSCRFIKRLKLNECAQVTDEAVIAFAENCPNILEIDLHQCRLIGNDPVTALMSKGKALRELRLASCDLIDDSAFLSLPPNKTYEQLRILDLTSCSRLTDRAVEKIIDVAPRLRNLVLAKCRNITDAAVFAIARLGKNLHYVHLGHCGNITDEAVKRLVQCCNRIRYIDLGCCVHLTDDSVVRLATLPKLKRIGLVKCSNITDESVYALARANQRRPRRDADGNLVPGDCYNNMHHSSLERVHLSYCTNLTLRSVLRLLNACPRLTHLSVTGVQAFLREDLESFCREAPAEFTEHQRAVFCVFSGQGVTNLRRYLNSEHNLTEIARGARPIDEGVPNRVGPVFPGTAVNPMQVTPPGHHGAAAAFIDDGEPDAVDDDDGLEDGSEMVIDTQPMLHNHHAVMGGTAFPIQGVASTEQLLPPPPPAIQPQQHLVTNPFHFVPGQPFAIPPHGLQFYEAVRATESGAVSGTPTHVPLVGQATGLESTIAEGSHHSGVARNSPGTATSQNPDASQAVPPNPMGNIELAILTGNRNPDLGGSGGASV

SEQ ID NO: 40480 - protein, 334 aa, Anabaena variabilis ATCC 29413
MSDQANQGDLEIRPSPLLTVINDLHSKYKSLKEGIVANYIPELAKVNPDLFSISIVTVDGQVYQVGDYQQLFTIQSISKVFAYGLALEDHGRDYVLTRVGVEPTGEAFNSIILDEQSKRPYNPMVNAGAIATTSLIKGAGATERLNRVLEMFRRYIGHDVFVDISVFTSERSTGHRNRAMAHLMLNFGMIDRNLEEALDLYFQQCAVMVNCHDLAVMAATLANRGVNPVTGEQAVNSRYIKDILSVMYTCGMYNFAGEWAYKVGIPAKSGVCGGIMAVVPNQMGIAVFSPPLDIRGNSVRGVKVCEELSQQLGLHLFECVKVENGKWGVGNCEC

SEQ ID NO: 40481 - protein, 255 aa, Escherichia coli O157:H7 EDL933
MFNSDNLRLDGKCAIITGAGAGIGKEIAITFATAGASVVVSDINADAANHVVDEIQQLGGQAFACRCDITSEQELSALADFAISKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 40482 - protein, 568 aa, Medicago truncatula
MTLSPISLSFSSPTTISGPHHCSLFNTTTTATSLTLRFCSLRREAFAFTSLSHRSPRNHHLRLTHLNAISAAISNNGTPPKSFDYDLLIIGAGVGGHGAALHAVEKGLKTAIVEGDVVGGTCVNRGCVPSKALLAVSGRMRDLRNDHHLKSLGIQVSNAGYDRQAVADHANNLASKIRGNLTNSMKALGVDILTGFGTILGPQKVKIGSSNNVVTAKDIIIATGSVPFVPKGIEVDGKTVITSDHALKLETVPDWIAIVGSGYIGLEFSDVYTALGSEVTFVEALDQLMPGFDPEISKLAQRVLINPRNIDYHTGVFASKITPARDGKPVMIELIDAKTKEQKETLEVDAALIATGRAPFTQGLGLENIDVATQRGFVPVDERMRVIDANGNLVPHLYCIGDANGKMMLAHAASAQGISVVEQVTGRDHVLNHLSIPAACFTHPEISMVGLTEPQAREKGEKEGFDVSIAKTSFKANTKALAENEGEGLAKLIYRPDNGEILGVHIFGLHAADLIHEASNAIALGTHIQDIKFAVHAHPTLSEVLDELFKSAKVKAQASDPVKEPVSV

SEQ ID NO: 40483 - protein, 634 aa, Propionibacterium acnes KPA171202
MTAVGPKMPRMALLDDIGCPDDVRKLTTKQAEDLAEEIRAFLIDKVSRTGGHLGPNLGVVELTIALHRVFDSPHDPIIFDTGHQSYVHKILTGRANGFEKLRQRGGLSGYPSRAESVHDWVENSHASASLSWAEGMAKGFLSQGEDRTVVAVIGDGALTGGMAWEALNSIADQQGLRLVIVVNDNGRSYTPTVGGLANQLAIIRTDPHYEEALDRMKRHVTDKPLGKQVFGLMHAAKAGVKDALIGNGIFSDLGIKYLGPVDGHDVLSVERALELAKRYGHPVIVHVMTTKGKGFAAAEANEEDHFHAVGRIDPVTGASLKASGGASWTQAFAGAMVELGERRPDIVGVTAAMLHPVGLAPFAARHPDRVLDVGIAEQHAVTSAAGMAAAGLHPVVALYSTFLNRAFDQLLMDAGLHHAGVTIVLDRAGITGTDGASHNGMWDMAMCGIVPGLMLSAPRDRQHLVSVLNEAVDIDDRPTVIRYSKDPIPDDIRIVTSHDGLDVLCDGPEDGILLVAHGQLCAEALAAVDQLDSPVRVVSPRWSLPVCGGLIEEAARARAVVSVEDGLVVSGLGSHLADALSQRGMWRPIRSLGIPQRYLDHDSRSAIMAELGLDSRGIADAVSQLVAQLDGEYS

SEQ ID NO: 40484 - protein, 1028 aa, Cryptococcus neoformans var. neoformans B-3501A
MRFSSRDEEPEDGEVVEDDAVWKNPLATTKYLKGAPSVSSSQKTSSYKKSRPSFIPSLDPADDDGHRPRRPPPPSLSSPPYQQSRHRSSSHNRKTISYEDEERGSGMQHALPKNPQTRLYPHSTEMREPEQRREDKYAKEPRSPHRREGYYSSRRGDGRDYPPQLDRERYGPARRLESGGDGGYGDRSRDRNMDRGGYRDKDDRRSYGRPSDSSAWGRPPREEYRDRRPEEFARHPTGERYREDSRERFPVDRDTGQRRSCSPVRIRSPERSSDRPLTPVPDNGRTSSPDHGAKNIASSRGHRSSPSHSSNHEDHNGEKGNGPIKLNRNRHRPSLPLKHISTQPPRSPSAPPPPPPPDPSTVPPSPTEPPPPMPGNLSLEQTVPHAPNPRAQMATRPPSPKREEGEIRQETESVVFKFKLWTAEEELKALGKNFGGSSTLMRYNMGTKLGEGTFGVVTKAVENDTKRAVALKKITQHNFRDGAHITTLREIKILKSLQHPNVVPLLNMVISRHDNHSENTFIKNEVFMVFPYMDHDLCGLLSNNDFKVNHSGAKCIMKQLLDGMAYIHSNNIIHRDIKTANILVDKHGQIMIADFGLARPWTDNKKMPPHLATEYTNMVVTRWYRAPELLLGWCNYGPAVDIWSIGCVLGEMYLRRPILPGGGDREQLSMIFAKCGPLNEETWSGWQDLPGFPEAHGFAWDKTPRDTSILEESKSWHMDRGGADLLVKLLSLDPSKRPTASEALDHPWFWVSPKPAETINLDFAASHEMSAWHKQPAAAPVQPPPQKAYQTQQAYQSQQTHHAQQIYQPQQPYVAYQSGYGNQQRGHGGYQQQTANATRHNLAMNPYASSQVGNAQGYNQQPYMQAQGVSNMPPGADAYGGINPYGAPVAYNTASLPPPNMAYNGQSSFNGGGGLTGGGGQQYSLPHQPYLPSGPPPMMHGNVNRPSRPPPPTSSEGRPLAAAPFPLAGGGGGGMKTFAPPPPFSLAGGGGGGRGGMPPTMKRPPSDSRRDFGGDHKRQRTEAPLPYD

SEQ ID NO: 40485 - protein, 148 aa, Propionibacterium acnes KPA171202
MDHEHTATYDLQPHLVLTPEQWHERLSDEEYYVLREAGTEAPFVGEYTDTTTEGVYRCRACGAELFRSTQKFHSSCGWPSFYAPLAEDRVRYLNDESLPGRPRTEVRCAQCDSHLGHVFAGEGFDTPTDLRYCINSICLDLVPTDETT

SEQ ID NO: 40486 - protein, 711 aa, Thermoanaerobacter tengcongensis MB4
MGAYLTLIYGVIVIAALVIIGLIKFIFAQDKGNEKMQQISDAIKEGAMAFLNRQYKTIASLALIVAVIIVVANYYGHLSEGSSQALSFALHVGFAFITGAFCSALSGYIGMYMAVNSNIRAAAGARSGLNRALQIALKGGAVTGLAVTALSLFGVATLFLAYGGLSGQDELIKEAPSLIVGFGFGASFVALFAQLGGGIYTKAADVGADLVGKVEAGIPEDDPRNPAVIADLVGDNVGDCAGRGADLFESTAAENIGAMILGVGLYPIFGWKGILFPLVARAIGIIASIIGIFFVNTKDESKDPMIALNKGYFVTTVVNLIALFFAVKVMLSGHLPDGRPVNYLLLYGAVVTGVILSYIFVFLTDYYTSVNKRPVQEIAKASTTGAATNIITGTSVGMESTALPVIFISAAIYIAYKLGEMAIPHIGTAGLYGTAIATMGMLSTTAYILAMDTFGPITDNAGGITEMSGAPEEIRRVTDRLDACGNTTKALTKGYAIGSAALATFLLFSAYLDEVKKILGKPIDSWFPVDIGKPEVFIGAFIGAMIVYLFSSTAIRAVGKAAQYVILEVRRQFREIPGIMEGTAKPDYARAVDIVTKGALKEMVIPGLIVVVTPILVGVILGKEAAAAFLMIGTISGVILALYLNNGGGAWDNAKKFIELGNYGGKGSDAHKASVVGDTVGDPFKDTAGPSLHVLIKLISTITLVFVALFR

SEQ ID NO: 40487 - protein, 259 aa, Tulipa gesneriana
MPISRIAIGSPQEATQAGALKAALAEFISTLIFVYAGQGSGIAFGKLSVDGVTTPAGLVAAAIAHAFALFVAVSVGANISGGHVNPAVTFGAFLGGNITLLRGVLYIIAQLLGSSVACLLLRFTTGLGTGHFGLVAGVSIWSGLVMEIVMTCGLVYTVYATAVDPKKGDIGTIAPIAIGFIVGANILVGGAFTGASMNPARSRSGRALVSWSWTSHWVYWVGPLIGGGIAGIVYDLFFINSTHEPAPKHRLLIGGWRRR

SEQ ID NO: 40488 - protein, 392 aa, Escherichia coli
KITLQNGKLNVPENPIIPYIEGDGFGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 40489 - protein, 51 aa, Populus x canadensis
ASTVDPSLGKSWVSPSDGYAIVPDESGQAVSDGGNGNDASVPESDVKRIRI

SEQ ID NO: 40490 - protein, 531 aa, Yarrowia lipolytica CLIB122
MPQIFFNKVYPGEMALPGRTKTAEELEALEAEKNDPQMQRPMFGKNGRAWPVITAGAGLFSDGYVNNSMGTVNTCLSILYGDYYSKSTYSRTVSSIVFAGTVLGMIVFGFVADYHSRKMGMIASTLILIVFTILCSAAWGAGGKDDIGGMLSALIAYRFLVGIGIGGEYPAGSVACSEASALMGNGTRNRWFIFFTGFMIDFGFVVAAFVPLILLWICGDDNLTPVWRITIGLGAIPPLSLFYFRTRFKEPDTFRKNNFKRTRPPYILALRYYGPRLVVICIVWMLYNFISFPFGIYGSQIINLLVKDGDLYKTFGWNVLLTAFYLPGAFLGAIFSDWFGPRITLAGALILQGIVGFIMAGVYESMIKNIAGFVIAYGIFQALGEMGPGGNIGLLASKNSPTAIRGVFYCIASSMGKIGAFIGTQCFPLIIKGFEKGGDEIKGVQGPFWISSALCIFSALITFFFLPPVTQTSVQDEDRKFFEYIRAHGFDVSKMGDEGFEPESEESMETELYEQKGSNEELYVNTHEVKN

SEQ ID NO: 40491 - protein, 433 aa, Staphylococcus epidermidis RP62A
MAFEFRLPDIGEGIHEGEIVKWFIKAGDTIEEDDVLAEVQNDKSVVEIPSPVSGTVEEVLVDEGTVAVVGDVIVKIDAPDAEEMQFKGHGDDEDSKKEEKEQESPVQEEASSTQSQEKTEVDESKTVKAMPSVRKYARENGVNIKAVNGSGKNGRITKEDIDAYLNGGSSEEGSNTSAASESTSSDVVNASATQALPEGDFPETTEKIPAMRKAIAKAMVNSKHTAPHVTLMDEIDVQELWDHRKKFKEIAAEQGTKLTFLPYVVKALVSALKKYPALNTSFNEEAGEVVHKHYWNIGIAADTDKGLLVPVVKHADRKSIFEISDEINELAVKARDGKLTSEEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 40492 - protein, 392 aa, Escherichia coli
KITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGSKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 40493 - protein, 142 aa, Dehalococcoides ethenogenes 195
MERTLLLVKPDGVNRGLSGEILGRMEKLGLKMIGLRMLQMDAVLADKHYAPHRERPFFKDLVTYITSGPIVAAVFEGENAVEKMRKAMGATDPAKSEKGTVRGDLGINIEQNTVHGSDSAENAKHEISLFFSESELVNYDRR

SEQ ID NO: 40494 - protein, 624 aa, Mycoplasma gallisepticum R
MSKNSYKRLLFLVHLIKKTKQNHMINFYQKYRPTNLSSIIGQSHITNILLKASAHDQLATAYIFQGSRGIGKTSISKILAKAYNCLNKKDGDVCNQCSACELINENKSQDIYELDAATNNGVDEIRKIIDAINYAPMNLSKKVYILDEAHMLSNGAWNALLKTLEEPPKHVVFIFATTEFHKIPLTVVSRCQSFNFKKLDKDDLVDVLKNVVKQEKIKIEDSAIDKIADFASGSARDGLSILQQLAYDKNKKITVEKINETFGLINLEIKLEFLELINQHDLEKFVKLLNEIEAKGTNFVLFIQDLLAILIDLLVYQKVKSSSLLKVLDEEQVKAINLKNIKLLSLSEKINGLLSTRVSQTNIKESLLLAVFDYLEQNPQPVVGNNVEVVIKPKTKTTEQIQEKEEAKPQVEIKQKNENEKVVKVEQPNEQLKAKKVRSLPSEETESSTKSTTNDQLDLSLDPTKAKDYLKAIIFSVWKNSKLINKELQKNFLNAQEKFKKGDNKEDSFYENVDLYLTGSKVLTVTDKAAIVLLEDENVAELLNEQNYNNSKVHTINHIFDKEIYVFAVTKEVMKPIFEQTQKIKDLDIINYYNDLYQSLDVDKLRAIKKQKTQAEILSELLDK

SEQ ID NO: 40495 - protein, 231 aa, Oryza sativa Japonica Group
MADEVAFETARKIIMHPLYTPRSSPWLDLKVFYVRVSNCEVDESAPDRLTLNHIPLSPDTVIEVNGQRSSMHTEFISSSLRRDRVDKMTEEATFVSTDSIRMTGSVRFQVFDKNDLLLTGDLELCSANGVVGESKNSSKRWNMKCQPASSCNGFLKGKPSTASESVHPVIEVYLAGTFCGTPIILTKTVQHISRRKSQMKLKLDSIPENEATEQQKEELNEDSLQVPAKHV

SEQ ID NO: 40496 - protein, 178 aa, Glycine max
  misc_feature (62)..(62): Xaa can be any naturally occurring amino acid
  misc_feature (75)..(75): Xaa can be any naturally occurring amino acid
  misc_feature (122)..(122): Xaa can be any naturally occurring amino acid
  misc_feature (125)..(125): Xaa can be any naturally occurring amino acid
MASSMISSPAVTTVNRAGADMVAPFTDLKSMAGFPDQKTNNDITSIASNGGRVQCMQVWPPXGKKKFETLSYLPXLNNTQLAKEVEYLLRKGWIPCLKFKLKHGFIYQEHNKSPKYYNGHYXTMXKLPMFDCTDASQVLKELQEAKTAYPNNFIHIIKFHNIHQMQYISFITYEPPSF

SEQ ID NO: 40497 - protein, 448 aa, Schizosaccharomyces pombe 972h-
MSSHVSNNSILDPVTFWNQANKSLIRYGGDFAPKIIVRAKGCCVYDEQDNAILDFTSGQMSAILGHSHPDITACIEKNLPKLVHLFSGFLSPPVVQLATELSDLLPDGLDKTLFLSTGGEANEAALRMAKVYTNKYECVAFSSSWHGVTGGAASLTFAAARRGYGPALPGSYTIPEPNPKLSPFRDAKGNYDWQKELDYSFYMLDKQSTGSLACMIVETILSTGGIIELPQGYLKALKKKCEERGMLLIIDEAQTGIGRTGSMFSFEHHGIVPDILTLSKSLGAGTALAAVITSEEIEKVCYDNGFVFYTTHASDPLPAAIGSTVLKVVKRDNLVEKAKISGELLRSDLLRLKDKHPLIVDVRGLGLLQGIEIASCTDPSKPSDFLGTVIGDKCLELGMNCNIVHLRGIGGVFRIAPPLTVTDEEIHKAIEIFDSALTFTAKEFSGSY

SEQ ID NO: 40498 - protein, 270 aa, Schizosaccharomyces pombe 972h-
MTVQTAERTITLVQAIWPKLRKEAEKQCEVNPWLAKDLARKILSKKTLRESLSCVLALPLDHVTGSSESMENWFYSILGLNDEKIIRSAMIDLDRLYTTNPACPDLISAFLSFRGFHALQLYRIAHGLWSEGDKTSAVLVQNWTAVAYGVDIHPAASIGDGLFLDHALGIVIGETAIVEDGVSIWHNVTLGSTFKDSGARHPVIRKNAMLCTGATVLGRVEVGENAVVAAGALVTKDVAPNRLALGSPARDVGPVPQYFGALTNPNCTNK

SEQ ID NO: 40499 - protein, 448 aa, Yarrowia lipolytica CLIB122
MFKNIARLASMARSAPRTTASFQTRFMATTASGTASASATPATFTLQNGPVFTGRSFGANRVVSGEAVFSTGMVGYPESMTDPSYRGQILVFTQPLIGNYGVPSGKETDPFGLIKYFESPHIQCIGIVVADAALKYSHWTAVESLGEWCKREGVAAISGVDTRAIVTYLREQGSSLGRITVGEEYDAEEDAAFVDPGEINLVRRVSTKQPFHVSAAADVENPLHIAVIDCGVKENILRSLVSRGASITVFPYEYPINDIAHHFDGIFISNGPGDPTHCQQTVLNLRDIMYEKPELSELPIFGICLGHQLLALAAGAKTVKLKYGNRAHNIPALDLTTGQCHITSQNHGYAVDVNTLPAEFKPYFINLNDQSNEGMIHTEKPIFSTQFHPEAKGGPLDTSILFDKYLGQVHQYRAARKSGVDTRPNKLLVDLLPKQRIGVEIDAWDYVQ

SEQ ID NO: 40500 - protein, 580 aa, Schizosaccharomyces pombe 972h-
MNNYGVSSIGTSLTPSPTGSIDEYTSKEVKHPEDVKVDASYEKEEVGYGELEVVPERGNLFQRWYRSFLPPEDGKPQKLKRTLTARHIQMIGIGGAIGTGVWVGSKNTLREGGAASVLICYSLVGSMVLMTVYSLGELAVAFPINGSFHTYGTRFIHPSWGFTLGWNYLASFLATYPLELITASICLQFWININSGIWITVFIALLCFVNMFGVRGYGEVEFFVSSLKVMAMVGFIICGIVIDCGGVRTDHRGYIGATIFRKNAFIHGFHGFCSVFSTAAFSYAGTEYIGIAASETKNPAKAFPKAVKQVFIRVSLFYILALFVVSLLISGRDERLTTLSATAASPFILALMDAKIRGLPHVLNAVILISVLTAANGITYTGSRTLHSMAEQGHAPKWFKYVDREGRPLLAMAFVLCFGALGYICESAQSDTVFDWLLSISNLATLFVWLSINVSYIIYRLAFKKQGKSYDEVGYHSPFGIYGACYGAFIIILVFITEFYVSIFPIGASPDAGAFFQSYLCFPVVVIVFIAHALITRQKFRKLSEIDLDTGFSKYDRLEESDKGPMTAKSLAKSVLSFCV

SEQ ID NO: 40501 - protein, 458 aa, Escherichia coli CFT073
MMESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 40502 - protein, 558 aa, Pseudomonas sp. SE83
MNAPVPVPRVADFTCEKKPASGSRGMVVTNHPLASAAGAQILLAGGNAIDAAVASLFALTVAEPMMVGILGGGLSHIRLADGRHVVIDNLSTAPGKATAEMYECLSDEIGKQRDTRDRQNVVGAKAVAVPGALKGWCEALARFGTLPLAEVLQPAIGLAERGFVVTPYLSNCITDNAGDLARDPGLAAMLLPGGKPLQPGMRLVQSDYAASLKLIAAEGPDALYGGKLGRALTDYMAANGGLIDQADLANYRIELREPIRGSYRGYEIIGPPPPSSSGVHITQMLNILEGYDIGSLGFGSTDAVHLLAEALKIAFADRAVATADPAFVKVPVARLIDKAYADERRALIEMEQAKSWTAGLSGGESADTTHVTVADAMGNVVSATQTINGLFGACVQIPGTGMIANNYMYNFDPHPGRALSIAPGKRVFTSMAPMMALKEGRIAFALGLPGALRIFPSALQAIVNLIDHRMSLQEAVEAPRVWTEGGVLELEEAIPEAVAQALIARGHKVVRSPRVAGGMNAIAFNPDGTLTGAACWRADGTPVAISGGLARAGARFTI

SEQ ID NO: 40503 - protein, 338 aa, Schizosaccharomyces pombe 972h-
MGLEQFKKYPLTFGPTPITSMKRLSKTLGGKVEIFAKREDCNSGLAFGGNKIRKLEYLIPEAIDGGYDTLVSIGGIQSNQTRQVAAVAAHLGLDCVLIQEDWVDYKDTMYDRVGNIELSRIVNADVRLDSSKFDIGIRPSFKNALEELTKKGKKPFPIPAGCSEHPYGGLGFVGCVEEIYEQEKQLGFKFDKIVVCTVTGSSFAGIIVGMALTGRQKDVIGIDASATPEKTKAQVLRIAQNTAKLIGLEKELTESDVNIDTRFAHPAYGIPNEGTIEAIKLCGATEGVLTDPVYEGKSMQGLIHLVRNNEIAEGSKVLYIHLGGAPALSAYSAYFKNT

SEQ ID NO: 40504 - protein, 264 aa, Anabaena variabilis ATCC 29413
MSSTLHRRQLLKLLGMSVLGTSFSSCVTSPARATTVNWGYIGKVGPEHWGELSPDFALCQIGRKQTPIDLQIADVKDVHSSSQDLLVVNYQPTALHLINNGKTVQVNYPPGSYLKYAHQKFELLQFHFHHFSEHRVDGKLYDMELHLVHRSKSGDLAVMGIFLQAGAFNPTLQIIWDAIPQKQGTEKQIADINIDVSQFLPAQRRFFTYSGSLTTPPCSENVLWCVMATPIEASPAQIAQFSQTFPQNARPVQPLNDRLVIEAI

SEQ ID NO: 40505 - protein, 390 aa, Bacillus clausii KSM-K16
MAMDIQQAKMMEQLPSQFFAKLVNKAQRLAQEHNDLINLGQGNHDQPTPAFIVEALREASSEPQFHRYGPFRGYPFLKEAIAAYYKQQYGVELDPETEVAIVPGTKTAIVELCQCLLNKGDMALVPDPGYPDYLSGIAITGAIAKPMPLLRNNRFLPDYHELSSDVLDKAKMMFLNYPNNPTGATADARFFADTVAVARSHCIPVIHDFAYGAIGFNGTPRSFLQQEGAKDVGVELFTMSKLYNMAGWRVGFVLGNKEIVAMLEELQDHYHCSLFGGLQAASACALQSDQSSVHELVGLYKERSEALWEAAQEIGWQVEQPSGSFFAWFPVPKGYTSEEFSELLLDKAHLVVAPGNGFGQYGEGYVRIGLLADKTTLREAIARVGNLNLF

SEQ ID NO: 40506 - protein, 329 aa, Bacillus subtilis
GGGGGGMADLFSTVQEKVAGKDVKIVFPEGLDERILEAVSKLAGNKVLNPIVIGNENEIQAKAKELNLTLGGVKIYDPHTYEGMEDLVQAFVERRKGKATEEQARKALLDENYFGTMLVYKGLADGLVSGAAHSTADTVRPALQIIKTKEGVKKTSGVFIMARGEEQYVFADCAINIAPDSQDLAEIAIESANTAKMFDIEPRVAMLSFSTKGSAKSDETEKVADAVKIAKEKAPELTLDGEFQFDAAFVPSVAEKKAPDSEIKGDANVFVFPSLEAGNIGYKIAQRLGNFEAVGPILQGLNMPVNDLSRGCNAEDVYNLALITAAQAL

SEQ ID NO: 40507 - protein, 352 aa, Borrelia burgdorferi
MKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINIARQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIKIHIPKGINNEEQILIKNAGMPILQTEKFGNLILITKIKTPKNLNSNAINFLKTWAKN

SEQ ID NO: 40508 - protein, 496 aa, Schizosaccharomyces pombe 972h-
MSEDLFVSINFPNGKSVKQPIGLYINGEWHKSAETWETVDPSIEEVIAKVYLAGEKEIDYAVKSAKEAFKTWKKVPGSEKGELLMKLAELTEKHADTLAAIEAMDSGKPLVSNARGDVDGTIALLRYCAGWADKIYGQVIPTGPEKLAYAKRTPIGVCGQIVPWNYPLNMAGWKIAPALAAGNCIIIKSAETTPLSLLYFATLVEEAGFPKGVVNIISGLGTVAGSYMAKHPGIDKIAFTGSTKVGVIVQQLAASNLKAVTLECGGKSPFLVFEDADLDQAVKWAALGIMYNSGQICTSNSRIYVQDSVYDKFIELFKKHVIQDYIVGMPFDDNTVVGPVVNKTQYNRIKNYIEQGKKEGAKLVLGDEPLPLKQGYFISPTIFADCSENMTIVKEEIFGPVVAISKFKTEDEAIEKANNTTYGLAAMCFTKDLERAHRVSDELEAGMVFINSTENSDIQAPFGGIKMSGIGNELGSNGIEMYTQIKAVHINFNNKL

SEQ ID NO: 40509 - protein, 162 aa, Zea mays
MAPIGVGSTLPDGQLAWFDESDQMQQVSIHSLAAGKKVILFGVPGAFTPTCSNQHVPGFITQAEELKAKGVDEILLVSVNDPFVMKAWAKTYPDNKHVKFLADGAAAYTKALGLELDLTEKGLGLRSRRFALLADDLKVTVANVEEGGQFTISGAEEILKAL

SEQ ID NO: 40510 - protein, 484 aa, Propionibacterium acnes KPA171202
MSTRLGGSSPAAGCPAVPSRFGAAGSGAPSGTEQEQGLQRGLKNRHIQFIALGGAIGTGLFYGAAESIEQAGPAIMVCYLIGGAVIFLIMRALGEMSVEHPTSGAFSYYAYRNWSPRAGFVSGYNYWFNYIAVSMAELTVVGKYVNFWFPQIPEWLSAGAFLVLITIINLTAVRAYGEFEFWFAVIKVVAILAMIVLGVLIIATGLGGGPPTGIGNLWRHGGFFPTGISGMLCGFVVVMFSFGGVELIGITAGEADDPRRSIPRAINQVVYRILIFYIGAISVMLCLFPWNQIGKAGSPFVTIFDKIGVAGAANILNVVVLTASMSAYNSGLYSNGRMLYSLAAQHNAPGIFWKTNRLGAPWVGVLASSVVTATAVLLTYLIPGKVFLYIISIALISGVINWTMIIITNLKFRRRIGPEGVAALEFRMPGNPVTSYVVLVFLALVVVIMAMMPSYRVALVVGPVWLALLWVGYDVSCLVRRRHA

SEQ ID NO: 40511 - protein, 571 aa, Leuconostoc mesenteroides subsp. mesenteroides ATCC 8293
MTKNFKGIAASNGVAIAKAYLLVDPDLSFEKTTVTNVAAEQARVDDALKASSDDVKLIKAKATESLGAAEAEVFEAHLMVLADPEMSGAIKQKIEDDKVNAEQAVKEVTDMYISMFDAMTDNEYMQERAADIRDVTKRILSHLLNISLPNPALIDEEVVLVSKDLTPSDTAQLDRQFVKGILTDLGGRTAHASIMARTLEIPAVVGSEKATVEVSSGDLVIVDGLTGDVIVNPDADTLATYQKKAADYFAQRAEWAKLKDEKSVSADGKEFIVGANIGAPKDMQAVLDNGSEGVGLYRTEFLYMESDHLPTEDEQFEAYKSVVEQMGDKPVTVRTMDIGGDKHLDYWKLPEEENPFLGYRAIRISLDQTDIFRTQLRALIRASAFGNLWIMFPMIATLSEFRAAKKIYLEEREKLEKAGVATGEVKLGIMIEIPAAAILADKFAKEVDFFSIGTNDLIAYTMAADRGNDRVAYLYQPYNPSILRLINTVISAAHKEGKFVAMCGEMAGDPVAVPLLVGMGLDEFSMSAPSVLQTRSLMKKLNTADMKVLAEKALDVETNDEVIELVKEATK

SEQ ID NO: 40512 - protein, 1074 aa, Oryza sativa Japonica Group
MRGDAPAASSSSSASSPPSLFGGGDGGGELFGSAPGPLVFLPLLLIQGGGMDLSRVGEKLLSSVRSARSLGLLPPTPPPPASRPEVPARAAAAAAAARAIAGLPPHEKISLPSNSEDLVSIYGSNPQGHAVDELEEVFFQEEFDPIKYILQSIPAEGDSSYFDKQSTLRLAQLDKIAERLSHHVMGHHEEMVKGMQLVMELEQDLKVANVICMNGRRHVSSSKNEVSRDLVVNVKSKKKQALLDVLPILTELRNAQDMQMELESFVEKENYFQAFQLLPEYLQILENYSGLSSVQEMGRGIEAWLARTIQKLDTHLLGVCQTFHEESYLTVIDAYALMGDIGGMAEKMQSFFLQEVLSQTHYVLKEMLEEEVGNNTQRNRFTYSDLCAQVPEPKLRPCLLRTFQSLFSLMCSYYTIMSFCPGVKSIESEGENSLTGRNNTSQSADESLGDSGRGHAAEMSDRTSSSDVSNPDTSTSGTDSPFYQLRTDAAKLVAHAFERGRRNLWQLATSRLSVLLSSSVVFSTSTYQFLKNYEDLTIFILAGEAFCGFEASEFRQKLKGICLNYSVAFHRQNIYALKMVLERESWTIMSAEASRIISLAGLTGDGAALISPTSRISTLPIHGSTMSDTGKEKNGFAAWTKIENPFFYKVENGTTESPKSNMMFNSVDNSSAHGSTNNGNGNKAPLDEENEDLLADFIDEDSQLPSRLAKTKIVKGNSSHWKDGDISSQTGSSLSLLRMMDKYARLMQKLEIVNVELFKGICQLFGIFYHYIYETFGNQDRGQSGKSLPDHQSFRLRVALSKITQDSDQWIKPQSISYSPSSPVSMDVMPTAPPSSMFTLYGLKERCAAAETISLVARVLNRSRAHLHSVLSQSNTSILEEFFGTMVDSVPDLAEHIHRTSARMLLHINGYPDKIANAKWEVKELGMEHNGYVDLLLGEFKHYKTRLDHGGISKELQDLLLEYGIDSIAEVLVEGLSRVKRCTDEGRALMSLDLQVLINGLLHIVSANVRPKLQIVDTFIKAYYLPETEYVHWARSHPEYSKSQVVGLVNLVATMKGWKRKTRLETIERIEAGP

SEQ ID NO: 40513 - protein, 169 aa, Oryza sativa
MTMITPSYLGDTIEYSSYASSLVPSSDPLVTAASVLEFCRYETAGGGANVVAPGYTKGDGLGAEIVGTFILVYTVFSATDAKRNARDSHVPILAPLPIGFAVFLVHLATIPITGTGINPARSLGAAIIYNRGHAWDDHWIFWVGPFIGAALAAIYHQVVIRAIPFKSRL

SEQ ID NO: 40514 - protein, 652 aa, Prochlorococcus marinus str. MIT 9303
MSLISLIEASKDFGINTLFADLTLHINERERLGLIGPNGAGKSTLLKVLAGEEPLGEGERRCSARLRVELVGQESAVNPGHTVLQEVLAGCGEKRELLLRFNELSNSMARNPNDATLLAELGQVSQRMDDAQAWSLEQQCQEVLQRLGITDLERPVEELSGGYRKRVGLASALVARPDVLLLDEPTNHLDAAAVEWLQSWLDRFPGALVLVTHDRYVLDRVTRRMVEVDRGKAHNYAGNYSTFLQQKAELEASEASTAHKFKGVLRRELAWLRQGPKARSTKQKARLQRIEEMRAEPLPQLRGSLKMANVSRRIGKLVIEAEALQVTANGKPDSPLLLDNFTYSFSPEDRVGIIGPNGSGKSTLLDLIAGRRQPNGGTLRLGETVHLGYLDQHTEDITKGKGLDRKVIDFVEEAASQIILGEEQITASQLLERFLFPPAQQHSPLGKLSGGERRRLTLCRMLIQAPNVLLLDEPTNDLDIQTLSVLEDFLEDFRGCVVVVSHDRYFLDRTVDRLFNFENGQLKRFEGNYSAFLEQQRRQERDFNEANEPKSSLLLQDSGPSRISKRSSQEAESSSPQATETSKPRRRSFKESRELEALNIDIPLLEAKRSNLEAALSGGDEDLTLLSQQLAELVETLHKAEERWLELSELAI

SEQ ID NO: 40515 - protein, 241 aa, Haemophilus influenzae
  misc_feature (1)..(1): Xaa can be any naturally occurring amino acid
  misc_feature (4)..(4): Xaa can be any naturally occurring amino acid
  misc_feature (83)..(83): Xaa can be any naturally occurring amino acid
  misc_feature (109)..(109): Xaa can be any naturally occurring amino acid
  misc_feature (111)..(111): Xaa can be any naturally occurring amino acid
  misc_feature (129)..(129): Xaa can be any naturally occurring amino acid
  misc_feature (139)..(139): Xaa can be any naturally occurring amino acid
  misc_feature (158)..(158): Xaa can be any naturally occurring amino acid
XSSXEGKKVPQVTFRTRQGDKWVDVTTSELFDNKTVIVFSLPGAFTPTCSSSHLPRYNELAPVFKKYGVDDILVVSVNDTFVXNAWKEDEKSENISFIPDGNGEFTEGXGXLVGKEDLGFGKRSWRYSXLVKNGVVEKXFIEPNEPGDPFKVSDADTXLKYLAPQHQVQESISIFTKPGCPFCAKAKQLLHDKGLSFEEIILGHDATIVSVRAVSGRTTVPQVFIGGKHIGGSDDLEKYFA

SEQ ID NO: 40516 - protein, 133 aa, Synechococcus elongatus PCC 7942
MARPLARLFAIVLVAVIGLTACTGGGDSAISGNYRQDTLAVVTSLRNAITLPDDAPEKSAAQAEARQLINDFAARYRRDSRVSGLSSFTTMQTALNSLAGHYSSYPNRPVPEKLKKRLEKEFRMVELALNREA

SEQ ID NO: 40517 - protein, 143 aa, Clostridium perfringens
NENEIDLMRKAGKILGETLNLLKEQVRPGITTTELDRIAEEFITKHGATPSFKGLYGFPASLCISVNNQVIHGFPGSYELKDGDIVSIDCGVCLNGFHRDAARTFGVGNISEEAEKLIRITEESFFKGIEKAYVDNRLTDISK

SEQ ID NO: 40518 - protein, 187 aa, Saccharomyces cerevisiae
MSIASYAQELKLALHQYPNFPSEGILFEDFLPIFRNFGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 40519 - protein, 187 aa, Triticum aestivum
  misc_feature (173)..(173): Xaa can be any naturally occurring amino acid
KKVLANKLNTWSKLQEHYDAEGKNLVIKELFEKDPQRFEKYHRVFKGSDKTKSSILFDFSKNRVTDETLKLLLELAKEAKVEEMRSKMFTGEHINFTEDRAVLHIALRNLSDRPIYDNGADVMPEVREVLAHMKQFSEAVRSGEWKGYTGKTITDIVNIGIGGSDLGPVMVTXEALKPYAQEGLKGS

SEQ ID NO: 40520 - protein, 209 aa, Triticum aestivum
DLPLSSLLFTTQTQHSSKEADGRVMGSNNPGGAGGGMAPGMGAGSSDGRHDDEAVLTEFLSSLMDYNPMIPDELVEHYLGRSGFHCPDLRLTRLVAIATQKFISDVASDSLQHCKARVAAPIKDNKSQQPKDRRLVLTMDDLSKALREHGVNLKHPEYFADSPSAGMAPSQERNRISHFPYQDMPLQLYVPLQASCIMDSSVWLHHFDA

SEQ ID NO: 40521 - protein, 233 aa, Zea mays
MSLSNKLSITDVDVGGKRVLIRVEFNVPLEADKNITNNQRIVGALPTIKYARENGAKSVVLMSHLGRPNGSPNEKYSLKPAVPELEKLLGKKVTFAPDCVGPEVEEIANKGEDGAVILLENLRFHIEEEGSSKDKEGNKTKADKAQVEAFRKGLTALGDVYINDAFGTAHRAHSSMVGVDLPQKASGFLVKKEHEYFAKALEEPKRPFLAVFGGAKVSDKIQLIDNLLDKVNT

SEQ ID NO: 40522 - protein, 140 aa, Clostridium perfringens
VGKSTVTGILATQLAKKGYKVGVLDADITGPSMPRFFGINEKRADIVAMDSEGKQVKFVPVKTELGIKVISMNLLMEVEDDPVIWRGPMVTGVLNQMFKDTDWEELDYLLIDMPPGTSDITLTVMQTFPIKELVIVSTPQ

SEQ ID NO: 40523 - protein, 324 aa, Dehalococcoides ethenogenes 195
MLKLSSIYAPINEGLKGVEDEFKLVSESRKQSFPEMAEMLDYILVGGKVLRPALSMLSAMCFGTGIKKVLPLATSSEMLHIATLVHDDAIDKADTRRSRRTVNSVWGLEKAILLGDFLFAHAAEVAAETDNMRIVTLFAQTLQIIASGELKQAYASFNPDQSYENYLERISGKTAALFVMATKGGAILADASPSDEEIMRSYGYNLGLSFQIVDDILDFVGNAKDMGKPVGSDLNNGTVTLPALLLMDRYPENNPIKDMLGATDRSAHVARAVEMINSSDIIDLSYKEAKRYADLACQDLSKLPKTAARESLYQLAEFIVERKN

SEQ ID NO: 40524 - protein, 593 aa, Methanosarcina acetivorans C2A
MAESWQLNRFRRFLVHEFKSRIIFNGEIKANMTHEKNPKRFLHFPFFQGAFPSSPKQIPLEITAGIAFAAFAIPEVMGYTKIAGMPLVTGIYTILLPMLVFAIFGSSRHLVVGADSATAAIIASGLITMAVPGSPQYVAYAGMIALIAAIFLLIAGLLQLGFLADFLSHTVLIGFLTGVGIRISISQLAGMFGISAGSYGTFMQLASLVRDLDLTNVPTLIVSLSVIGIIFLSERIGSKVPGALIAIIGAIAASWMFDLTSYGIIILDAVPGGLPHLSFPQVPLSDIPKLFNISVACFLIILAQSAATSRAYSVKFSDTFNENSDLIGLSLANAAAGISGTFVVNGSPTKTEMVRSVGGQTQLTQLTTVFIVLIVLMFFTRPFAYLPTAVLSSMVFLIGLRLIDTEGMTALHRQRPVEFNVALITAMTVVVIGVEQGIVIAIVLSVIAHLRHSYRPLNLLLVPKPGGAMRTVPLEKGQQAVEGLLIYRFGSNLYFANENRFTKEIIELAKKDGSLKWFCISATNIGDIDFTAIEAFKNVCIQLQQMNITLVLSEVVQPVMNELDRDGITKMIGRDHIFESVQDVIEAYKRTAD

SEQ ID NO: 40525 - protein, 535 aa, Bacillus clausii KSM-K16
MVHSFSSELRGEYIQQLEGDVFDLLVIGGGVAGAGIALDAVVRGMKTVLIERADFASGSSGAWSTLFHNESRQAHQLDMKWHGEYVKERLILHENAPHLMKQLPLLLPAFKVGMFGRHSFGSKVVERISDLARKEKRKHLSKKELNRLAPLLSDKSIKGAVLYQEFWRDDARLVFDLLKEATRRGAMALNYMKAETFLYENGKAVGVVAIDQLTGEAYKVFAKKIINATGIEADTLREQDRSMSAKTIGYMTDVYMVIPKELLAIDQVVYLELDDKKLISLAPRGKKVVLSLTDSDEKDKNEREVMLAKINQTFQEVQITPDDIEASWHVKRPIVIETNKKKHEAIRKNDWFESASGLVTVVCGHTTGYRLLAQQILDRIAKKAGPFSPCETDTVTLSGGYAGSVDQFDNYKEKRLAEGVQYGISQEKAQELVDMYGSNVGAIYARFWSYKKQARLFGLPPVIFAQLLFSIEEEMAVTPADFLVRRTAMFYFNKTEALHVQEAVFRYMRDRFNWSEEQEAQYRVELDALIKPASR

SEQ ID NO: 40526 - protein, 144 aa, Zea mays
AAFPMVLKAALELGVFDTLYAEASRSDSFLSPSEIASKLPTTPRNPEAPVLLDRMLRLLASYSVVKCGKVSEGKGERVYRAEPICRFFLKDNIQDIGSLASQVIVNFDSVFLNTWAQLKDVVLEGGDAFGRAHGGMKLFDYMGT

SEQ ID NO: 40527 - protein, 580 aa, Physcomitrella patens subsp. patens
MAFGSQEGWKAEDGAADDAWNDNTPVPVPVSVPAKVSSSTPVVLNKLSYCKVVKADTLANKNSQVLEADSDHCHFLELPPVLILEIFTHLDARALCLLSCTCVLFRRLASDSHGWKNFYCERWGLPAIPSTGVLGISTPGKSWRELYMAREERCKVLMGRFQTDMLLGHTEPVRCIRLLPVANLIITAGYDQVVRVWNLEEGLPLVCSRPLGETLRAIGVDMELLAVAGSDAVIRLWRAIPECPQLFDVAGIWGGPNSKGAEICLYGHNGPITCLGLDAANIYSGSWDMSIRVWDRVTLLCVSQLLHNDWVWALVPRGRRLLSTAGSHVYSWDIETGQHRMREGVHLGQAYAVQGSYSGHFIFTGGEDGAVRMFDDRFSRRHNNGYKTNTLEPIAVWMPHRGAIHSLAFEDPWLVAASADGSVAIMDVRQIMDKASGSGKRLPSSSTRSRTTSSSQIVGKAGEEAVQRFLPGLHHCSFSVDIGADRVVSGGDEKTVRIWDFSQAIEIERSIQASRRSRPRRRSKKAVAPVVEQLAKLETRGVITSRPEVASTSTKVVGHQAASRWVTLGRIRKSQTVGAL

SEQ ID NO: 40528 - protein, 286 aa, Lactobacillus sakei subsp. sakei 23K
MQKLSALTAPMALSNGVTIPGLGYGTYQTPNEETKKAVLEALSVGYRHIDTAAVYGNEQGVGDALKESDIAREDIFVTSKLWNTERGYDATKAAFAKTIATLGVDYLDLYLIHWPANTKQFGAKAAELNAETWRAMEDLYNEGKIRAIGVSNFMPHHLDELMKTAVIKPMVDQIEVHPGWPQAEAVRYNQAHDILVEAWAPLGEASALSNETIAAIATKHGKTAAQVCLRWGIQQGVLPLPKSTHQERMAQNTDIFDFELTDAEMTQISALENLGGQCMVPDEVDF

SEQ ID NO: 40529 - protein, 489 aa, Vibrio vulnificus CMCP6
MGKPTGFLEFGRELPKKLAPAERIKNNKEFVLNAEFGKKINTQASRCMDCGVPFCHNGCPIGNIIPEFNDAVYRDSWEEAWNILSSTNNFPEFTGRVCPAPCESACVLGINQDPITICNIEKTIVETAYREGYAKPKTPRSRTGKKVAIIGSGPAGLAAAEQLNSAGHSVTVFERDEKVGGLLRFGIPDFKLGMDIIDRKINLMAEAGVEFKVNQHVGVDVNAQQIRQEYDVVLLTGGSTVPRDLPVPGRELKGVYFAMQFLAQNNRRANEMDLKGEEIHAAGKHVVVIGGGDTGSDCVGTSNRHGAASVTQVEIMPVPPEKRPANMPWPQYPMILRTSTSHEEGVDRHWNILTKEFIGNDKGEVTGLRLADIVWQDAQPGERPSFKEVEGSERVIPCDMAFLAMGFLHPEPHGVLAQLNVALDERGNVATQDFQTNQQGVFAAGDMRTGQSLVVRCINEGRECARAIDQYLMGNTNLEAKADSLMLSA

SEQ ID NO: 40530 - protein, 1237 aa, Bacillus cereus G9241
MLDWMKKLFNKEEEQTAMNKEVPKQVESQPKIPRVNHYTEAREAQMASRNAGKCRFPLVPDNGFDEEDVIETGHFEEPPVQAVTYENQPIQRGIKVERSRRQYVEKVVSTYEEPEIQYEPEREPVVKKASAPAQESNRRPFRPTEMISPIYGYNRPSVEKKEEKQEEVKEREDLEISVEGKSVVDAWLEKKGYTLSDFSEGQAPTSSSHEGIDQQDQQSKKEEKSVVDQWLEKNGYEIERQEPIVEEVVQEMSAPQEVPAAELLHETIAERMEDTKQEKDVVAKNILQAESVDSKVEHEDTILSEEIKRNTEIEQPTIEVEKQAPEESVIVKAEEKLEETIIVEIPEEVEVIAETEESEEVEVIAETEESEEVEVIAETEESEEVEVIAETEESEEVEVIAETEESEEVEVIAETEEQKEVEVIAETEESEEVEVIAETEEQKEVEVIAETEAPEEVEPVVLEETQQEMVLNEAIEQKNEFIHVAEADEQTKKDVQSFADVLITEEQLVVEETPIVEEQPVAEETPIVEDQPVVEEAPVAEEQSVVEETPIVEETPIVEEQPVAEETPIVEEQPVAEETPIVENQPVVEEAPVAEEQSVVEEAPIAEEQPVAEETPIVEEQPVVQKEEPKREKKRHVPFNVVMLKQDRTRLMERHAARTNAMQPSMSERVENKSVHQVEEKPMQQVVVEPQVEEKPVQQVVVEPQVEEKPVQQVVVEPQVEEKPVQQVVAEQVQKPISSTEVEEKAYVVNQRENDVRNVLQTPPTYTIPPLTLLSIPQQAALDNTEWLEEQKELLDTTFNNFHVGAHVINVSQGPAVTRFEVQPDPGVKVNKITNLSDDIKLSLAAKDIRIEAPIPGKSAIGIEVPNKESKPVFLREILRSPVFTKSESPLTVALGLDISGDPIVTDIRKMPHGLIAGATGSGKSVCINAILTSILYKAKPHEVKLMLIDPKMVELAPYNSVPHLVAPVITDVKAATAALKWAVEEMERRYELFAHAGARDLTRYNTIVSEREIPGETLPYIVIVIDELADLMMVAPGDVEEAICRIAQKARACGIHLLVATQRPSVDVITGLIKSNIPTRIAFTVSSQVDSRTIIDIGGAEKLLGRGDMLFLGNGTSKPVRVQGVYVSDDEIEKTVDHVKKQMKPNYLFKQEDLLAKTEQAESEDELFFEACQFVVEQGGASTSSVQRKFRIGYNRAARLIEEMQSQGIISEARGTKPRDVLISEDEFAAMQETNV

SEQ ID NO: 40531 - protein, 330 aa, Prochlorococcus marinus str. MIT 9303
MSIPPAIVAAARMGWHWQWIQLMNGLAPADANGSYRRPPSQHQQATLPAEQELSNRSADQYPRLIIGRSCPWAHRTWLVLQLRNLQSSLTLHLARADHKAGRWQLDPAWLGCNSLLALYQRCGSPPSHRATVPALVDPGTMTSQSPQLLGNESAQLVEVLNLWPAAKDAPDLAPSHLQGEINGWQKLLQPAVNDGVYRCGFARNQAAYDKACNELFDTLAQVDRSLSKKGPWLCGDQLTLADVRLFPTLIRWEMVYAPLFGCSQQPLWGFPHLWHWRQRLLALPGVAKTCDSQAWRQDYFGALFPLHPSNIVPAGPDLAKLVNASAPDQR

SEQ ID NO: 40532 - protein, 169 aa, Zea mays
MSGHGDTATSAKMAKLKELLQKSENHICADCGASDPKWASANIGVFICVKCSGVHRSLGTHISKVLSVTLDKWSDSEVDSVIEVGGNSQANAIYEAFIPEGCQKPHSDSTQEEREKFIRSKYELQEFLKPSLRIVSHQPSDSGKHAGNASHSDGSKSQSRMIEFIGILD

SEQ ID NO: 40533 - protein, 472 aa, Vibrio vulnificus CMCP6
MNMSQNVYQFIDVQRVDPAKKPLQIRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTDKKVAIIGAGPAGLAAADILVRNGVKPVVFDRYPEIGGLLTFGIPSFKLEKGVMENRRRIFSEMGVEFRMNVEVGKDVQMQELLEEYDAVFLGVGTYKYMRAGLENEDASGVYDALPFLISNTYKVMGLEHDQPFIDMAGKNVVVLGGGDTAMDCVRTSIRQGAANVVCAYRRDEENMPGSRREVKNAKEEGVNFMFNLQPLSIDVDTRGQVTGVKVVQTALGEPDEAGRRRPEPVAGSEHVLPADVVIMAFGFQPHQMSWLEPYGVELDQWGRIKAAAKQTYQFQTSNEKIFAGGDAVRGSDLVVTAIDEGRKAAEGILDYLEL

SEQ ID NO: 40534 - protein, 840 aa, Schizosaccharomyces pombe 972h-
MRAWGWVRNKFSSEDDYNDGASNKDYPDRFNEFDNSQNDHNDYTQNNAQFQNAQTTTFGRTISRVKAYYEIPEDDELDELASIPQWFKKNVTSNIFKNFLHYLKSLFPIIEWLPNYNPYWLINDLIAGITVGCVVVPQGMSYAKVATLPSEYGLYSSFVGVAIYCFFATSKDVSIGPVAVMSLITAKVIANVMAKDETYTAPQIATCLALLAGAITCGIGLLRLGFIIEFIPVPAVAGFTTGSALNILSGQVPALMGYKNKVTAKATYMVIIQSLKHLPDTTVDAAFGLVSLFILFFTKYMCQYLGKRYPRWQQAFFLTNTLRSAVVVIVGTAISYAICKHHRSDPPISIIKTVPRGFQHVGVPLITKKLCRDLASELPVSVIVLLLEHISIAKSFGRVNDYRIVPDQELIAMGVTNLIGIFFNAYPATGSFSRSAIKAKAGVKTPIAGIFTAAVVILSLYCLTDAFYYIPNAILSAVIIHAVTDLILPMKQTILFWRLQPLEACIFFISVIVSVFSSIENGIYVSVCLAAALLLLRIAKPHGSFLGKIQAANKYGSDNIANVRDIYVPLEMKEENPNLEIQSPPPGVFIFRLQESFTYPNASRVSTMISRRIKDLTRRGIDNIYVKDIDRPWNVPRQRKKKENSEIEDLRPLLQAIIFDFSAVNNLDTTAVQSLIDIRKELEIYANETVEFHFTNIRSGWIKRTLVAAGFGKPKGHAVDASVCVEVAAPLRDANLSAESSRNLSRIITPIYDDEEGNVSGHIYELDGKNNSDLSMHCQKGSNQVEIEFVEFNSRKYPFFHVDVASAVVDLQHRLLSPQKSDSFGSLKEGGTTTIKKIEN

SEQ ID NO: 40535 - protein, 498 aa, Botryotinia fuckeliana
ISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPW

SEQ ID NO: 40536 - protein, 313 aa, Zea mays
MAGKENAAPVGALGVAGPRLTRAAAKRAAAMAAEGPDDAKRRRVALGELPALANNAAFAPSRPVKPSKPASRPARPGASEACGPAAAAEAERCSSFSPPRAADAESNSASYSPAAHHNRHRFLRAAARRRPRVQLSSSTSPPFGTADTAFSAPPRAVAPADLQLSGSYASDIYTYLRSLEVDPQRRSRSDYIEAVQADVTAHMRSILVDWLVEVAEEYKLVADTLYLTISYVDRFLSVNALGRDKLQLLGVASMLIAAKFEEISPPHPEDFCYITDNTYTKEELLKMESDILKLLKFELGNPTIKTFLRWQTH

SEQ ID NO: 40537 - protein, 524 aa, Lactobacillus sakei subsp. sakei 23K
MNKVKGPKKHKLIEYANGPSLEEINGTVEVPEGKTFWKTLLAYSGPGALVAVGYMDPGNWSTSITGGQSFQYLLMSVILVSSLIAMLLQYMAAKLGIVTQMDLAQAIRARTSKSLGIVLWILTELAIMATDIAEVIGAAIALYLLFNIPLVIAVFITILDVMLLLLLTKVGFRKIEAIVVALIVVIFVVFAYEVALSNPDWAGVIVGLVPTAKTFATTPNVGGMSPLTGALGIIGATVMPHNLYLHSAISQTRKIDRNNEEQVAQTVRFSTWDSNIQLTMAFFVNALLLIMGVAVFKTGAVKDPSFFGLFEALSDTSTMSNGILASVARTGILSTLFAVALLASGQNSTITGTLTGQVIMEGFVHLRMPLWLRRLVTRLLSVIPVLICVMMTSNKPPLEEHQALNTLMNNSQVFLAFALPFSMLPLLMFTDSRVEMGDRFKNSLVIRVLGWLSVIGLTYLNMLGLPGQIEAFFGDQATAAQLALADHIAYVLIAAVLALLVWMIVELYKGNQRFEQQLAAQAAE

SEQ ID NO: 40538 - protein, 365 aa, Brassica napus
ILSRRPDSYLELVDLLRWQYATVQLYCWCRPTRPLLSCLFSVSYASLGDADPNYRACVGECEISGCVGQLCFPQCNSSSNTGPWYTQEPLYLQWQKWGCQGDCRYHCMVNREKERETLGQPPLKYHGKWPFKRLLGIQEPASVAFSVLNLAMHFHGWISFFITLYYKLPLREDKTAYYEYVGLWHIYGFLSMNSWFWSAVFHTRDVDITERLDYSSAIAVIGFSLIVSILRTFDVRVEAARVMVSAPVLAFVTTHILYINFYKLDYGWNMIVCVAMGVAQLLLWARWAAVSRHPSNWNLWMVVIASGLAMLLEIYDFPPYEGYFDAHSIWHAAPIPLTVLWWSFIRDDAEFRTSSLLKKSKTKAK

SEQ ID NO: 40539 - protein, 241 aa, Vitis vinifera
MEFVSPEGLRLDGRRPMEMRQIRGEIGAVAKADGSAFFEMGNTKVIAAVYGPREVENRSQQISDQALVRCEYTMANFSTGDRMRKPKGDRRSTEISLVIRQTMEACILTHLMPRSQIDIFVQVLQADGGTRSACINAATLALADAGIPMRDLVTSCSAGYLNSTPLLDLNYVEDSAGGPDVTVGILPKLDKVTLLQMDAKLPMDIFENVMQLAIEGCKAIANYIREVLLENTKQLEYRRGP

SEQ ID NO: 40540 - protein, 388 aa, Thermoanaerobacter tengcongensis MB4
MNFEDRIAKRAKAIEISTIRYFFNMAREVEGAISLAIGEPDFITPEHIRNAAKKALDEGMTGYTVNAGLIELRREIADYLKRRYSLYYDPEKEILVTIGATEAIYVTLSTLAEEGDEVLIPEPSFVAYHPCTVIAGAKSVFVPTYEEDDFILRADVLEKYITERSKVLILPYPNNPTGAVMPKEALEEIAKVVEKHDLIVVTDEIYSELVYGGFKHTSFASLPGMWERTITINGFSKSYAMTGWRLGYIAAPEHFTKHIAKLHQYAVTAAATMCQYAGIEAMRNGDEDIIKMREEYDKRRKFLLESVREMGLSCFEPKGAFYIFPSIKTTGLTSMEFAKRLLYEAKVAVVPGNAFGEHGEGYVRLAYATSMENLEEAVKRMKEFMAKL

SEQ ID NO: 40541 - protein, 320 aa, Synechococcus elongatus PCC 7942
MADRLTNLFPFWLLLIGAIALRWPQIFIGLNQGNLPVLILTLVMLGMGLTLSLDDFQRVSRLPRAVLTGFCAQYLIMPFLGWAIGAALQLPTALAVGLILVGTCPGGTASNLITYIARADVALSVVMTLASTLAAVVMTPLLTQFLAGAYVPVNGWLLFAQTLQVVILPVAIGVALNRWTPRLVRQVLPIAPLLSVVGICLICAATFSANAEAIVQQGRQMLLGVFLLHSLGFALGFGFAKLFGYSQAIARTIAIEVGMQNSGLAIILARQAFPLLPLAAAIGAISGVMHSLVGSFLAVIWRSQAQRQSEAVQPHNSLTM

SEQ ID NO: 40542 - protein, 506 aa, Oryza sativa Japonica Group
MATANLLYAALLVPTVLYLAVTRRRSRRLPPGPVGLPLVGSLPFIDPNLHTYFASLAAKHGPILSIRLGSKVDIVVNSAQLAREVLRDQDSVFANRVMLDAGDAVSFGGAQNIVGNPLGPMWRLLRRVCVQEMMSPAGLASVHGLRRREFRSTLRYLHSKPGEPVDVGAQMFLNTMNVITGTMWGGTIGSESERSAVGSEFRGLVAEVTELLGTPNVSDLFPVLKPFDLQGIRRKMERLRSRFDLLFTKIIQQRMRSQQDGGEMTTDFLECLLKMEKEGSDGKTTFTMDNVKGFLLEMVVGGTDTTSNSVEWIMAELLQNPQVLNKVQQELDSIVGRDAVVEESHLPQLHYLRMVIKETLRLHPPVPLLVPHSPSAAATVGGYHVPEGCRVLINVWAIQRNPLVWNKPLDFNPDRFARDGGHKGDFTGSQLDYLPFGSGRRMCAGMAMGEKVMVYSVAMLLQAFDWKLPQGVQLDLSEKFGIVMKKATPLVAIPTPRLSKPELYYS

SEQ ID NO: 40543 - protein, 398 aa, Dehalococcoides sp. CBDB1
MTSQVGTDKGFISDRAKELKPSGIRKFFDLAAKMGSGAISLGVGEPDFTTPWHIRESAIYALEKGYTMYTSNAGLLELRQEISKYLYQTYGLEYNPETEVLITVGSSEALDLVMRATLNPGDEVLMTDPAYVAYPSCVFMSYGNPVQIPTFEANNFEISAADIAPRITPKTRSILLGYPSNPTGAVMPKNKLAEIAKLACDKNLLVVSDEIYDKIIYSGFEHTCFATLPGMRERSVIINGFSKTYAMTGWRIGYAVGPAAIIQAMTKIHQHTMLCAPIAAQKAALEALRNGQDDVRLMVEEYDRRRRFIVKNFNDMGLSCFEPKGAFYTFPSVRKTGLSSNEFAEKLLMEEKVAAVPGTAFGESGEGYLRCCYATSLKDIEEAMKRFRHFLKHNCPQM

SEQ ID NO: 40544 - protein, 626 aa, Yarrowia lipolytica CLIB122
MQMLNRTRKGSGLHGSDRWLVYKSKLGDRCGQSLRLHYSISMEKDYSDTPESAEFTETHTGQVETAHMSKWQRFKYGFGPADISHIDTEGLTPMEITALKTANSPLQRGLKGRHLQMIAIGGSIGTGLFVGSGSTLANGGPAALLIAYGIIGIMLLLTMHALGELAVCFPVSGGFCTYFTRFIDTAWGFAMAWNYVMNWFVVLPLELVAASMTVNFWNEMNGTHINAAAWVSVFWAVITCINLFGVKGYGEAEFVFSIIKVVAIVGFVIFGIVMACGGGPERGDFHHYMGGTLWQHPGAFAHGFKGVCAVFVTAAFAFAGTELCGLAAAETENPRKMLPRATKQVFWRICLFYIVSLTIVGLLVPWNNDQLLNGSSSADAAASPFVIAIRLAGVKGLPSVMNVVIMISVLSVGNASVYGFSRTMAAMGESGQAPKIFAYIDREGRPIFGILVVLAFGLFSFIAAAGAETRNEVFNWLLALSGLSSVFVWGSICLAHIRFRLALKYRGRGTDELTFRAAFGVWGSVLGLILNCLVLMAQFWIALYPLGAKTPNASDFFQAYLAAPVVIAFWIFWKVWKRDGFLGLKDLDIDTGRREMDLDKVRAEMAIEDEELSRRSFLYRTYNFWC

SEQ ID NO: 40545 - protein, 150 aa, Zea mays
  misc_feature (67)..(67): Xaa can be any naturally occurring amino acid
MLVCMSHAWSAEATLAGAKAAAVATIASAIPTVSFLSPSLAFSRRFNQALPYVRTRRSSRNGPSSAXVSNNWSSLLQLASVRMLPWAKANINPTGQALIVSTVAGMAYFIAADKKILSLARRHSFEQAPEHLKNTSFQGTGRPHPAFFRP

SEQ ID NO: 40546 - protein, 546 aa, Zea mays
MLRYSRRFLTRTPRRRQPKTAGKTEPSPTAAPTYTRDVVRRATAILRDQPWSAARPLLLSLPGLAWDSHTVARVLKTHPPLQKAFLFFRLATTASRTFRHDRFTYTSMIHLLGEAGRVPAMLRLLAEMLRAGIAPDAATFTTVMHWLARAGDVDGAMRVWAEMKARSRPTVVSYTACIKILFDARKAEEARGVLREMVAEGLRPTCKTYTVLIEHLADTGKFEATLEIMDKMKEACVQPDKALCNILVQKCSRAGETSVLTCILQYMKEHFIVLRRPIFLEALQALKASGDSDELLREVNPHLSYEGIENDPILSDQGYLTDRSIILYLMSANKWSAIEQMVNQMAPKNVKMETHILSDVIEASCAARKPSCGLAVMRYGLGVGCELGRSAYCSLLGQYIRTDSFDLVLEIVEELIKSGCNLGTYVSSVLILRLGYAGQSACAAHIFGLLTADKNVVSYTALINAYFQAGKVDGALDLFTQMRTNRISACLGTYEVLIHGLEKAGLKQESDYYRRERMNMQWHLQYHGPQSPEDTLCNHLFCGIHG

SEQ ID NO: 40547 - protein, 250 aa, Desulfitobacterium hafniense Y51
MGMIELKNPSQIAVMRKAGKIVADTLQLMRENVRPGITTGELDGIAEEYIRKCGAVPAFKGYNGFPSSLCTSVNEQVVHGFPGLRTLKSGDIISIDCGAVFDGYVGDAAITLPVGEISEELQLLLRVTEESLMMGIPQAIKGNRLQDISHAVQTHVEAHGLSVVRDYVGHGIGRAMHEDPQIPNYGKPGRGPRLEIGMVLAIEPMVNLGTYEVKVLSDHWTVVTKDGKASAHFEHTVAITENGPEILTRS

SEQ ID NO: 40548 - protein, 338 aa, Methanosarcina acetivorans C2A
MTISVYLMTQLSILCDGVLKMLKKFTSLFPLWAILLSAVAYLHPEYFAPHQGLIVPFLSLIMLGMGVTLSVGSFLAVLKRPYVVLLGTLMQYTLMPLAAWAVSLALKLPADLMAGVILLGCCPGGTASNVICYLAKGDVALSIVLTSVSTMLAFLATPFLTWLFIGQTVNVDVTGMLVSVVRIVIVPVVLGLAINYFFEARIRAVRDVFPAISAAAIVIIIAIIIGTNSENLEQSGLLVLLAVVLHNSLGLAGGYGVAKALKLSEKEARTLAIEVGMQNSGLSVALAIKHFTAAAALPGAIFSIWHNLSGAFLAGHWSKETVPDPDKSERPKTIGHIH

SEQ ID NO: 40549 - protein, 330 aa, Mycoplasma gallisepticum R
MNGENMSTLIEELKNKIKNSKKVPQILLVEGWNACVQEAAKQLVAEKLVKPVLMFRTMDEIPADFDPRIKRYVIEKMDLSKYATYLFKLREKKGMTLEVAQQEVQKPNVLASLLVKLDEVDGEVCGKEYTTKETLKPALQIIKTSETAKIVSSVMVLEKNQERLVFADCAINVYPTAEELAEIAKSTIKFAKDVLQIEKINLAMLSYSTLNSGVGESVDKVKAATKLVEESDVGKLASICGPMQFDAAYVEEVRKQKAPKLDWEKGANVFIFPNIDAGNIGYKIAQRLGGYDAIGPVLTGLAKPVNDLSRGANAHEIYSVAIITACQAVA

SEQ ID NO: 40550 - protein, 162 aa, Zea mays
  misc_feature (37)..(37): Xaa can be any naturally occurring amino acid
  misc_feature (83)..(83): Xaa can be any naturally occurring amino acid
MATAFDSPTSSPAAAPFHDDPFLHFDGSAPAAHRDGXPAAADGFPASPDAYAPSPFGMPHSNGDLHDDPFAAPADSNGGPILXEGFLLREWCRQNAIHLEEKEKKEKELRSQIIVDAEEFKKAFVEKRKLNAETSKGQNRDREKLFLANQEKFHAGADKQYW

SEQ ID NO: 40551 - protein, 348 aa, Prochlorococcus marinus str. NATL2A
MNSKASNETILVTGAAGFIGAALVKALLNLNFKVIGIDNLNDYYSTSLKRSRLTEIEKVSTVNGEWFFYEIPIEDNKVLQDIINRYNPQVFVHLAAQAGVRYSITNPAAYIQSNLVGFANVLEGCRQNQIPHLIYASSSSVYGGNKNLPFYEEQAVNHPVSLYAATKKSNELMAHTYSHLYDLPTTGLRFFTVYGPWGRPDMAPMIFARSILNNEPIQVFNYGKMQRDFTYIDDVVEGIIRCCFKKASIDDDFNPLVPNPSTSSAPYRIFNIGNSRPTQLTYFIELLEKNLGKKAIKNFQPMQPGDVVSTAARMDLLNSWVDYKPITSIENGIKLFSEWYLDYFKNTF

SEQ ID NO: 40552 - protein, 354 aa, Ashbya gossypii ATCC 10895
MVYKQLYMRGTPPDLSRCITGQDIAMVMNVRTIKLNNGADMPLVGLGCWKIPNEVAAEQVYEAIKLGYRLLDGAEDYANEREVGQGIRRAIDEGLVRREELFVVSKLWNNYHRPEDVGKALQRTLSDLGLDYLDLFYIHFPLAFKFVPLEERYPAGLYTGAADEQAGRLAQEPVPLIETYRALEQLVDEGRIRAIGLSNFQGCLVQDLLRGCRIRPAALQIEHHPYLTQERLVQYAKSEGLAVVGYSSLGPQSFLELGNTAAQNAAPLLQHEVVCRIAERHTATPAEVLLRWATQRDIAVIPKSSRKERLATNLRVDEALTLADDELRELSSLNCGLRFNDPWDWSAQPLPTFI

SEQ ID NO: 40553 - protein, 500 aa, Botryotinia fuckeliana
QEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFARPR

SEQ ID NO: 40554 - protein, 620 aa, Escherichia coli CFT073
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDEALILEMAASHEALVTVEENAIMGGAGSGVNEVLMAHRKPVPVLNIGLPDFFIPQGTQEEMRAELGLDATGMEAKIKAWLA

SEQ ID NO: 40555 - protein, 471 aa, Yarrowia lipolytica CLIB122
MDNDRVKRRKVESESDNGRTQLTAITALPDEENTGSVHLKDLIGSPHLEAMWQFNFMIDLAFVLDNIHKNAMSNIKCRFVMGDFSGEKIAAFRAQAKSLPIADNIEVGRAKLSNLFATHHTKMMVLFFKEDKGERSAQVVIHTANMIHHDWDNMTQGVWKSQKVKEKRKTNTEGSTSTFETDLVAYLSEYQLDTTSKLIKFLQRFDWSSETARVVGSVPGTHKDKKWGLTRVADLLDEHKEDHKSDYEGSESDTIVLQSSSIGSLGVTDKWITPQLVGALDGRSPRDRDGHGLPASQIVWPTVENVRRSFDGYDLGMSIHFKNESDTHRKQYAYMKERMNVWKADNKHRTRAMPHIKTYTRFTRAGKLRWVLLTSANISKYAWGSVSAAKESKFSIPSWELGVLLFPQAVGKAVFDLKDSVIPYDWPLTNYSAKDEPWTKNADHLEKDTNGFPWVVTLDGKKKLMRSHEAL

SEQ ID NO: 40556 - protein, 299 aa, Escherichia coli CFT073
MDFPQQLEACVKQANQALSRFIAPLPFQNTPVVETMQYGALLGGKRLRPFLVYATGHMFGVSINTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRNALPVLDKYAESIGLAFQVQDDILDVVGDTATLGKRQGADQQLGKSTYPALLGLEQARKKARDLIDDARQSLKQLTEQSLDTSALEALADYIIQRNK

SEQ ID NO: 40557 - protein, 501 aa, Botryotinia fuckeliana
AQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPW

SEQ ID NO: 40558 - protein, 151 aa, Triticum aestivum
  misc_feature (96)..(96): Xaa can be any naturally occurring amino acid
  misc_feature (103)..(103): Xaa can be any naturally occurring amino acid
NKFVQKSRLLPVRNSRDIVDPRVRRNGDRRRKSVRGCIVSQDLSVMGLGIVKKGDNDLPGLTDTEKPRMRGPKRASKIKKLFNLGKDDDVRSYVNXYRRTFLXKKAKKVIKAPNIRRLVTPLTLQRKGARIADKKKKDREISSPKACREPI

SEQ ID NO: 40559 - protein, 360 aa, Schizosaccharomyces pombe 972h-
MWRSIISFLFFSVALCQPFLFQKRSSNISDFISFNASLPNVTIFAMGGTIAGYASSSTETVDYAAGSVGIATLVDAVPAIKNFSNIRGVQVTNVGSEELTPANVLNLTQLILAEVAKPDVHGIVVTHGTDSLEETAMFLDMTVNTTKPIVVVGAMRPSTAISADGPMNLLNAVVVAASNRSIGRGTMILLNDRIGSAFYTTKTNGNMLDTFKSYEAGFLGMILDQRPHFFYSPATPTGKVHFDVSNTTELPAVEILYGYQGLNPNLAKAAVDLGAKGLVLAGMGAASWTDPGNEVIDGLISNQSIPVVYSHRTMDGFSDYYYNGIPSYFQNPQKARYMLMLSINAGYSIQNITDIFSLEY

SEQ ID NO: 40560 - protein, 509 aa, Bacillus clausii KSM-K16
MTFEQTKLAKETEIFKGGHTKYHQQNAKKGKLFARERLQLLLDDGLTTEDGLFANCEADGLPADGVICGMGTIDGKPVCVMANDSTVKAGSWGARTVEKIIRIQETAEKLSVPLLYLVDSAGARITDQVEMFPGRRGAGRIFSNQVKLSGRIPQVCILFGPSAAGGAYIPAFCDVVIMVDGNASMYLGSPRMAQMVIGEDVTLEEMGGASMHCSVSGCGDILAKNEEDAISQARAYLSYLPPSYKEKPPSKEARPPKDVPKTIEDLIPQNQNAPFNMYDLLERLVDNDSFFEIKRNFAPELITGFARLNGQAIGIVANQPKAKGGVLFPDSADKAARFITLCDAFHLPLLFLADIPGFMIGTKVERAGIIRHGAKMIAAMAEATVPKISVIVRKAYGAGLYAMAGPAFDPDCCLALPQAQIAVMGPEAAVNAVYANKIAELGEQERKAFIEEKREAYKRDIDVYRLASELVIDGVVNGNDLRQELGQRFAFYESKRMVFSERKHPVYPV

SEQ ID NO: 40561 - protein, 379 aa, Vibrio vulnificus CMCP6
MSKSALLVLEDGTVFRGVSIGADGISVGEVVFNTSMTGYQEILTDPSYSQQIVTLTYPHIGNTGTTSEDEESSSIHAQGLVIRDLPLIASNFRSEQSLSDYLKSQNIVGIADIDTRKLTRILREKGAQNGCIVAGNNLDEALALAKAKEFPGLKGMDLAKEVTTKEAYQWKQGSWTLEGGLPEAKDDSELPYHVVAYDFGAKRNILRMLVDRGCRLTVVPAETSAEDVLALNPDGVFLSNGPGDPAPCTYAIEATKVFLENGLPVFGICLGHQILALASGAKTVKMKFGHHGANHPVKDLDRNVVMITSQNHGFAADEATLPDNLRATHVSLFDGSLQGIHRTDKPAFSFQGHPEASPGPHDAAPLFDHFIELIKQHSA

SEQ ID NO: 40562 - protein, 501 aa, Botryotinia fuckeliana
LAQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRP

SEQ ID NO: 40563 - protein, 357 aa, Ashbya gossypii ATCC 10895
MAIKILVSSASQQCRAAARGPRTGSCKTSGMSIGINKDTLAGFRAVKSFKVAQKEQGPITSLSFDDHGQYLLSATACDNMHLYDAAGCRFLNTVASKKYGCHAAKFTHAQSECVYSSTMISFDIRHLNLETNQYLRYFQGHEALVSDLAMSPLDDTFLSASYDESVRLWDLRTSKAQAIVPSVVPNSVAYDPSGLVFALGNPESQEIGLYNVRQLKAGPFMVVKVDPRFSQWTKMEFSNDGRYLLLASSAGRQLILDAFDGAQLFELTGTKPFPLREFMDAGSACFTPDGRYTLGTDYDGRIAFWNHSESVSQRTLKPQGFVAAAPGTCPRTIAFNPKYSMFVTADESVEFYVYDEH

SEQ ID NO: 40564 - protein, 316 aa, Yarrowia lipolytica CLIB122
MSFKLASGKSMPKVGFGLWKVPRDKTADTVYGAIKNGYRLFDGAFDYQNEREAGEGIRRAIKDGLVKREDIFITTKLWNTFHSKEHALQIAKEQNEWWGLDYIDLYLIHFPIPMQYIPISEKEWAGWTNATDSGPNPLAKIPTRETWEALEELVDTGIAKSIGVSNFTAQNIYDVQTYNKHPISALQIEHHPYLVQPQLTQLAKDNNIQVTAYSSFGPASFVEIGMDQKVPPLFENETITKIAKAHNKTPSQVLLRWATQRGIAVIPKSNNVERQTQNLESLDFDLTEAEIKEISNLNKNLRFNDPGVYANLPIFA

SEQ ID NO: 40565 - protein, 311 aa, Lactobacillus sakei subsp. sakei 23K
MTKKIILDCDPGHDDAVAMMIAHGNPEIDLLAVTTVAANQTLTKVTRNALAVATMIGMHDVPIAAGCSRPLIEEIKVAADIHGESGLDGVVLPKPTVELEKIHAVDLIIDLIMSHPAKTITLVPTGALTNIAMAARKEPKIIDRVKEVVLMGGGYHEANASAVAEFNIKFDPEAAKIVFNAGWQVTMVGLDLTHQALATPDIVSEIKAIHTETSAFVVDLLAFFRDMYKKGQNFDAPPVHDPCAVAYVIDPTVMTTKKVPVDIELNGTLTRGMTVADFSYPIPEDCQTSVAVKLDHAKFWGLVEDALRTIG

SEQ ID NO: 40566 - protein, 368 aa, Gibberella zeae PH-1
MSFAGMLNRLHGQPESYDKKAKYKFGRTLGAGTYGVVREADGPTGKVAVKIILKRNVKGNEQMVYDELEMLQKLKHPHIVKFVDWFESRDKFYIVTQLATGGELFDRICEQGKFTEKDAAETIKQVLLAVDFLHKNNIVHRDLKPENLLYLNRDPESDLVLADFGIAKMLDGKGESLKTMAGSFGYAAPEVMRKEGHGKPVDMWSMGVITYTLLCGYSPFRSENLQDLIRECTDNSVVFHERYWKDVSNDAKDFILKLIDPDADKRWTSEEALGHIWLTGENATDYNLLPEIKSFRARSRFRRIIEKIKLQARIEKLKAMEEDPDNSDLSAIFSEVARAKLADEKEEREVLRITQEVEKEVKRRSFQA

SEQ ID NO: 40567 - protein, 503 aa, Botryotinia fuckeliana
PLAQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPR

SEQ ID NO: 40568 - protein, 572 aa, Schizosaccharomyces pombe 972h-
MKDNQQAVQLQQPTTIGHYLAVRLAQAGVKHHFVVPGDYNLGLLDKLQYNNYLEEVNCANELNCAFAAEGYARANGIAACVVTYSVGAFTAFDGIGGAYAEDLPVILISGSPNTNDIGSSHLLHHTLGTHDFSYQYEMAKKITCAAVSIQRPTEAPRLIDYAIKMALLKKKPVYIEVPTNVASQPCAAPGPASLITEPETSNQEYLQMAVDISAKIVNGKQKPVLLAGPKLRSFKAESAFLELANSLNCSVAVMPNAKSFFPESHPNYAGIYWGQASTLGAESIINWSDCIICAGTTFTDYSSNGWTSLPPKANVLHVDVDRVTVSDAEFGGVLLRDFLHELAKKVKANNASVVEYKRIRPESLEIPMENPKAALNRKEIIRQVQNLVNQETTLFVDTGDSWFGGMRITLPEKARFEIEMQWGHIGWSVPSAFGYAIGAPKRNVVVFVGDGSFQETVQEVSQMVRLNLPIIMFLINNRGYTIEVEIHDGPYNRIKNWDYAAIVEAFNAGEGHAKGFRVGNGHELAEAIRQAKENSQGPTLIECNIDQDDCSKELINWGHNVGAANGKPPAKE

SEQ ID NO: 40569 - protein, 480 aa, Pseudomonas putida
MPIFEVPLLIGGMARAASDGGTFERRHPVSGDLVSVCRRHPGRADAAVEAAQAAFPAWAALGPGDGRARLLKAADALDARRDEFLAMAEETGAKANWYGFNVMLAANILREAASMTTQDTGRVIPSDVPGSFAMALRQPCGVVLGIRPWNAPVILGHIAIAMPGRIVSQGLRSQPGGAWPDRSGIAGGRFGDGVVNVICNAPHDAPAVVERLIAHPAVRRVNFTGSTHVGRIVGQLAARHLKPAVLELGGKAPFLVLADADLEAAVDAAAFPAYFNQGQICMSTERLIVDQAVADEFVAKLGEKVRRLRAADPSQPDAPLGSLIDAGAGERIQALVDDAVGKGATLVAGGERTGSVMHRYCLTTSMRALKLYREESFGPVAVVLRASGHEGAAGPLANDSEFGLSAAIFSRDTQRALALAQRLESGICHINGPTVHDEATMPFGGVKASGFGRFGRTAAIDAFTQLRWDSVQHGAAHYPI

SEQ ID NO: 40570 - protein, 224 aa, Glycine max
MANIDIEGILKQQPDDGRVPKTKIVCTLGPASRSVEMTEKLLRAGMNVARFNFSHGTHDYHQETLNNLKTAMHNTGILCAVMLDTKGPEIRTGFLKDGKPIQLKEGQEITITTDYDIKGDQEMISMSYKKLPVHLKPGNTILCSDGTITLTVLSCDPDAGTVRCRCENTATLGERKNANLPGGAVDLPTLTEKDKEDILPWARTHPPSHRIASFIYLPKAPNFG

SEQ ID NO: 40571 - protein, 274 aa, Chlamydomonas reinhardtii
MADRGGERAERGERGSFGRGFGGRGDRGRGRGARRARGKKEDEEKWVPCTKLGRLVQQGKIKSLEQIYLFSMPVKEYQIVEYFLGSALKDEVMKIMPVQKQTRAGQRTRFKAFVVVGDFNGHIGLGVKCAKEVATAIRGAIIQAKMSVVPVRRGYWGNKIGKVHTVPTKVTGKCGSVTIRLTPAPRGAGIVAARTPKKVLQMAGIEDCYTCSRGSTKTLGNFVRATFNALSRTYGFLTPELWRESKYTKAPFQEFTDFLAKPHIGESKGEAYAY

SEQ ID NO: 40572 - protein, 431 aa, Medicago truncatula
MASSLPHLDDDSVSPSPRSNHFNDAPPRVRFMCSFGGKILPRPSDNQLRYVGGDTRIVAVNRSISFSALVHKLSKLSGMSNITAKYQLPNEDLDALITVTTDEDVDNMIDEYDRVTQSENPRAARLRLFLFPEGEDSRTNSISSLLNGSSKRENWFMDALNGGVSGLERGRSEASSMVSEVPDYLFGLDNNSELPESRPKEQQRHLLQQQDNVSNSDPGSPAPVVSSSPFCSTSSVLSVPSIPNLPPVKTKLDNQVSEPVFKGNQIETETVLQPQLKMDNYQINPAIHYQQPQPRPQPQEGAYSGHHAQPVPVYYIQGSVQPGNVPVHMQGHGHYPYVQQPYHQVMQPQVPIGYHQMIPGTGQVYGAGMRHVAPVQPYSPTTVVHDGLKQQVYQGVQNNSGPVPVYQAMVGTGGDELQRGGTGRGTNSPHN

SEQ ID NO: 40573 - protein, 717 aa, Medicago truncatula
MDLCSLACPSFVTPCDPRRTLPLPSSSSSHSQWGLHFFSHSQQHNKLKKKFGVVHASLSEMGEYYSQRPPTPLLDTINYPIHMKNLSTKELKQLADELRSDVIFSVSRTGGHLGSSLGVVELTIALHYVFNTPQDKILWDVGHQSYPHKILTGRRDKMHTMRQTNGLSGFTKRSESEYDSFGTGHSSTTISAGLGMAVGRDLKGRKNDVVAVIGDGAMTAGQAYEAMNNAGYLDSDMIVILNDNKQVSLPTATLDGPIPPVGALSSALSRLQSNKPLRELREVAKGVTKRIGGPMHELAAKVDEYARGMISGTGSTLFEELGLYYIGPVDGHNIDDLVAILKEVKTTNSTGPVLIHVITEKGRGYPYAQKAADKYHGVAKFDPPTGKQFKVAAKTQSYTTYFAEALIAEAKADKDIIAIHAAMGGGTGMNIFHRRFPTRCFDVGIAEQHAVTFAAGLACEGLKPFCAIYSSFLQRAYDQVVHDVDLQKLPVRFAMDRAGLVGSDGPTHSGSFDVTFMACLPNMVVMAPSDEAELCHMVATAAAIDDRPSCFRYPRGNGIGVELPTEYKGIPLEIGKGRILIEGERVALLGYGSAVQNCLAAASLVEQHGLRLTVADARFCKPLDRSLIRSLAKSHEVLITVEEGSIGGFGSHVAQFMALDGLLDGNLKWRPVVLPDRYIDHGSPADQLCMAGLTPSHIAATVFNILGQTREALEVMS

SEQ ID NO: 40574 - protein, 492 aa, Xanthomonas axonopodis pv. citri str. 306
MTAKPRLDFWQIWNMCFGFLGIQFGFALQNANASRIFQTLGAQVDDVPGLWIAAPLTGLVVQPVIGYLSDRTWTPWGRRRPYFMVGAVFTTLALLVMPNAPMLWVAAGTLWVLDASINISMEPFRALVGDQLPPSQRPTGYAMQSFFIGIGAIVASFLPWLLTHWGIANTAPPGQLPDSVRYAFYLGAAVLFLSITWTVLRTREYSPEQLAGFDDAHPPLAQAVSTGMVPTSMASVLWCGLGVLLAAAIAWQHGDRMLYVLAGLCFAYGVLLALARMLPATSMLVAIVQDVRSMPMTMRRLAWVQFFSWFALFAMWIYTTAAVTQVHFGASDTASAAYNDGANWVGVLFGAYNGFAALAAVVIPLLVRAIGLRWSHLCNLWLGAAGLLSMLVIRDPQWLLLSMLGVGFAWASILSLPYALLSDSVPAPKMGVYMGIFNFFIVIPQLVAASALGFVLRVWLGGQPIYALAIGGLSLLIAGVCVVRVPVASGGQ

SEQ ID NO: 40575 - protein, 453 aa, Staphylococcus epidermidis RP62A
MGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPQITDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 40576 - protein, 478 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 40577 - protein, 72 aa, Clostridium perfringens
MQKTKMIFTIGPSSDSGEILREFIRIGMNAARLNFSHGDHASHKGKIELIKRLRKEGKSATAILLDIKGPKI

SEQ ID NO: 40578 - protein, 273 aa, Staphylococcus epidermidis RP62A
MALYDFAKGLILEAGNKVRLMMQEELDIKTKSNPNDLVTNVDKATENYLYETILHNYPDHQVIGEEGHGHNLEYLKGVIWVIDPIDGTLNFVHQKENFAISIGIYHDGKPYAGFVYDVMKDVLYHAKVGQGAFENTHKLEMIQNTELKRSIIGINPNWLTKPILSDIFSSIVNEARSARAYGSAALEIISVAKGQLAAYLTPRLQPWDFAGGLLILNEVGGIGTNLLGDKLDFNQPNSILIANPSLHREILNHHLNQQRDTLITLHEKRFGKR

SEQ ID NO: 40579 - protein, 216 aa, Zea mays
MKLEVMPKPKQRVLEAQQREEAMEMSGLDLWKHEKPPRICPLPPSLPPPPPAFDEAALVPPLNFAVVDDGIFRSGFPGTANFRFLKSLNLRSIVYLCPEPYPGTNTEFLEKNGIRLHQFGIEGRKEPFVNIPDDKIREALKVVLDPRNQPLLIHCKRGKHRTGCVVGCLRKLQEWCLSSVLDEYHRFAAAKARITDQRFMELFDVSSLKHLTPSHC

SEQ ID NO: 40580 - protein, 307 aa, Synechococcus elongatus PCC 7942
MQSSFLSAVLLPLALVIIMFGMGLTLTVQDFRRVWIAPKAVAIGLIAQLVMLPLLGFAIASLTPLSPELAVGVIILAACPGGPTSNLFTFLAAGDVALSITLTAISSLITVFSIPWVVNLGLQAFLDQTSTFQLPFGPTVVQIAVVAIIPVVLGMLVRHYAPQLAQRTDRSLRWISTAFLAAVIVGFFAQERQNILAFFQSVGGVVLLLNLLAMALGVGLASLTRLGYARATTIGLEVGIQNGTLAIAIAASPTLLNNPAMAIPAAIYSLVMFMTGGIFVWLRQRYQPTRAVQTAAEVPAAVGSHLE

SEQ ID NO: 40581 - protein, 355 aa, Triticum aestivum
MAAATTIQSVKARQIFDSRGNPTVEVDIGLSDGSFARGAVPSGASTGIYEALELRDGGSDYLGKGVLKAVSNVNAIIGPALIGKDPTEQTDIDNFMVQQLDGTSNEWGWCKQKLGANAILAVSLAVCKAGAMVKKIPLYQHIANLAGNKTLVLPVPAFNVINGGSHAGNKLAMQEFMILPTGAASFKEAMKMGVEVYHHLKSIIKKKYGQDATNVGDEGGFAPNIQENKEGLELLKAAIAKAGYTGKVVIGMDVAASEFYSEKDQTYDLNFKEDNNDGSHKISGDSLKDLYTRPYLCPLTLMLFTNGSLKSHSSSGWRKGAMNPPLAASTWIGTSHPVSLLFATRRSFNSFTSSY

SEQ ID NO: 40582 - protein, 258 aa, Rickettsia conorii str. Malish 7
MNDNLINALKDLIINTGKIALDIKKAGMLTDIKSDGSVVTNADKEISKIIYQTLQTLTSQIAIVCEEQPLPIFSSDTFWLIDPIDGTWSYVNGKSTYTVNIGLIENGFPTIGLIYHPETAKLYYTDVNGRLKIEQNSKEIFVNHEPKHEELNAVIGFYNSNKATKEFLSKYSFGQINAIGSSMKLCLIAEGAADIYPKFGQTMEWDIAAGHALIKAGGGNILDTHGQEITYGKESFANPNFFACSKYWLEREARLHRY

SEQ ID NO: 40583 - protein, 257 aa, Arabidopsis thaliana
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLVNNSNRAGDMYERTHSAALRIM

SEQ ID NO: 40584 - protein, 419 aa, Microcystis aeruginosa PCC 7806
MIRDIFMPALSSTMTEGKIVSWVKSPGEKVSKGETVLVVESDKADMDVESFYDGYLAVILVEAGQEAPVGEAIAYIAETEAEIELAKAQGKTAAVAPSKPVETPEIAPPPVSIPVAAVKDNGRLVASPRAKKLAKELKVDLKTLVGSGPHGRITAEDVEKATGKVSTAPAPVITPPQPVSVPVAAPKAPIPASAPVGRTVPLTTLQKAVAQNMSVSLQVPTFQVGYTITTDPLDQLYQQLKSKGVTMTALLAKAVANTLAKHPIVNASYSDAGIQYHGAINVAVAVAMPDGGLITPVLRSANQMDIYSLSRSWKDLVDRARSKQLQPEEYNSGTFTISNLGMFGVDRFTAILPPNQGAILAVGASRPQIVVNQDGLFGVQKQMTVNLTSDHRVIYGADAASFLQDLAKLIETEVQSLTM

SEQ ID NO: 40585 - protein, 462 aa, Polaromonas sp. JS666
MSHFCPGYPKPREKRSSVWALFRSARNSWIDALYARSYSMQMGEVHLPGVDLYMVNDPALVRRMLSGQPDQFPKSPLLADALRPLLGDSILTTNGDQWQRQREMMNPAFAQAKLDVAFPVMRAAADDLVERLTEAAQRGSELNIEVELTHVTADIIYRTIFSEPLSGDDAHKVFDAFARFQALAPKLMLPSMYGVRWLVWPWNVWQSRRAASDIRRLLEKLIRSRHEAWLRGDDLGKNDILSALMTSRDRKTGEPFSFDELVDQVAVLFLAGHETSASALTWAVYLLSAVPEVQERVHQETCRVFGQRTPEQRDMKALVLTRNVFRETLRLFPPVGFMARESAQTCPMRDKMVPKGASVMISPWLIHRHRERWSDPDAFNPDRFDDDASRESIRQSYLPFGMGPRVCLGAAFALQEATLILASLIRAFRLETVTGHTPMPVGRLTIRSDNGVRLRIFKREDQ

SEQ ID NO: 40586 - protein, 315 aa, Microcystis aeruginosa PCC 7806
MITENSRLRSEFLNTQVITRNTGKKLGVVKDILVDIDQREVVALGLRDNILSLSGMPQYMYLSSISQTGDVVLVEDDNVLESVDIDAYTPLIGSEVITETGEPLGKVRDYQFDPLSGQLHSIIIASLGLPLIPEQLISTYEISIEEVVSSGPNRLIVFEGAEERLTQVSVGVLERLGIGRPPWEREEEEAYYTPAARPENQLGTGIPLRTPVEAAKPVEERWSEDEWEKEPLRANPPPQKRAEARYYEQEYEEEEDNWGEARSERTESFSRPQYDDYEDKAEDDMWDDDVEPDYNPPRINITEKKKERIPEYEDG

SEQ ID NO: 40587 - protein, 998 aa, Pyrus pyrifolia
MLLFLPLLLLLLPPLPTTLSLNQEGLYLQHFKLSLDDPDSALSSWNDADSTPCNWLGVSCDDASSSYPVVLSLDLPSANLAGPFPTVLCRLPNLTHLSLYNNSINSTLPPSLSTCQNLEHLDLSQNLLTGGLPATLSDVPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIAGATNLSLLILAKNKFSGPIPEEIGWVKNLMEFSGGDNKFSGPLPEGIARLGQLGTLDLHSNEVSGELPVGIQSWTKLNELNLASNQLSGKIPDGIANLSVLNYLDLSGNRFSGKIPFGLQNMKLNVFNLSYNQLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDVSDHGSVA

SEQ ID NO: 40588 - protein, 209 aa, Aspergillus oryzae
MANYLASIFGTEQDKVNCSFYYKIGACRHGDRCSRKHVKPSYSQTILMPNMYQNPAYDPKNKMNPSQLQNHFDAFYEDVWCEMCKYGEIEELVVCDNNNDHLIGNVYARFKYEEDAQKACDALNSRWYAARPIYCELSPVTDFREACCRLNSGEGCVRGGFCNFIHRKDPSNELDRELRLSTKKWLKERGRDARSVSRSPSPEPTRRRY

SEQ ID NO: 40589 - protein, 998 aa, Pyrus pyrifolia
MLLFLPLLLLLLPPLPTTLSLNQEGLYLRHFKLSLDDPDSALSSWNDADSTPCNWLGVECDDASSSSPVVRSLDLPSANLAGPFPTVLCRLPNLTHLSLYNNSINSTLPPSLSTCQTLEHLDLAQNLLTGALPATLPDLPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIAGATNLSLLILAKNKFSGPIPEEIGWVKNLMEFSGGDNKFSGPLPEGIARLGQLGTLDLHSNEVSGELPVGIQSWTKLNELNLASNQLSGKIPDGIANLSVLNYLDLSGNRFSGKIPFGLQNMKLNVFNLSYNQLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDVSDHGSVA

SEQ ID NO: 40590 - protein, 216 aa, Mycoplasma gallisepticum R
MMSDLLFSILPMLNDYDQNKLASYKQLGLNKIHYDVMDEFVNNKAFDERYVDNLKNLGYQINVHLMVNKVANHILVYAKTRCDQISFHVEPLANNKQLINKYLAYIKTNNKKAGLAFKFNTDVNDYLDQIKLVDYVTLMSVEPGAGGQAFNPLVYRNIAKLIKFNPKLEIEIDGGINLEKAIELKGLVSGFVSGSYFYQLSDQSKLEMLEKIRAFS

SEQ ID NO: 40591 - protein, 987 aa, Pyrus pyrifolia
LPTLPTTLSLNQEGLYLQHFKLSHDDPDSALSSWNDADSTPCNWLGVECDDASSSSPVVRSLDLPSANLAGPFPTVLCRLPNLTHLSLYNNSINSTLPPSLSTCQNLEHLDLSQNLLTGGLPATLSDVPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGPIPDELCRLPLESLNLYENNFEGSVPASIANSPHLYELRLFRNRLTGELPQNLGKNSPLKWLDVSSNQFTGTIPASLCEKRQMEELLMIHNEFSGEIPARLGECQSLTRVRLGHNRLSGEVPVGFWGLPRVYLMELVENELSGTIAKTIAGATNLTLLIVAKNKFWGQIPEEIGWVENLMEFSGGENKFSGPLPESIVRLGQLGTLDLHSNEISGELPIGIQSWTKLNELNLASNQLSGKIPDGIGNLSVLNYLDLSGNRFSGKIPFGLQNMKLNVFNLSNNRLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQATKKEGKLTPYYYEDVSDHGSVA

SEQ ID NO: 40592 - protein, 498 aa, Botryotinia fuckeliana
LAQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMIRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLF

SEQ ID NO: 40593 - protein, 496 aa, Botryotinia fuckeliana
AQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTALHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASL

SEQ ID NO: 40594 - protein, 501 aa, Botryotinia fuckeliana
AQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNGARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPR

SEQ ID NO: 40595 - protein, 228 aa, Schizosaccharomyces pombe 972h-
DRCGLLLERHAKIATDGQKPFLKKDSDFKEVPSGDIDLETAISLIKPTVLLGCSGQPGKFTEKAIREMSKHVKHPIIFPISNPTTLMEAKPVQIDEWSNGKALMATGSPLPPLTRNGKEYVISQCNNALLYPALGVACVLSRCKLLSDGMLKAASDALATVPRSLFVADEALLPDLDNAREISRHIVFAVLKQAISEGMSTVDLPKDDAKLKEWIIEREWNPEYRNFV

SEQ ID NO: 40596 - protein, 144 aa, Zea mays
GGFLPQGRFSVASVYAPISFPPLPLIVWKNREGGHPPLAAVGWLKRGDPARIFLKKIFLPGFPQGVWKRKSFGGYFFPNPGGVKGFNPVGLGTKHGCGGRLKGAVGSQGPRKCFFNSRLQPPVSGGRGLSKRGFPKGPEQFSPV

SEQ ID NO: 40597 - protein, 116 aa, Aspergillus nidulans FGSC A4
MGKLTSTIGIPIKLLNEAQGHVVTLEITSGVVYRGKLLEAEDNMNVQLKDITVTARDGRVSHLDQVYIRGSHVRFFIVPDMLRNAPMFRTRGQRGRGVGLARGKATVQRARGQRRG

SEQ ID NO: 40598 - protein, 365 aa, Thermoanaerobacter tengcongensis MB4
MALTQREKEILRLIKKNPMISQEELAKMLGISRSAVAGHIANLMKKGFILGRGYVVRDLKGVTVIGGANIDIKGKPYKELRQHTSNPGHINIAPGGVGRNIAHNLAQLNVPVTFLSVVGNDDEGRRLLEETRQAGVNVEQVVISNTRRTGIYLAILNAIGDMDIALSGMDILEELNIQYLESKTEVIKNSEIVVFDANIPEESIRYITELCYNNNIPVVVEPVSIDKAKKLKNVLDKIDYITPNKEELESITEIKILDDEDMKKAVKYLRDKGIKNVIVTLGERGVYVSSEELEKFIEPYQTEIVDATGAGDALTAGLVYGIFNGYSLEVSAKLGLAAASLTISSPYTVNPFLNENQLKNIVKEI

SEQ ID NO: 40599 - protein, 478 aa, Solibacter usitatus Ellin6076
MFANYINGEWIAAGATFENRNPANTDEVVAVMAKGSAADIAAAADAAGAAFPAWSAMSGPARGNILYKAADILDKTFDSVAADMTREEGKTLPEAKGEVRRAINILRYFAGEGSRLPGMLVPSERDRVHMFALRKPVGVVGLITPWNFPSAIPAWKLAPALICGNTVVIKPASAAPLSAWRIVEALHQAGIPKGVVNFIAGSGGELGQALVNAAPLKAVSFTGSCEIGDWLHAEASKRRLRIQLEMGGKNPTIVLADADFGSAVENVVNAAFFSTGQKCTATSRAIVEDAIYDKFVAAVVARTRKLKVGDGMQPGIDIGPCVDQSQMETVLRYIEIGRKECGEPACGGKRLTEGALAKGYFVEPTVFAGVTPDQTIAREEIFGPVLAIMRARDFEDAMSIANSIPFGLSSSIQTTNLSRAFEYIYRAEAGLLTVNLPSAGVEYQLPFGGTKDSSFGPKEQGPAALEFYSDYKTVYLKY

SEQ ID NO: 40600 - protein, 395 aa, Myxococcus xanthus DK 1622
MIRYIDDLQLTGKRVFIRVDFNVPMEGRRVTDDTRIREAMPTIRRALEMGGKVILASHLGRPKGPDPKLSLEPVAVRLAELLGGKHEVILTDDCVGDGVKKQVKELKDGQVVVLENLRFHKEEEANDETFARELAALADVYVNDAFGTAHRAHASTAGMVPFVKEKAAGFLMRKEIEYLGKVLKNPDKPFVAILGGSKVSDKIKVIESLLPKVDALLVGGAMAYTFLKAQGVEVGKSRVEGDKLSLATRLLEAAHRFKTQLVLPVDHIVGTEPTENSPATETPDNAIPPDMMGLDIGPKTRAIFAQHIRDARTVVWNGPMGLFEVPKFAEGTRSVAAAMAINTQATTVIGGGDSAAAVEQMGFADKMSHVSTGGGASLEFLEGRDLPGIKALETR

SEQ ID NO: 40601 - protein, 465 aa, Rickettsia conorii str. Malish 7
MSFLRKKSFESVKEIGSSSGLSKTLGAFDLILLGLGAMIGTGVFVVTGIIAAKYSGPAVMLSYAIAGITCIFVALVYTELAAMLPTSGSIYTYSYVAFGEVFAWMIGSVIILELGVAAGIVAAGWSGYVQGILAAGGINLPKELTTVPTNGGIINLPAFLISGFIGFILYLGTKDSKRLNAILVFIKMTAIFVFILAAAPHFDATNWSNFMPFGFSNVLVGASILFLAFTGFGTIATAAEECKNPKRDIMIGIIGSLVLTTIVYVTMAGLVTGIAPFDQLNNDQPLAYALTINNSKIGSAIVATGAVCGMMTVLMMNIYGTSRIFYAIARDGLLPKSFAKLHPKYDSPYITIIIFASLAAILGGFCSTELLTQLTSMGALIDYITVTIIVVLFRVTLPDAQRPFRCPLVFIIVPFILIACAYLLFIQIYDGEFNLLTAGRALIYWFITIFVLYIIRSFFMQKEQN

SEQ ID NO: 40602 - protein, 688 aa, Staphylococcus epidermidis
MKTRQNKYSIRKFSVGASSILIAALLFMGGGSAQAAEQQQDKGTVENSTTQSIGDGNEKLSEQQSTQNKNVNEKSNVNSITENESLHNETPKNEDLIQQQKDSQNDNKSESVVEQNKENGAFVQNHSEEKPQQEQVELEKHASENNQTLHSKAAQSNEDVKTKPSQLDNTAAKQEDSQKENLSKQDTQSSKTTDLLRATAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 40603 - protein, 171 aa, Arabidopsis thaliana
MLRQTTKRAFLGLASQNPTPFPVVSRLYHPNVIDHYDNPRNVGSFDKNDPNVGTGLVGAPQCGDVMKLQVKFDGSGQIIDAKFKTFGCGSAIAASSVATEWVKGKSVEEVLTIKNSQIAKHLSLPPVKLHCSMLAEDAIKAAIKNYKEKQDKANGETVETIDSTYLHGIGS

SEQ ID NO: 40604 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGAPLVEKILDTAGQKGTGKWTGINALDLGIPLTLISESVFSRCLSALKDQRVEAEKLFGK

SEQ ID NO: 40605 - protein, 284 aa, Aspergillus oryzae
MTTLAFIGCGNMGSAILDGLLEATRSEPQKSKIEYFIATTKSAASAEKLSEKYRSDPSRVLVASGSNVKVMEQSDIVLLACKPFLAQSILSEPGVAKALKGKFVISVMAGKTPAEIMEYIYGDSAQAMNRPVIVTAMPNVAARLRQSMTIIEENPALSKDRAEILTWIFEQIGTVKFVAPDLVNAGSMVSGAAMALLTLAVDGIMDGAVMEGFRRPDAMEVSAQVLEGLAGLLREGVHPAVLRESISSPRGCTIQGLYALEKNGVRGAYAEALVRGVKHLRGEN

SEQ ID NO: 40606 - protein, 400 aa, Arabidopsis thaliana
MATMISNLPRDLIEEIFSRVPLTSMKAVRLTCKSWNNLSKSESFTKVHIGRAATREEKTMIVDVMPHKLNLMSIVIDDVTPSAEFKGQFSLLHKNYRINQVLHYEGLLLCIMKDPTRIVVWNPYLGQTRWIQLRYFHRPHGIDHFRYALGYADKESCSSLKFLRFLDYFYKAPEEEFFWYEIYDFDSGLWTTLNVTPHWGIYSTCPCVSLKGNTYWPAKERSTQGFQDYIIRFDFTRERFGPLLALPTDRESSFVSLSCVKEEKLAALFKHRLHHDSYEYEFEIWITTKIEVEMVSWSKFLRMDMRPKMELPLTFYIDEEKKVFMGFDHGEYPKLLFLNVVGETGFLRKFENIQYRSPCSYVPSLVQVKKLARDRLRKQRSLENRRFAQNILRLARNGKS

SEQ ID NO: 40607 - protein, 237 aa, Acinetobacter sp. ADP1
MSAPKLSLCVEDTGYEIAFAGRSNAGKSSAINSLTNQKQLARASKKPGRTQMINFFSLGNPDQRLVDLPGYGYAAVPEDMKRIWQKELENYLIHRQSLQGLVLLMDIRHPLQHFDTMMLEWAHSRKLFVHILLTKADKLNRGPANQVLLDVKQTLKKMKLSFSIQLFSSLNKQGLEELASVMAGRLNYTLDKTLDFDLDAIPEATEDDLNDELMDQDETSEFNTENIDDHLDQEPKI

SEQ ID NO: 40608 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGK

SEQ ID NO: 40609 - protein, 270 aa, Oryza sativa Indica Group
MDSEHWISSLAAAKRFYAAQLGHVDDMAGIGMEEVEMEMEDDGEGMELELEMQLEEATWPDVACPYCYEDHDIASLCAHLEEDHPYEPHTAAYFCKQATGVDFAMAQNNLEKLMMPCPICFEKITRDMLNHITMQHGYLFKSGRRMRRFVIPESQALSLLSRDLRDAQLQALLGGGHRQRRSNTTATNISADPLLSSFGLGFSTLDSEERSKAPVPIRDDTSIHKDTPAQPWESRIDSSLTSEEREQKRKQATDRATFVQGLVLSTLFED

SEQ ID NO: 40610 - protein, 494 aa, Pseudomonas aeruginosa PAO1
MIDLNPIQPICIAGEWRAGGGDLYESLYPATGEAVARLHAASLEDVEEAMAGAHRAFRESGWAQRKPHERATVLYRIAALIRERSEELAQLQRLDNGKPIRETRNLVASAAATFQFFAAACETLEESITPSRGDFVSMSVYEPMGVVVAITPWNSPIASEAQKLAPALAAGNAVVVKPAEITPLAALALARICDEAGLPRGLVSVLPGKGALIGDALTRHPLARRVSFTGGTRTGKHIARIAADKMMPVSLELGGKSPTMVLADADLDHAVAGVLYGIFSSSGESCIAGSRLFVASERYDEFMERLATGAAALRVGDPADERTQMGPLISARHRESVERYVEMGVAEGGRLRTGGLRPHGGAFDRGYFYTPTIIEGLTNGARLCREEVFGPVLVAMPFASEEALIEEANDSCYALAAGIWTRDFQRAWRLGRAVQAGTVWINTYKQFSISTPFGGWRDSGLGREKGRLGILQYMEQKSLYWGLNEQPLAWAGSH

SEQ ID NO: 40611 - protein, 313 aa, Pseudomonas syringae pv. syringae B728a
MIGTPRSLDCEDAMTLQYQTIADCVGNTPLVRLQRMAGNTSNTLLLKLEGNNPAGSVKDRPALSMITRAELRGQIHPGDTLIEATSGNTGIALAMAAAIKGYRMILIMPDNSSAERKAAMTAYGAELISVSKDDGMEGARDLAERMQAEGRGKVLDQFANGDNPEAHYTSTGPEIWRQTGGTVTHFVSSMGTTGTIMGTSRYLKEQNPDVQIVGLQPMEGASIPGIRRWPQEYLPKIYQSDRVDRIIDMGQSEAEDTMRRLAREEGIFCGVSSGGSVAGALRISREVENAVIVAIICDRGDRYLSTGVYDSPN

SEQ ID NO: 40612 - protein, 287 aa, Triticum aestivum
  misc_feature (14)..(14): Xaa can be any naturally occurring amino acid
  misc_feature (58)..(58): Xaa can be any naturally occurring amino acid
  misc_feature (177)..(177): Xaa can be any naturally occurring amino acid
AAASTIMKDISQGXERIPVSVLNSISDEHPMPYIYMSRLKYPPNYQPAPPAGCACVGXGCSDSKLCACVVKNGGEIPFNDKGCIIAAKPLVYECGPSCKCPPTCHNRVGQKGIKFRLQVFKTKSMGWGVKTLDYIPSGSFVCEYIGEVLDDEEAQKRMTDEYLFAIGHNYYDESLWXEGLSRSIPSLQNGPGKDEETGFAVDASKMGNFAKFINHSCTPNLYAQNVLYDHDDKSAPHIMFFACEDIPPGQELVYHYNYAIDQVHDENGNIKKKKCLCGSVECDGWLY

SEQ ID NO: 40613 - protein, 360 aa, Zea mays
MAPVDLTPKQPRKAYGGDGGAYYEWSPADLPMLGVASIGAAKLSLAAGGLALPSYSDSAKVAYVLQGTGTCGIVLPEATKEKVVAVKEGDALALPFGVVTWWHNGPAAPTPLTVLFLGDTSKGHRPGQFTNFQLTGATGIFTGFSTEFVSRAWDLPEADAAALVSSQPASGIVRASSSPLPAPSPRDREGVALNCLEAPLDVDIPGGGRVVVLNTANLPLVKEVGLGADLVRIDAHSMCSPGFSCDSAYQVTYIVRGSGRVQVVGPDGVRVLETRVEGGFLFIVPRFHVVSKIADASGMEWFSIITTPNPIFSHLAGKTSVWKAISAEVLQASFNTTPEMEKLFRSKRLDSEIFFAPPSN

SEQ ID NO: 40614 - protein, 368 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISAISSPNSCDENMTKATKPLEPQKDEKQLVPEEALIVLAGPLTRSKSKKFNQAINGLLKELKKNQEDVTQSSFIVITAQEAR

SEQ ID NO: 40615 - protein, 491 aa, Aspergillus oryzae
MADQAVADFGLIGLAVMGQNLIMNVADHGFTVCAYNRTTSKVDRFLENEAKGKSIVGAHSIEEFCAKLKRPRRIMLLVMAGKPVDQFIESLLPHLEKGDIIIDGGNSHFPDSNRRTKYLAEKGIRFVGSGVSGGEEGARYGPSLMPGGNEEAWPFIKDIFQSIAAKSEGEACCDWVGDEGAGHYVKMVHNGIEYGDMQLICEAYDILKRGVGMPVNEIAEVFDKWNKGVLDSFLIEITRDVLRFNDDDGTPLVEKILDKAGQKGTGKWTAINALDLGMPVTLIGEAVFSRCLSALKDERVRASSLLPGPTPQFTGDKQAFVDDLEQALYASKIISYAQGFMLMQEAAKEYGWKLNKPSIALMWRGGCIIRSVFLKDITNAYRQNPDLENLLFDKFFNEAIAKAQNGWRNVVSKGALWGIPTPAFSTALSFYDGYRTRDLPANLLQAQRDYFGAHTFRVKPEHANETYPEGKDIHVNWTGRGGNVSASTYIA

SEQ ID NO: 40616 - protein, 411 aa, Oryza sativa Indica Group
MALYSTDSKKVGFLSFLNFFHNSTAFSNLIGCCLFILPSYLVGYYIEHHHLVSPFIPENQYICCISSIIKPGLSSSVAHLLVCLSSCLQQTMDADRDPIFPVQQMPSLLFPPPPPRPLALDSTSSASSSFVPHHTSITSFPILVLTVLGILTTSVLLLTYYIFVIRCCLNWHSSSSSNTRTAGLISRRRRGAASSSLPEVAEPRGLEEAAIQSLPAFRYRKAIKDTTADSSECAVCISEFQEEERVRLLPSCLHVFHVDCIDTWLQGNANCPLCRAAIATNDSQLPLDQFVRPEEVVIQVITGAEEEGAQAPQQEANTAASDPAVDATSTNQQVSSKKTKNQNAWHVSISKGDECIAVRRDRNVLPLRRSFSMDSLGGAGEVHLQIQNILQRSTHFHGDISDSSSSSTGTL

SEQ ID NO: 40617 - protein, 328 aa, Gossypium hirsutum
MDVSCFSQNVLLVTLLLAIAVSLVESQGTRVGFYSTSCPRVESIVRSTVQSHFGSDPTIAPGLLRMHFHDCFVHGCDASILIDGPGTEKTAPPNLLLRGYEVIDDAKTQLEAACPGVVSCADILALAARDSVVLSSGASWAVPTGRRDGTVSQASDAANLPGFRDSVDVQKQKFAAKGLNTQDLVTLVGGHTIGTTACQFFRYRLYNFTTTGNGADPSITAAFVSQLQALCPQNGDGSRRIGLDTGSVNRFDNSFFANLRDGKGILESDQRLWTDASTKTFVQRFLGIRGLLGLTFNIEFGRSMVKMSNIEVKTGTVGEIRKVCSKVN

SEQ ID NO: 40618 - protein, 238 aa, Prochlorococcus marinus str. MIT 9303
MADLQTQMKQAVAAAAVEQIKDGMVLGLGSGSTAALMIQALGAKLASGELREIVGVTTSFQGEVMAAELGIPLRNLTAVDRIDLAIDGADEVDPSFQLIKGGGACHVQEKLVASRADRFVVVVDSTKIVDRLNLGFLLPVEVLPGAWRQVQGRLAELGGIADLRMAQCKAGPVVTDQGNLVLDVSMAGGIGDPEDLECRINNLPGVLENGLFVNLTDEVLVGQISDGVAGVRRLQRRE

SEQ ID NO: 40619 - protein, 516 aa, Aspergillus oryzae
  misc_feature (153)..(153): Xaa can be any naturally occurring amino acid
MPSEDQNQQFKRIGIVGAGNMGSMMAFAFSELGLDVSIWDVKKENVDQLLQSAKDIKGQGKIEGFEDIGEFTQSLEGQGERKLFIFSITHGDPADSVLSKIKHALKKGDIILDGGNENYRRTERRQKECEEIGVSWIGTGVSGGYQSARRGPXLSPGGDEKALELVLPLLERYAAKDRKTGQPCVARVGPAGSGHFVKMVHNGIEGGMLSAVAEAWSILHYGLGLKYDEIGDIFDEWNQKGELRNNFLLDIGADVCHRRKSPEGDGKGEGIGEKNEYVLDDVLDKVVQDDDDTEGTPYWCVMETANRHVSAPTIATGHYMRIASGNRAERLRVAEKLRMPKPKPIEGIKDRRLFIEDLRRAVYCCFLSSFCQGLELIARASDDEGWNIDLSKCLQIWRGGCIIQSEAIADLLQPLLKKDVHYTNLKDIDEVARALKHNFDSLKRIVIDSTVFDQYIPAISATLEYLKYAGGTMLPTKFMEAQMDLFGAHAYYKPGVPGEDPGPVKKGPHHYEWRPA

SEQ ID NO: 40620 - protein, 513 aa, Zea mays
MERRRRRPPRLPLLVFVLVATTCPLGSSGIGSFGVGAESNGASSSFRNSRTRSLLQIGDRNEDGLFHLPHTRALTHKSRSHRKVPTPAPAPESAPAPSPSMSPPDSSPSPSPHGSHPMPRQSTSHRHPSITPPHLVRPGPRQDGNDPLVYTPAHSRHKHFWTTYGLVAAGIAVFLLVSAASILCFRAKKMGTVRPWATGLSGQLQKAFVTGVPSLKRSELETACEDFSNIIGSTSTCMLYKGTLSSGVEIAVASSLVTSAKDWSKENESQYRKKITNLSKVSHKNFMNLLGYCEEEHPFTRVMVFEYAPNGTLFEHLHVREAEKLDWMARLRISMGIAYCLEHMHQLQTPAALRNFDSTTVYLTDDFAAKVSDLEFWNDAKGHNSTTNNELAFSLDMEDIVRKYGMVLLEILTGRVPSSEDDGPLENWVSRYFEGGMRLEELIDPSIGFFPEDTARALCEVVRSCIDRDPKKRPQMKEVAARMREITALGPDGATPKVSPLWWAELEIMTSES

SEQ ID NO: 40621 - protein, 387 aa, Oryza sativa Indica Group
MGFNLLLVPLLLVWCEWMEMFFSSFLNESASSENLFGHPNVERCPFLRNINGATTYSFSSALPVAARGGNGPIFEDGPGFDSAFKLFHGRDGIVPLSGKSYLPDENNSESIDANPEPALLFNPLAARAATISLSAFGPFGFNFFNGKGKRQNKKPNNLNQSNKKPSNPNQNSMKQKGGNSSSHEAMSNEWMENGQCPLARSYRAMSGILPLVAKALQPPAGVKLKCPPAVVAIRAALARTELVKSLRPQPLPAKMVAIALLGMAANIPLGVWREHTKKFSPQWFAAVHAAVPFIGMLRKSVNMPKTAMAFTIAASIIGQTIGSRAERIRLKALAAKGDADSTTVADMYPNKSGNCSDTEGKAWDPLAMKMAGRASGGVAAPTPSMCF

SEQ ID NO: 40622 - protein, 647 aa, Gibberella zeae PH-1
MGVPSEREAGDGPPASSASNPRRTPGNQSYARVAAQGTDEQSPLLRHDADTDNAHGEHDDSQTTKSIWYLLLLTISIGGLQIAWSVELSNGSPYLLSLGLSKSLMALVWIAGPLTGTLVQPYVGMLSDNCRMPMGKRKPFMIGGSVATILSLLFLAWAKEIVACASNIIGFDPESQGVKTTTIVVAVVGVYVLDFAINTVQASIRAFIVDCAPAHQQESANAMASRITGFGNIVGYIAGYVDLTRHLGFLGKTQFQILCAIACVALALTVFVSTALIKERDPRLDGPAKKQEHGVISFFLTIFKSIKRLPPQIKRVCEVQFCAWVGFFPLLFYTSSYIGEIYVEPYLEANPHMPPEQLNKLYEQATRIGTFALLINSVVSLLTNVFLPFFIAPTYDSQPVNNVPGETPAAGHYDEDEDDKPSWLDKLAIPGLTLKRAWFLSLLLFAGCMFATLFVRTVKAATVLIGLVGITWAMTLWAPWAIISAEISRRDALIRAQRTRQATARANNGGIRGDEEEEEIDQAGVILGIHNMAIAAPQIIATVGSSVIFKLWQKPRGTPGDHSISIVFALGGICVLVSSFFVAKIKDDAAMPADVMIEAEEGQSGAAEVVERRPLNRRKSTRDQLPRATQARANLTRNKSFGGAEMY

SEQ ID NO: 40623 - protein, 649 aa, Aspergillus nidulans FGSC A4
MGFASKIANAQMSASNSGGVYGGAPPTSYTGGPPTGAGSQAGGYQPQQAPQQQQPPQQYQAYPGGSSSSSPLPSENMSRPYPNQGYPPPAGPPPQLRPGQAPSPYPPGPSPQPQQQQQQYQAYPPVPPNKPSPSPAYSGAPQTYSPAPYSPHTPHPQSYSPAPPQNYSQPPPPQPYGAPGPGPNYPPPQPHASGYPPQNAPYPPGPPGPPHAQAPGGQYGPPSGAGGAVGPATQQQLNAYRQLLISTIQEKSLQHFYPPDKLDRLVQGLSRDGPAKVNKIVNEFALPTEIAMDVIKLSLYDIVLYVDDSGSIEFEEKGVRKEQLKQILGIVATIASTFDEDGISLRFMNNDFMQNNIRSAQDVEQIISNIRFSGMTPLGSALRSKVLDPMIVGPARAGRLQKPVLVITITDGQPAGEPLDSVAQGIRYAVDEVSRSPFGRGAVAFQFSQVGNDTKARDFLGSLDNDPSIGGLIDCTSNFEVEQDEMSRANPPVHLTRELWCAKLMLGSIDSSYDTKDERGSGPSGAPPGPPPGQYGGYGQSGPGYGSSAPYNPGQQQPYSPAYPPHSQAPGGYAQPPPQGQYGGYSQPGPGYGSPAPYSSGQQQGYGSAPYPPSSQASGSYGQQQYGQRPGSQPGYPGQQPPYGQQPRY

SEQ ID NO: 40624 - protein, 470 aa, Escherichia coli O157:H7 EDL933
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 40625 - protein, 407 aa, Zea mays
  misc_feature (233)..(233): Xaa can be any naturally occurring amino acid
  misc_feature (252)..(252): Xaa can be any naturally occurring amino acid
MTDGSDEYKRDESVILLVIVSLAALSLLSLIAAFAYYCYITRKVSRRLQSLHLPKRSSSPPPPPPPRALPPPQQQGKDSPFSSSASDGAAAAAAAMSVVVAGERGVQVFSYRQLHAAMGGFGRAHMVGQGSFGTVYRGVLPDGRKVAVKLMDRPGKQGEEEFEMEVELLSRLRSPYLLGLIGHCSEGGHRLLVYEFMANGGLHEHLYPTRGSCGGISKLDWDTRMRIALEAAXRDFKSSNILLDKDFHARVXSDFGLAKLGSDRAGGHVSTRVLGTQGYVAPEYALTGHLTTKSDVYSYGVVLLELLTGRVPVDMKRPPGEGVLVNWALPMLTDREKVVRILDPALEGQYSLKDAVQVAAIAAMCVQPEADYRPLMADVVQSLVPLVKNRSNQKACNPNVQSSKPLD

SEQ ID NO: 40626 - protein, 403 aa, Zea mays
MQADSFRCHYRTSLYKKAGWYRSGGHRTTLHPACTPSLWDDYGRRRSRPHLRQVPRHSLASSPVTRTYQTWSKPLNMSWAAIENDPGVFTELLQQMQLKGLQVDELYSLDLDALNDLQPIYGLILLYKWRPPEKDERPVIKDAIPNLFFANQIINKACATQAIVSVLLNSPGITLSDELKKLKEFAKDLPPELKGLAIVNCASIRMLNNSFARSEASEEQKPPSGDDDVYHFINYVPVDGVLYELDGLKEGPISLGKCPGGVGDAGWWLRLAQPVIKEHIDLFSQNEIRFSVMAILKNRKEMFTVEIKELQRKREGLLQQMGDPNASRHVEQSLAEVAAQIESVTEKIIMEEEKVKKWKAENLRRKHNYVPFLFNFLKILEEKQQLKPLIEKAKAKQKSHGPS

SEQ ID NO: 40627 - protein, 399 aa, Geobacillus stearothermophilus
MNLEQIRKDTPLHKKYSYINTAAASPPPQQVVDAMTDYLQKTASLGPYLPAFRKEIYAKVDEIRGKVAEFIGASSKEIAFSKNGTEAINFIVNGLKWNEGDEVILADLEFHSNFVPWLKLQSEGKIKLKVLKTDKSGVISVQELEKMINPNTRMITVSHLPNASGALQPVEEICKVAKKHNVLTLINASQTLGLVPIDVKKLDCDFLAACGRKWLRGPEGSGILYIREELIDYIEPTLIGWGGTVWDFDTNEFSYLPIAKRVEAGCPVIPSILGLGAAVDYAWAIGIESIYQRVKDLTEYTVKQLSTIPGISIYGPEDIKNRLAIIPFNVKGLTPERITEFLEENHIIIEAGTFMANTMLQQYRINKMARFSPHYFNTKEEIERAVDLIKTLIRKEGQQ

SEQ ID NO: 40628 - protein, 258 aa, Archaeoglobus fulgidus
LRYNLWFGVYDGKEIKLSENFEESFLKAENPSPLPFNVSEVGAKALGKDYYRILRKTALAVSEKMVEKELRREDRYVVALVKALEEIDESINMLNEKLEDIRAVKESEITEKFEKKIRELRELRRDVEREIEEVMEKIAPNMTELVGAKVAAKLLERAGSMERLVRLPASKIQVIGAEKSLYKAFARMKKGKKAKIPKHGIIFLHPFIRTLPKAKRGKMARFLAAKLAIAAKIDYFRGEIDESLYESIRRRYEELRRK

SEQ ID NO: 40629 - protein, 77 aa, Glycine max
  misc_feature (9)..(9): Xaa can be any naturally occurring amino acid
NGRSTSEGXIRNGLLIAALFAGQHTSSITSTWTGAYMLRFKQYFTEAVEEQQDVMTRHGDKIDHDILAEMDVLYRCI

SEQ ID NO: 40630 - protein, 483 aa, Prochlorococcus marinus str. NATL2A
MPARFSQQNQRVRPNSNEDKVVARAKEHFEKTLIQISGDIAGSVAALEHPTKNDALNYGEIFLRDNVPVMIYLLTQKRYDIVKKFLTVSLDLQSTTYQTRGVFPTSFVEEKGKLIADYGQRSIGRITSADASLWWPILCWLYVRKSGDQSFGTSQQVQRGVQLLLDLVLHPTFEGNPVLFVPDCSFMIDRPMDVWGAPLEVEVLLHASLKSCIQLMELSRKHQKSRLLDQRLVLTRQWVHDLRQFLLKHYWVTSKTMQVLRRRPTEQYGEDQHQNEFNVQPQVVPSWLQDWLENRGGYLIGNIRTGRPDFRFYSLGNSLACMFGVLTAPQQRALFRLVLHNREHLMAQMPMRICHPPMDIEEWQNKTGSDPKNWPWSYHNGGHWPSLLWFFGASILLHEKRYPKADVLLMGQMRALIEECYWSQLNQLPRQKWAEYFDGPTGTWVGQQSRTYQTWTIVGFLLMHHLLRAEPDDVLMLDLEEEF

SEQ ID NO: 40631 - protein, 313 aa, Spirulina sp. PCC 6313
NGFGRIGRNFLRCWAGRTDTNIELVGLNDTSDPRTNAHLLKYDSMLGKFAGDVSADDTTITVNGKTIKTVSDRNPDNLPWKDWGIDLVIESTGVFIDKVGASRHINAGAKKVLITAPGKNEDGTFVVGVNEDQYNHDIHNIISNASCTTNCLAPVAKVLLENFGIVKGVMTTTHSYTGDQRLLDASHRDLRRARAAALSIVPTSTGATKAVALVLPELAGKLNGIALRVPSPNVSVVDFVVQVEKKAIAQEVNEAFRAAAEGPMKGILEYNELPLVSIDYRGTDASSIVDSSLTMVMGGNMVKVVAWYDNEWG

SEQ ID NO: 40632 - protein, 472 aa, Methylobacillus flagellatus KT
MNRAQAHQQGWKDYLKDCSEILEIVESLEVSGRITKLTGLVMEAVGIKLPIGSACYVPLAEGRRVEAEVVGFDGGRMLLMPQSGVEGVVPGAKVFALEVADALPKPNQAKHPRRRAIDRARHLPVGEALLGRVIDAAGRPLDELGPLNSEHSVPLNTRPLNPLSRAPIEEVLDVGVRAINSMLTVGRGQRMGLFAGSGVGKSVLLGMMARYTTAEVIVVGLIGERGREVKEFIEQILGPEGLARAVVVAAPADVPALMRLQGASYATAIAEYFRNQGKDVLLIMDSLTRYAMAQREIALAIGEPPATKGYPPSVFAKLPALVERAGNGKPGEGSITAFYTVLTEGDDQQDPIADSARAILDGHIVLSRSLAESGHYPAIDIEQSISRAMHNITSPEHQKNARKLKQLNSRYTRNQDLINVGAYESGSDPVLDEAIMRHEAIEAFLQQDIKESASWTDSVDALASLVGTAGAN

SEQ ID NO: 40633 - protein, 459 aa, Prochlorococcus marinus str. NATL2A
MSLENFVLHQLQDLVLSGKTRNEKWRRAQLKSLSTLLENHQQEILKALSQDLGKPATEAFFEIIAVKQEIKLAQKSLSNWMKTRQINVPVSLKPAQALVQPDPLGCILIIGPWNYPFSLTLQPLVGALAAGNTAVLKPSEHAPNVSNLIKKLIEKYFPPEIVQVFEGDGNIAADLMTRQFDHVFFTGGENIGKKVMEAASKNLTPVTLELGGKSPAVVIDGANLEVTSKRVIWGKSLNAGQTCIAPDHLLVEDKLFDSLISNLINSINDFYGNTPLDSKHLGSIINEKQFNRLNNLLTQAKKNNQIIYGGDSNEKEKRISPTLIKIDNRNDPLMKEELFGPLLPILSIKNLDQAISDFKLLPKPLALYLFGGGEKEQGKVLSMTSSGGVCFNDVVLQAGIPELPFGGVGTSGMGKYHGKAGFDNFTHYKSVLKRPFWLDLNFRYPPYKLDLSLLNKLIG

SEQ ID NO: 40634 - protein, 513 aa, Lactobacillus acidophilus NCFM
MSLLTVKDLGQSFIDKTLYEDANFVLNKEDHMGVTGQNGVGKSTLIKILTGEILPDNGQVKWQNKIDVGYLDQYAKLAPGVTIRGFLRTAFDDLFQKEKELNELYTKYAETSDEDLLEKAGKVQTYLEENNFYDIDTEIEQVASGLGLADLGYDHDVSKLSGGQRSKIILGKLLLQNPDVLVLDEPTNYLDVSHIDWLVDYLNNFEGAFIVVSHDYDFLGRITNCIIDIDFGTITRYTGTLKQAMRQKAANRETYLKAYANQQRKIAKTEAYIRKNKAGTRAKSAKSREKQLARMDVLTPPKNNRRAKFEFPYVATASNLLLQTQDLVIGYDQALVKSAFNFSVGGDEKVAITGFNGIGKTTLLKTLLGQLKPIYGSYDLSVTAKLAYFKQDLTWPNNNMTPLQYLQEEFERKKPKELRQALARMGLTAQQAMSPLKELSGGEQEKVKLAKMQFEPANLLFLDEPTNHLDNDTKDALRKAIINFSGGVIIVSHERDFFRGDWIDKTIDIETMN

SEQ ID NO: 40635 - protein, 470 aa, Polaromonas sp. JS666
MLIPVILCGGAGSRLWPVSRELHPKPFMRLADGQSLLQKAFQRGAHLPGVKEILTVTNRELFFKTEDEYRPVNPRGLLTSFLLEPFGRNTAAAVAAAALQVQRTHGDGAVLLVLPADHLIADQAAFADAVVQARALAEQGRVVTFGIRPEGPETGFGYIEAEGHDVKRFVEKPDLETARQYLASGRYWWNSGMFCFTAGAMLAELEQHCPRILAAARKCLEQSRTATGKGLQQTELDAESFAEVPDDSIDYAVMEKTRRISMVPCALGWSDIGSWTAVGELSEADGCGNRVQGHALMHDTTDCYIQSQDRLVGTVGVADLIIIDTPDALLVANRHSSQNVKQIYAQLKTLGHDAHKVHRTVHRPWGTYTVLEEGPQFKIKRIEVKPGAALSLQMHHHRSEHWIVVSGTASIVNGEQDILLLTNQSTYIPAGHKHRLINPGVIDLVMIEVQSGAYLGEDDIVRFEDDYGRV

SEQ ID NO: 40636 - protein, 241 aa, Brassica napus
  misc_feature (224)..(224): Xaa can be any naturally occurring amino acid
  misc_feature (233)..(233): Xaa can be any naturally occurring amino acid
ERTGAAVTLKRSETERARPLLASEERAYEDTEKVHIVGVDEEDGADYDDELGNSPRFSWKKLWLFTGPGFLMSIAFLDPGNLESDLQAGAIAGYSLIWLLMWATAIGLLIQLLSARLGVATGRHLAELCREEYPTGARMVLGIMAEIALIGADIQEVIGSAIAIKIWSNGLVPLRPGVVITAWDCFIFLFLEYYGIRKLEAGFAILMATMALAFAWMFGQTKPXGTELLVGAXVPKLSSAQ

SEQ ID NO: 40637 - protein, 853 aa, Candida glabrata CBS 138
MGEERSNLFPGRNNIEVVISDDDLDDDYIDDGDGISIKPANSIDTGVLRSIIEEEGWYDTGRYYDEVRNHRFYVTERYMDKRKIGLADMLNSSSILSLNYDNHSMNDFERYDKKVRKEAELRDVLEDILKKQNNDGLQVVEDSILHEKYTSPNTETNNKKNSCARLRLNVLKSAFQGAYSKSANPSRSKNAHTNNDIRNNFDNMSSRTYVIDNASDGNVAIDENIDYETMKRSVSIDGNVHSNFYDSDQEKKGKRYIHEKINKYLHDSTRRRNQLQRNLKVRHIQMLAISACLSAGIFMTSGKAFSIAGPFGCLLGFIITGTVVIATMMSFAELATLIPVSSGFSGLASRFVEDAFGFALGWTYWFSSMVALPAQVVSSTFYFSHYDHLKLTRGGTAGFVTLFSLFPLVLNLFDVRFLGEFVYIVGLSKVLITIMIVIVMLVLNAGHGFDVHGRVSFRYWDAEKSRNLKDITYGLFRPTFDLSDAGLGSINGIGGNRGRFIAVVSVMLVSTFAFSGVEMTFVASGEAKNPRKTIPSAMKRTFIFIFTIYFFLIFSVSINIYTGDPRLLSYYTGALESRYHNIENKVSNEWQVSYRCEEVLHGVNPGDVQAGFSSPWVLALENFGFCSFAAGFNAVLIFFTSSATASSLYASSRTLYAMSIQRKAPAVFRLCDRRGVPYVAIGFSSLFAIVAYLAVDDAAISNFDVLMNISSAATSIIWLGLNVAFLRFYYALKKRRDIISRDDVFYPYRSPFQPYLSMFGLLGCSIFVLFMGFINFIHGYWNTKSFFSSYGGLILFGVCYLGYKLISTSKIQRLDQLDLDTGRREIDRILWTEHRQYRGPYSERLKKLYNWLI

SEQ ID NO: 40638 - protein, 101 aa, Zea mays
  misc_feature (27)..(27): Xaa can be any naturally occurring amino acid
  misc_feature (36)..(36): Xaa can be any naturally occurring amino acid
PYAPKTFNEALGPPKTVIWNGPMGVFXFKSFQLALXGISKKLVWLSPPKGVPSIIGGGDFFFSVKKVGLAPKISPIFTGGGGSLELLEGKTLPGGLAPDNA

SEQ ID NO: 40639 - protein, 219 aa, Burkholderia thailandensis E264
MAFLLHQARFFTTVNHLRDLPPTVQPEIAFAGRSNAGKSTAINVLCNQKRLAFASKTPGRTQHINYFSVGPAAEPVAHLVDLPGYGYAEVPGAAKAHWEQLLSSYLQTRPQLCGMILMMDARRPLTELDRRMIEWFAPTGKPIHSLLTKCDKLTRQESINALRATQKSLDAYRDAGYAGKLTVQLFSALKRTGLDDAHALIESWLRPAAADEDHAAVAE

SEQ ID NO: 40640 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKEQRVEAEKLFGK

SEQ ID NO: 40641 - protein, 211 aa, Dehalococcoides ethenogenes 195
MLSDSSKQIKKEVEAINSDFKTIVGCGESKCPKLKRLKLASTPDIILKVMIEIPKGSQNKYEYDKERKVIKFDRMLFSAVHYPSDYGFIEDTLAEDGDPLDALVLVWEPTFPGCLIETKPVGLFKMYDEKGPDAKLLCVPIGDPHFNFIRDLSDVPPHLLKEIFHFFNIYKELEAKKTGVEGWEDRESAIKTYWESHQRYLDSLKNKPEQK

SEQ ID NO: 40642 - protein, 112 aa, Glycine max
  misc_feature (58)..(58): Xaa can be any naturally occurring amino acid
  misc_feature (72)..(72): Xaa can be any naturally occurring amino acid
TGPDCLGCPSRPFGFDKTTEGGIWPIYHKNTASAGKVLFKVTLTSHPNLPFKEFIVPXAAPFTAVLKLRRLXFKVPPQTSAIITNYGFGIFSHFTVFSISPMHGSDLDLIPY

SEQ ID NO: 40643 - protein, 401 aa, Triticum aestivum
  misc_feature (158)..(158): Xaa can be any naturally occurring amino acid
  misc_feature (186)..(186): Xaa can be any naturally occurring amino acid
  misc_feature (253)..(253): Xaa can be any naturally occurring amino acid
  misc_feature (264)..(264): Xaa can be any naturally occurring amino acid
  misc_feature (273)..(273): Xaa can be any naturally occurring amino acid
  misc_feature (276)..(276): Xaa can be any naturally occurring amino acid
  misc_feature (286)..(286): Xaa can be any naturally occurring amino acid
  misc_feature (289)..(289): Xaa can be any naturally occurring amino acid
  misc_feature (292)..(292): Xaa can be any naturally occurring amino acid
  misc_feature (297)..(297): Xaa can be any naturally occurring amino acid
  misc_feature (309)..(309): Xaa can be any naturally occurring amino acid
MATEAQAQWVLTATGRSPTNIAVIKYWGKRDEALILPVNDSISVTLDPDHLSATTTVAASPAFPSDRMWLNGKEIALSGGRFQSCLREIRKRARDVEDEKRGIKIKKEDWEKLHVHIASYNNFPTAAGLASSAAGFACLVFTLGKLMNVNEDYGELSXIARQGSGSACRSIYGGFVKWCMGKWNDXGSDSMAVQLVDKSHWDDLGIIIAGAGSKQKGNQVPPSKWVLKMKVLPGSDFESFPKVTCPDSNQFHXVCLDTSPPSFXMTPPSHRIXSLXEKWNHSEGTXQVXYTXDAGPXAVLIARNRKTAXLLLQRLLYTFPPQKNDLDSYMLGDKSILSDAGLQSIADVEALPAPPEMKAPNQKFKGDVSYFICSRPGAGPKVLTDESHALIDSATGLAKGV

SEQ ID NO: 40644 - protein, 491 aa, Yarrowia lipolytica CLIB122
MQVTLPDGKSYDQPTKLFINNEWVDGHGGSIESVNPATEQVICSVEAADESDVDKAVQAARNCYENVWRKVTGAERAQLMRKLADLVEKNKDLLTSIEAADSGKPKYGNCDGDVDELIYVLRYYSGLAEKAGNGVTISTSNEKFAYTIHEPYGVCGQIIPWNYPIAMAAWKLGPCLAAGNVLVMKLSEYTPLSMLVICNLVKEAGFPPGVVNVVNGYGAKAGNRLAEHPDVDKIAFTGSTATGRSVMKAATGNMKAVTMELGGKSPLLIFDDCDLAKAIEWAHIGIMYNMGQVCSATSRILVQEGIADKFVEGFIKQCNEASILGCPLDQKTSHGPQVNKIQYEKVLGYIEKGKAEGAKCILGGEAAPQNGKGYFIKPTAFTNVNKDMTIWKEEIFGPVVVIDTFKTEEEAIAKANDTPYGLAAALFTENIRRAHRVVKELRAGQVWVNSDNDSDPRVPFGGVKQSGIGRELGEYGLSIYTQAKAVHINLD

SEQ ID NO: 40645 - protein, 1248 aa, Ustilago maydis 521
MPVGGTLMYLVQFRQILIHDSCICTSCLQKLALQLKAQFTNVTSLHPTDPDHTLMLRLKCTSCHEQHPKLVGVTPSDSHEMTKGARGSANLVMSCAFCKKESSAKFEEPPLWRQIDAGDGGAEWKTLCVLDFRGLEPVGFDPSGAWTCKGSESGTTFDSVEFDDGVEWMDYDEKSNTYAQCAFNVCGVLLADEIETNFGSKQSAHAHEDAVGGRWAEKIIFSGAQPHTNQGSEPGFACTMKLRCCSSTNLALLATIFVSFTLLAASVKAKHDSHARTHHLLRCLGHHAVQAADIAKVQALLDANPNPTDDAVWSQLNPKQWGFKGHDAPGGDTWQPENGAAQTAKERTMRQHAKLLKCAKRLHAVQAPAPPPAMDAVALDQPQPDSAQPRDKRQTEPVMPDASGGAGLKQVGRQGASDARAQFDHAGGSMMVDPATPAAGTRGTGRTGSRGVALAPLSNNQTVHGAAPQTDQKAGEKAIATPGGAEKHSPGLAPDAASVGSTFANSHEAKNASKTIPGDRGAVAADFGGAGAGANPAAQAPSVPAQPGAADVKAPTEPNANAVAAGNAPVHPNAPVDPNAPLKPGAPVDPNSPVDPNAPTQPGTPVDPNALLKPGVLGDANALSGTMGGDAKFQAVAAIAMGGATNAAAAGAAVLAHANGTNATTVWNQRLPAIVGQLKLAQVSAAHSNCTEPLIRKEYSTLTRQEKKAFVEAVKCVRSKPSRFKTSTPGWNAADDWTLLHIRMVKYVHFTAYFLPFHRGFTVLVQRDLNECGFALGLPWIDWTKTSQDPSMNGIWDPDPEVGLGTDGKGDSKDCPWQSGLAVTDGALADHFFNAPRRHRLCRQFNNLDVKSPNAHFGPNCTTFINADFIKGLGATHDNGKFFDFSSALEISTHLSMHTCVGGNLAWLSSSPNDMAFHSHHATLDNVFDAWRKKSDANQMAFHGPKQQQKRGQHPPWTAQKTDVINFEPLAPNVMVQDLLDPESGKWGVSLPTTRRLYASQPERRCIVIVRWPWKRNVRGMGVGCVVSTIEAGIATCSRIGHITASEILHLCGYNTDAPDGAGPPSGGQSGVVLNSMCKLPMRVNEAWCLSSRTRQNRTWAENFAIEITITNRSRPILRCAKDGAASGSWIQGMSRVSAVRNREFCLGSVKTPMSQGGPRRAKAALKKKGWVRLAGQLHSVDGIRDLLLPPRSQAIMNREPGIMAWGKFFIEHRHQGVARSVSKRVIPDNMSFRTGVRVAMSNGQCKR

SEQ ID NO: 40646 - protein, 288 aa, Oryza sativa Japonica Group
MARARRGRQNAAASPPSLALQLQVASLVIVFVFAFSSAITPTRADHVEGHMSHEMFGYENDATGPAKWGSLHKEWAVCGDGKKQSPIDITTVEPQKVKEPLMQAYKAGATTIQNRGHDYMLKWKDGNSKLTVQGKEYTLKQVHWHEPSEHTINGTRFDAEMHMVHEDPSMARAVVSVLLSTKAGQPNAVLTEMAPHFKNLAGKEKAEEEVKEPVDPSTWVDKTSGYYRYDGSLTTPPCTEGVIWTIMSKIGDASKEQIDLLKTVATTVEPNARPAQKLNDRIVRYFEV

SEQ ID NO: 40647 - protein, 336 aa, Pseudomonas putida KT2440
MAFNIHNRNLLSLEHHTTRELRYLLDLSRDLKRAKYTGTEQQHLKGNNIALIFEKTSTRTRCAFEVAAYDQGANVTYIDPNSSQIGHKESMKDTARVLGRMYDAIEYRGFKQEIVEELAKFAGVPVFNGLTDEYHPTQMIADVLTMREHSDKPLHDISYAYLGDARNNMGNSLLLIGAKLGMDVRIAAPKALWPHDDLVERCKQYAEESGARITLTEDPKAAVKGVDFVHTDVWVSMGEPIEAWGERIKQLKPYQVNAELMKSTGNPRTKFMHCLPAFHNSETKVGKQIAEQYPDLANGIEVTDDVFESPACIAFEQAENRMHTIKAILVSTLADL

SEQ ID NO: 40648 - protein, 335 aa, Moritella sp. PE36
MTILVTGGAGYIGSHTVLELLNSNQDVVVIDNLCNSSEESLKRVKAITGKSVSFYCGDVLDSELLNRIFTEHDINAVIHFAGLKAVGESNQIPLTYYRNNIATTINILEVMDAHNVKNFVFSSSATVYGDPASVPIDESFPTSATNPYGRSKLMVEEILADLYKSDSSWNIARLRYFNPVGSHESGLIGEDPNDIPNNLMPYISQVAVGKLKQLSVFGDDYATVDGTGVRDYIHVVDLALGHLKALDKLMTNPGLVTYNLGTGQGYSVLEMVKAFEQASGKTVAYQISPRREGDIAQCYAATELAERELGWKAERSISDMTADTWRWQSNNPDGY

SEQ ID NO: 40649 - protein, 406 aa, Escherichia coli O157:H7 EDL933
MTFSVDKVRADFPVLSREVNGLPLAYLDSAASAQKPSQVIDAEAEFYRHGYAAVHRGIHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDEKTRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSAQGLNNIAEYEQNLMHYALSQLESVPDLTLYGPQNRLGVIAFNLGKHHAYDVGSFLDNYGIAVRTGHHCAMPLMAYYNVPAMCRASLAMYNTHEEVDRLVTGLQRIHRLLG

SEQ ID NO: 40650 - protein, 228 aa, Helianthus annuus
HLGQLKRFSLRELQVATDNFSNRHILGRGGFGKVYKGRLADGTLVAVKRLKEERTQGGELQFQTEVEMISMAVHRNLLRLKGFCMTPTERLLVYPYMANGSVASCLRERPETQEPLDWPIRKRIALGSARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARL

SEQ ID NO: 40651 - protein, 470 aa, Moritella sp. PE36
MLIPVIMAGGTGSRLWPLSRELYPKQFLTVTGELSMLQQTVARLSGIEHQAPLLICNEEHRFIAAEQLRLGGFEHSGIILEPVGRNTAPAIALAALQALKTAKQDEDPVLLVLAADHLIEDTAAFQSSVEKALPFALDGKLVTFGIVPTSPETGYGYINAGEAKGAAFSVNQFVEKPDLGTAQRYLDSGDYYWNSGMFLFKASRYIEELKIHHPEIIAACVNAMSETNSDMGFIRVDKAAFELCPDDSIDYAVMEKSADVMVVPMDAGWSDVGSWSALWDVSVKDENNNVTKGDVISIDSSNGYFYSENKLIATVGIDNIVVVETKDAILVANKDRVQDVKKIVNHLKQAGRTEHKIHREVYRPWGKYDSLDFGDRDQVKRITVKPGAKLSIQMHHHRAEHWIVVSGTAKVTNGDKTFLVTENESTYIPLGQIHALENPGVLPLELIEVQTGSYLGEDDIVRFDDKYGRV

SEQ ID NO: 40652 - protein, 458 aa, Oryza sativa Japonica Group
MGERARQWLLVAGAGAAVGALSTAAVMRILSRSKRREGYVRSLLESNGVASGGAGSSVGTRVVATSDLLDDEVVSEQLTRNIQFFGMESQKKVTGSFVVVIGLGGVGSHAASMLLRSGVGRLLLVDFDQVSLSSLNRHAVATRDDVGTPKALCLKKHFSMIYPECQIEAKVQLYDPSCEDEILSGQPDFVLDCIDNIDTKVALLAACVRRGLRVLSAMGAGARADPTRIRVADLRESSNDPLSRAVRYRLKKDHGIEGGIPVVFSLEKPKAKLLPFQASKEEETPSDYQIVPGFRVRIIPVLGTIPAIFGQVMASYVITQLAKLDFQTEPIVNMDLDHYRILHHRLLEHEELIYGSAEQVLVDAEEVMYIVKELWRGRSARDQNLKDTGRKMWRSVNELMLVRWDKSKPAGVSNLILLKFNEADAHESTTLDQIKEEEPEFYNMVSRVLKQAEAEFAL

SEQ ID NO: 40653 - protein, 946 aa, Arabidopsis thaliana
MQTIIISPLVSHRLCLARAVPCNRLLNNHHRAPPSIRLSNHRSTTSLRLFSSAGSLCVCKSDAEYFAKAAASRDSEMATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLEKMLCACSGEQFRFEDQPGSPESLATRDFSASGLSSRNGGGDWDSKLEDIQVDEAESTLKEALSLNYEEARALLGRLEYQRGNFDAALQVFKGIDIKVLTPRIIKAIVEKTLPCKPRSKAVIVPPTTMSMHSVSLLLEAILLKARSLEELGSYKEAAEECKIILDVVENALPSGMPDGISGFAKLQDIFQKALELLPLLWKKAGNHHETIASYRRALSRPWNLDPQRLAVTQKSLALVLLYGSVEACPKDNIEEAIVLLMLLVKKMVVGDIQWDPELMDHLTYALSMTGQFEVLANYLEQTLPGVYTRGERWYLLSLCYSAAGIDKAAINLLKMALGPSESRQIPHIPLLLFGAKLCSKDPKHSRDGINFAHRLLDLGNSQSEHLLSQAHKFLGVCYGNAARSSKLDSERVFLQKKSLFSLNEAAKRGKADPELDVIFNLSVENAVQRNVQAALDGAVEYSSMVGGVSTKGWKHLAIVLSAEKRLKDAESILDFTMEEAGDIEKIELLRLKAVLQMAQEQPKKAMKTCSSLLGLIRAQEKSEQSEKFETEAWQDLASVYGKLGSWSDAETCLEKARSMCYYSPRGWNETGLCLEAKSLHEEALISFFLSLSIEPDHVPSIVSIAEVMMKSGDESLPTAKSFLMNALRLDPRNHDAWMKLGHVAKKQGLSQQAAEFYQAAYELELSAPVQSFI

SEQ ID NO: 40654 - protein, 187 aa, Desulfitobacterium hafniense Y51
MSLIGKEVNEFKVQAFVEGAFKEVTKGDLLGKWSVFVFYPADFTFVCPTELGDLADQYDEFKKIGVEIYSVSTDTHFVHKAWHDASDTIRKIRYPMLADPTAKLAKDFEVYIEEEGLALRGSFVVNPEGKIVAYEVNSNNIGREASELLRKVQAAQFVAEHGDQVCPAKWRPGAETLKPSLDLVGKL

SEQ ID NO: 40655 - protein, 475 aa, Vicia faba var. minor
MTMEEKEEHSTEAAVTSHNDSKLFDDDDRVKRTGTVWTTSSHIITAVVGSGVLSLAWAIAQLGWIIGLSVMIFFSLITWYTSSLLSECYRTGDPHFGKRNYTFMEAVHTILGGFYDTLCGIVQYSNLYGTAVGYTIGASISMMAIKRSNCFHSSGGKDGCRISSNPYMISFGVIQIFFSQIPDFHEMWWLSIVAAIMSFTYSLIGLGLAIAKVAENGSFKGSITGVSIGTVTEAQKVWGVFQSLGNIAFAYSYSQILIEIQDTIKSPPSEMKTMKQATKISIGVTTIFYMLCGGMGYAAFGDLSPGNLLTGFGFYNPYWLIDIANAALIIHLVGAYQVYAQPLFAFVEKIMIKRWPKIKKEYKLTIPGFRPYHLNLFRLIWRTIFVITTTFISMLIPFFNDVLGLIGAAGFWPLTVYFPVEMYIKQKKITKWSYKWISMQTLSVICFVVSVVAFVGSVSSIVVDLKKYKPFTTDY

SEQ ID NO: 40656 - protein, 440 aa, Aeromonas hydrophila
MNLSLDHIPGQLRHAIDECRLIQIRGRVTQVTGTLLKAVVPGVRIGELCHLRNPDNTLSLQAEVIGFAQHQALLTPLGEMFGISSNTEVSPTGTMHQVGVGEHLLGQVLDGLGNPFGGGHLPEPAAWYPVYRDAPPPMSRKRITQPISLGIRAIDGLLTCGEGQRMGIFAAAGGGKSTLLASLIRSAEVDVTVLALIGERGREVREFIEADLGEEGLKKAVLVVATSDRPAMERAKAGFVATSIAEYFRDQGKRVLLLMDSVTRFARAQREIGLAAGEPPTRRGYPPSVFAALPRLMERAGQSDKGSITALYTVLVEGDDMTEPVADETRSILDGHIILSRKLAAANHYPAIDVLRSASRVMNQIIEPEHQAQAGRIRSWLAKYEEVELLLQIGEYQKGQDKVADEAIARIEAIRQWLRQGTHEPSSLPEALTTLEALTR

SEQ ID NO: 40657 - protein, 486 aa, Vicia faba var. minor
MVENISRTNLSYRGDTGGIEEAIDDAPLQTDSKFYDDDGRVKRTGTVWTTCSHIITGVIGSGVLSLAWSVAQMGWIAGPATMIFFSIITLYTSSFLADCYRSGDTEFGKRNYTFMDAVHNILGGPSVKICGVVQYLNLFGSAIGYNIAAAMSMMEIRKSYCVHSSHGEDPCHVSGNAYMIAFGVAQLFFSQIPDFHNTWWLSIVAAVMSFFYSTIALALGISKVAETGTVMGSLTGISIGTVTPAQKVWGVFQALGNIAFAYSYSFILLEIQDTIKSPPSEGKAMKKAAKLSIGVTTTFYLLCGCTGYAAFGDAAPGNLLAGFGVSKAYILVDMANAAIVVHLFGAYQVYAQPLFAFVEKEAGKKWPKIDKGFEVKIPGLPVYNQNIFMLVWRTIFVIVPTLIAMLIPFFNDVLGVIGALGFWPLTVYFPVEMYIIQKKIPKWSRKWICLEIMSTFCLFVSVVAGLGSLIGVWIDLKKYKPFSLEN

SEQ ID NO: 40658 - protein, 198 aa, Glycine max
MRNINSVKQEFLKKWIWGLRKYSSQKKNMSLMERKKAIKLSADLAMASTRNKSTRWSRALIANASRDGNNKVLTEHVSPSSSSPPQRPATRKSFRRIRSCRNMLIRRNRAAVHCRTKDRVVAASFVAKRLVQKRTRRLKSLLPGGESMDAVSLVEETLDYIQSLRAQVEVMRRLVTASEIMILNPSRGGEKEALPYIR

SEQ ID NO: 40659 - protein, 432 aa, Nicotiana tabacum
MDCSIRIQNPLSTTTITSALFSNKKSANFRVFTVGCSSKILSSDGAPSGLVERPWKVADARLVLEDGSIWKAKSFGASGTQVGEVVFNTSLTGYQEILTDPSYAGQFVLMTNPHIGNTGVNFGDEESMQCFLAGLVIRSLSISTSNWRCKETLDEYLAKRNIMGIYDVDTRAITRRLRQDGSLIGVLSTENSKTDEELLEMSRTWDIVGVDLISGVSCKSPYEWVDRTASDWDFNDNGRNKETFNVVAYDFGIKHNILRRLASYGCKITVVPSTWPASETLKMKPDGVLFSNGPGDPSAVPYAVEAVKELIGKIPVFGICMGHQLLGQALGGKTFKMKFGHHGGNHPVRNLRNGCVEISAQNHNYAVDPESLPEGVEVTHVNLNDGSCAGLASFKMKLMSLQYHPEASPGPHDSDPVFGEFIQLMKQEKVKA

SEQ ID NO: 40660 - protein, 152 aa, Glycine max
MTTEQTFIAVKPDGVQRGLIGPIITRFENRGFKLAGIKMVTPSKEHLEKHYADLSDKPFFPGLIAYMGSGPVCAMVWEGCDAVKTGRSILGATNPLASAPGTIRGDYALDVGRNVCHGSDSVENGKKEIALWFKDGEVQSWKSAQHDWVYEK

SEQ ID NO: 40661 - protein, 377 aa, Solanum tuberosum
MTISATFSSHGKILMSPLRKSEWANQPVLCKSVELFKNGRNQYRMSTNSNKFQCRALEIENKSSTKFHLDDVIESQQFDRETLSAIFEVAREMEKIEKNSIGGRSEILKGYLMATLFYEPSTRTRLSFESAMKRLGGEVLTTENAREFSSAAKGETLEDTIRTVEGYSDIIVMRHFESGAARRAATTASIPIINAGDGPGQHPTQALLDVYTIEREIGKLDGINVALVGDLAYGRTVRSLAHLLAMYEDVKIYFVSPDVVKMKDDIKDYLTSMGVQWEENADLIEVASKCDVVYQTRIQRERFGERVDLYEEARGKYIVDMSVVNAMQKHAVVMHPLPRLDEITVDVDGDPRAAYFRQAKNGLYIRMALLKLLLLGW

SEQ ID NO: 40662 - protein, 417 aa, Glycine max
TPSWEKTVDCYSPGQGLMPASFKVRTVPLDGSNEAFEEVLDPDFGESAIGRVAPVDSGLWWIILLRAYGKLTGDYALQERVDVQTGIRLILKLCLTDGFDMFPSLLVTDGSCMIDRRMGIHGHPLEIQALFYSALRCSREMLIVNDATKSLVAAVSNRLSALCFHMREYYWVDMKKINEIYRYKTEEYSTDAVNKFNIYPEQIPSWLVDWISEEGGYFIGNLQPAHMDFRFFSLGNLWAIVSSLGTTRQNQGILNLIEAKWDDIVGQMPLKICYPALEGEEWRITTGCDPKNTPWSYHNGGSWPTLLWQFTLACIKMGRPDLAQKAVDSAEKRLSADRWPEYYDTPNGRFIGKQSRMVQTWTIAGFLTSKMLLENPERASLLFWEEDFELLQNCVCMLSKSGRRKCSRFAARSQFIV

SEQ ID NO: 40663 - protein, 48 aa, Borrelia burgdorferi
TVVGGGDSVAAVNKFNLSDKITHVSTGGGASLEYLEGRILPGIKVLEN

SEQ ID NO: 40664 - protein, 379 aa, Methylobacterium dichloromethanicum
MMRAMMVQSEDHRSVDFPSLTKPLFEDTKKVFGSTEGTIFLFPASGTGIWESALSNTLARGDKVLAARFGQFSHLWIDMAQRLGLDVVVQEEEWGTGAKPEKIEEALRADKNHEIKAVMVVHNETATGVTSNIGAVRKAIDAAGHPALLFVDGVSSIGSLPFKADEWKVDCAIAGSQKGLMLPAGLGVICVSQKALKAAEGQSGRNDRLARVYFDWEDQKKQNPTGYFPYTPPLPLLYGLREALACLFEEGLENVYHRHAVLGEATRQAVAAWGLKTCAKSPEWNSDTVTAILAPEGVDAAKIIKHAYVRYNLALGAGLSQVAGKVFRIGHVGDLNELSLLGAIAGAEMSLIDNGVKVTPGSGVAAASSYLRENPLAKA

SEQ ID NO: 40665 - protein, 347 aa, Bordetella parapertussis 12822
MAEVVFNTSMTGYQEILTDPSYAGQTVMLTYPHIGNTGVNPEDVEANRVYAAGLVVRDCPARVSNFRATQSLPEYLNAQGIVAIAGIDTRKLTRILRESGAQGSCILVGEDAERAVELARGFPGMSGQDLAKVVSIKERADWTQGTWELGSGYTQPAQDRFHVVAYDYGVKSNILRLLADRGCRVTLVPAQTTAEEAFKLQPDGVFLSNGPGDPEPCDYAVDATRAFLERKLPVFGICLGHQLMGLALGGKTVKMKTGHHGANHPVQDVQSGRVFITSQNHGFAVDAATLPANTRVTHISLFDGTLQGFELTDRPAFCFQGHPEASPGPHDIIVLFDKFISLMAGQK

SEQ ID NO: 40666 - protein, 668 aa, Oryza sativa Indica Group
MWKMVDALLRCSALVALVLHFVVNGCSAVNTEGSALLKFQSRVEEDPHGAMAGWSERDGDPCSWNGVRCVDGRVVILDSDWKCSLPIRSRIIVAKCSRNLKDLSLRGTLGPELGSLSHLRALVLSNNLFDGPIPKEMSDLAMLEILDLSNNNLTGEVPQEIAEMQSIKHLLLSNNNFQWPLIQNSYRNFDQEIDFDVYDERGDVDQRSENGFESDSSSEENTKDNNNLSARLSSQFAARNPTVQLSRRRLLEDTNLAAASANAPVPAVASVPSTGTGSFSAFKEIKVPPPLSPPSSPPMSSGPPQRSKRWLYAIVISSIALLLIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCLEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 40667 - protein, 162 aa, Candida glabrata CBS 138
MSKVYFDIEADGQPLGRVVFQLYDDVVPKTAANFRALCTGEKGFGYAGSPFHRVIPDFMLQGGDFTAGNGTGGKSIYGGKFPDENFVKRHERPGLLSMANAGPNTNGSQFFITTVPCPWLDGKHVVFGEVSEGYDVVKKVESMGSSSGATRARIIVSKSGEL

SEQ ID NO: 40668 - protein, 367 aa, Mycoplasma gallisepticum R
MLKAGIIGLPNVGKSTLFNAITNANSLVANYPFATIEPSFGIVELLDDRLNQLAKQIKPDKVVYATIMFVDIAGLVKNASKGEGLGNKFLSNIREVDCLIHVVRCFDNKNITHVHNHVDPINDIETINLELIISDLEIVDNRINKIKRKYESGDRTVVVEYELLNKIKKTLELNQMLDLSEYTQEELTIIKNFNLLTAKPRIYVGNINDKYLTDPLKSPHVQALADFCQKHSEQYLTISAEIEQEISNFFGQGKELEEITELFGIKETGLNKIAFKAYEMLGLCTFFTCGKKEVRAWTFKKNSLAPTCAGIIHSDLERGFIKAEVIYWSDLIQYGSELKAKEAGKLRLEGKQYVVQDGDVITFKFNV

SEQ ID NO: 40669 - protein, 57 aa, Glycine max
MKTFDPWPVFFRREWKRNWPFLTGFAITGFIITKMTANFTEEDLKNSKFVQEHKKKH

SEQ ID NO: 40670 - protein, 554 aa, Zea mays
  misc_feature (248)..(248): Xaa can be any naturally occurring amino acid
RPGTASPRFIGRRPRHIATVSHRRGHPFSLVHRIAPAPSAIDPSVPRCASAMQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLXGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKAPFFTSPRYLPPTKSDKCRIKDAIISHGCFLRECAIEHSIVGVRSRLNSGCELKNTMMMGADLYETEDEISRLLAEGKVPIGVGENTKISNCIIDMNARVGRNVSITNKEGVQEADRPDEGYYIRSGIVVVLKNATIKDGTVI

SEQ ID NO: 40671 - protein, 469 aa, Synechococcus elongatus PCC 6301
MASALTPNASHSVSVLVRMPSNTAAMLHVVQAIATTGANLTEMELLQRTNQWIDRRLIVEAASEEQAAAVVEAIAAVPDLELLDSEDRTFALHRGGKISVEPKLPLTSQAQLAMAYTPGVGRVCKAIAANPDRVYELTVKQNMVAIVTDGTAVLGLGNLGPAGALPVMEGKAMLFKAFGDVDAFPICLDTQDTDEIVETMKRIAPVFGGVNLEDIAAPRCFEIEARLKQELDIPVFHDDQHGTAIVTLAALENALKLVKKSLSQVRIVMNGAGAAGLSVASLLREAGATNIIICDSRGILSCDRSDLTPQKQAFAIEAGGSLADALVNADVFIGVSVPGVLTVEMVETMASDRIIFAMANPIPEIQPELIQGRAAVIATGRSDYPNQINNVLAFPGVFRGALDCRAKSLTSSMFLAAARAIAALVPPETLSAEHIVPSAFDSRVAPAVAAAVVEAAQANGLAQTLAVTH

SEQ ID NO: 40672 - protein, 370 aa, Triticum aestivum
  misc_feature (207)..(207): Xaa can be any naturally occurring amino acid
MEKTNIVACRNPTSRDASDDEEATWSHAWGLISGFAVSITLKTAIELGIIDALTNAAGRALTVDELAAQLPAPDKAGSAASVDRLLRLLAAFDVVRCSTETGPDCEAVRKYTPAPVCRWLTSNRSDGSLAPLAMLAVDQDYLPTWNQMGAAVVCGVPTPFERAHGVPLFEYMGKNPRLSGVFNQAMFHMSVTVISKMVERFDGFDGXEVLADVGGGTGAALEMITARHKHIKGINFDLPYVITQAPSLPGVENIAGNMFENVPTGDAIFLKWILHLQNDDECIKILKNCHRALPANGKVIVVEIVLPTTTEATREAQNMFLLDVIMFNNQQGGKERTEQDFLKMARSSGFDGAFRSTYIFGNFWALEFTK

SEQ ID NO: 40673 - protein, 414 aa, Oryza sativa Japonica Group
MAATAAAEAEAAAGDEAWCRETVPRVMELVSPRLPQRDACALLAVSPWCHRALVANPKLWEVRYRVASLPSTFFVLPLLALGLDSRGVLLRCFALLRKWSLAWASSLEWPPRYCHLKIINLEFAQDIDDRHFVRLKEMGCTSLQELELLNINACQKVSDKGIETITSLCPNLRALSIYWIVGLTDLTIRHIVQNCKHIVDLNLSGCKNISDKGMQLVADNYEGLKKLNITRCIKLTDDGLQEVLQKCSSLESLNLYALSSFSDKVYKKIGSLTNLTFLDLCGAQNVTDDGLSCISRCVCLTYLNLSWCVRVTDVGVVAIAQGCRSLQLLSLFGIVGVTDVCLEALSKHCSRSLTTLDVNGCIGIKWWEVDLFVSGPDALECVYPAVFEFLGFYNIFRGSIQELAHLLRNNISFA

SEQ ID NO: 40674 - protein, 166 aa, Beta vulgaris subsp. vulgaris
GEGTYGVVYKARDSLTGKIVALKKVRFDNLEPESVKFMAREILILRRLDHPNVVKLEGLVTSRMSCSLYLVFEYMEHDLAGLAASPDIKFTEPQVKCYMHQLISGLEHCHNRGVLHRDIKGSNLLLDNGGILKIADFGLATFFDPNKKHPMTSRVVTLWYRTPEEF

SEQ ID NO: 40675 - protein, 1005 aa, Oryza sativa Japonica Group
MFRRLLLPLRRCFSTSTSSSATPTLYSSGTTPVSILSWGRGASGQLGGGKEERRLYPSPVAHLSLPDPAPVLSPTPGRLPDAAAAGTAAGGVEVGISCGLFHSAVVVDGGAWVWGKGDGGRLGLGDESSAFVPRHNPNLSELRVLALGGIHSAALTASGEVFTWGYGGFGALGHYVYHRELLPRKVNGPWEGKISHIATSGAHTAAITDSGELYTWGRDEGDGRLGLGSGGGPGEAGSLSVPSKVNALPVSVAAVACGGFFTMALTSDGQLWSWGANSNFELGRGSNSSDWRPQLIPSLKNLHVIQVACGGYHSLALTDEGVVLSWGHGGHGQLGHPTLQNHRVPLAIKALSEERIVYIACGGSTSAAISEKGDLYMWGNARDCQLGVPGLPEIQPLPLMLSFARTSFGGQTAHLPKSKSSGYKHFVSISSGLPCFLAIRRQSPGYSSVHTASFSSQHNQLSTDRSGTVMAERELIDKDKLILRGLQFHGFHGVKQEEKTLGQKFVVDVDAWMDLSAAGETDSISDTVSYTDIYRIAKDVVEGPSRNLLEAVAHRIASATLLKFPQISAVRVKVGKPHVALPILFAFLKSSCRRGVFFFTEASSWPETRMPPVNSDGAGPSSGEDGSAAAVKKRNRPKYHRFTQQELQACKPILIPQTVILVLVFVGLIFIPIGLACIAASNKVVELVDRYDTKCVPRNMLRNKVAFIQNSSIDKTCTRVFKVPKDMKKPIYIYYQLDKFYQNHRRYVKSLNDMQLRNPKKVADTQYCSPEATANGRPIVPCGLIAWSLFNDTYSFTRGHGNETLRVNKDGISWKSERNRRFGKNVYPKNFQNGTLIGGGQLNPSKPLSEQEDLIVWMRIAALPTFRKLYGRIDMDLQAGDRVEVTMQNNYNSYSFNGKKSLVLSTAGWLGGKNAFLGRAYAIVGLACFLLALLLALLYFVFPMSVSATAELNPQFFIPFMKCSWILILEYMIQTWLLKEFFNTVSAVQSANLGVPGAPFVKDTT

SEQ ID NO: 40676 - protein, 228 aa, Helianthus annuus
HLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPNEPPLDWPTRKRIALGSARGLSYLHDHCDPKIIHRDVKAANILLDEEFEAVVGDFGLAKLMDYKDTHVTTAVRGTIGHIAPEYLSTGKSSEKTDAFGYGIMLLELITGQRAFDLARL

SEQ ID NO: 40677 - protein, 111 aa, Beta vulgaris subsp. vulgaris
YKAVNRESYEIVAVKKMKRKFYFWEECVNLREVKSLPSIESSNIIKLKEVVRENNDLFFIFEYMQYNLYQIMKDRHRPFTEEEIRNFLTQVLQGLAHMHRNGYFHRDLKPQ

SEQ ID NO: 40678 - protein, 323 aa, Oryza sativa Japonica Group
MEKAAGFLSSLLGGGEEVPPEPAATVRSILIYPIKSCRGISVPQAPITSTGFRWDRQWVVVNSKGRAYTQRVEPKLALVEVEMPPEAFAEEWRPTADSYLVGRAPGMDPLKIPLSAEQAIINDVSVWEWSGSAYDEGAEAAEWFSSYFGNPSRLVRFKEGSEIRPTNPDYAQGYKIMFTDCFPFLMASQGSLDALNEVLKEPVPMNRFRPNILVDGCHPYSEDLWKTIKINKLTFQGVKLCNRCKVPTINQENGILGTEPTETLLTFRSDEVLRPSHKNKRQVYFGQNLVCKESLSAKGKGRIIKNKQYHLALKTVAHTIDIQ

SEQ ID NO: 40679 - protein, 200 aa, Pseudomonas aeruginosa PAO1
MSVLVGKKAPDFNVAAVLGNGEIVESFTLSEAIKGKYGLVFFYPLDFTFVCPSELIALDHRIPEFQARNVEVIGVSIDSHFTHNAWRNTPVDKGGIGAVKYTLAADTKHEIAKAYDVESDGGVAFRGAFLIDKEGVVRSQIVNDLPLGRNMDELLRLVDALQFHEEHGEVCPANWKKGDKGMTASPEGVAKYLAENASKL

SEQ ID NO: 40680 - protein, 238 aa, Helianthus annuus
FFPPPPFVPPPPFPVPGGNSATGALAGGVAAGAALLFAAPAIAFAWWRRRKPQEFFFDVPAEEDPEVHLGQLKRFSLRELQVATDTFSNKNILGRGGFGKVYKGRLADGSLVAVKRLKEERTPGGELQFQTEVEMISMAVHRNLLRLRGFCMTPTERLLVYPYMANGSVASCLRERPPNEPPLDWPTRKRIALGSARGLSYLHDHCDPKIIHRDVKAANILLDEEFEAVVGDFGLAKL

SEQ ID NO: 40681 - protein, 387 aa, Oryza sativa Japonica Group
MDKAGGSGEAPPEPEPAAAATVKSIVVYPIKSCRGISVPQAAITSTGLRWDRPWLVMNSAGRAFTQRVEPKLALIEVEMPQEAFTEWQPTPDSHMGISQFHHLFTIHDAQSHNVMPFFFHVRVGVLRISFLSEALLIAVIRAPGLDPLKIPLGAKRATVDDVSIWEWSGSAYDEGDEAAEWFSSYFGKPTRLVRFNEASEIRETNPDYAQGYKVLFADDFPFLLASQGSVDALNSILKEPVPMNRFRPNIIVDGCHPYSEDLWKTIKIGKLTFLGVKLCDRCKVPTINQDNGIPGEEPTEALQALRSDEVLRPSHKNKRRVYFGQNLVCKESLSAKDEGRIIKMKFQHEQGGHSGNRSEVSNRSIYARMDVNLTLQIRLEKVCYVPE

SEQ ID NO: 40682 - protein, 333 aa, Pseudomonas putida KT2440
MTLRIAINGFGRIGRNVLRALYTQGYRQDLQVVAINDLGDSTMNAHLLKYDSVHGTFDATVEADHESLTVNGDRIAVSAIRNPAELPWKAEAIDVVFECTGLFTDRAKAAAHLAAGAGKVIVSAPAKGADATVVYGVNHDILRASHQIISNASCTTNCLAPIAQVLHREFGIEQGLMTTIHAYTNDQVLTDVYHSDPYRARSATQSMIPSKTGAAEAVGLVLPELAGKLTGMAVRVPVINVSLVDLTVNLKREATAEQVNQLFLEASKHSKVLGYNALPLVSCDFNHNPLSSIFDANHTRANGRMLKVLAWYDNEWGFSNRMLDNCLALHRAG

SEQ ID NO: 40683 - protein, 120 aa, Beta vulgaris subsp. vulgaris
VSEEYKLVPDTLYLTVNLIDRFLSGNYLEKQKLQLLGVTCMLIASKYEEVSAPQVEDFCYITANTYAREEVLNMERKVLNFLCFQLSVPTIKTFLRRYVHAAQATEDSLVDLEFLAKYLV

SEQ ID NO: 40684 - protein, 228 aa, Helianthus annuus
HLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPNEPPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARL

SEQ ID NO: 40685 - protein, 407 aa, Bacillus cereus G9241
MDTLIFEVGTALVLVAFAAILAAKLKFSIIPFLIILGMLVGPHAPDLGLIDLRFIESGEVISFLGRVGVIFLLFYLGLEFSIKKLIKSGKSIAFGGTVHISLNFILGLLYGYVMGFPLLEMLIIAGIITISSSAIVAKVIVDLRRSGNKETELILGIIMFDDIFLAVYLSVVSRLVLGGATSFIGALTSVLIAVGYMLLFFVIARKATPFLNKILDISSNEIFIIVIFAILFFVAGFSETIHVAEAIGALLLGLVFSETEHSDRIEKLVVPFRDFFGAIFFFSFGLSIDPFSLGGAVWLALGAVLITLIGNFTAGMMAGRKAGLSHKASTNIGLTLVSRGEFSIIVANIGIAGGLMAAIKPFSALYVLILASLGPLLTKESGRIYSLLDKVFKWSVKERAKREKEVG

SEQ ID NO: 40686 - protein, 394 aa, Coccidioides immitis RS
MSSQNQEFTEGPQVYRPGGFHPVYLGEVYNGKYEVLRKLGSGRYSTVWLVQNREALKILSAECYGGLKDTYEREILEHLRDADPSHPGYAYISTLVDSFEHQGPNGRHVCLVFRVMGETLRSFGTWFEHHMIPNEIMRRFTIQLLLALDYAHDHNVIHTDIKPDNIFVQIQDESLISKLYLPNNPADPAGFDTSTNPSSIQCQPLKWDYFQNGANLLEFDIALGDWGVASWTHSHLTELIQPVALRAPEVLIKAPWGPSTDLWNLGAVILEVFRAVRMFSGRVPPDGHYEVRSHLHEIVDLFGPFPKSLLQKGDQELVQEYFDSAGKVKHLPPLDRPGLESEAFLGKLDRKNKRQFVIFLRSLMKVDPEERKTTMELLAEPWLDAVLKPVSFGV

SEQ ID NO: 40687 - protein, 481 aa, Vicia faba var. minor
MVVEKNASNNHHQTFYVSIDQQIDSKFFDDDGRVKRTGTSWTASAHVITAVIGSGVLSLAWAIAQLGWIAGPIVMFLFAWVTYYTSVLLCECYRNGDPVNGKRNYTYMEVVHSNLGGFQVQLCGLIQYLNLVGVAIGYTVASAISMMAIVRSNCFHRSGGKDPCHMNSNIYMIAFGAVQIIFSQIPDFDQLWWLSIVAVVMSFTYSTIGLGLGIGKVIENKKFAGTITGINDVTKAQKTWGSLQALGDIAFAYSFSMILIEIQDTIKAPPPSESKTMKKATLISVIVTTFFYMLCGCFGYAAFGNSSPGNLLTGFGFYNPFWLLDIANAAIVIHLIGAYQVYCQPLFAFVENYTAKRFPDSDFVNKDVKIPIPGLDRYKLNLFRLVWRTVYVILTTLISMLLPFFNDIVGLLGAIGFWPLTVYFPVEMYIIQKKIPKWSTKWICLQLLSGACLIITIAATIGSIAGLILDLKVFKPFKTIY

SEQ ID NO: 40688 - protein, 288 aa, Oryza sativa Indica Group
MEGKEEDVRLGANRYTERQPIGTAAQGAEEKDYREPPAAPVFEAEELTSWSFYRAGIAEFVATFLFLYIRILTVMGVNKSASKCATVGIQGIAWSFGGMIFALVYCTAGISGGHINPAVTFGLFLARKLSLTRAVFYMAMQCLGAICGAGVVKGFQRGLYMGSGGGANAVNPGYTKGDGLGAEIVGTFVLVYTVFSATDAKRNARDSHVPILAPLPIGFAVFLVHLATIPITGTGINPARSLGAAIVYNRAHAWHDHWIFWVGPFIGAALAAIYHVVVIRAIPFKSRD

SEQ ID NO: 40689 - protein, 238 aa, Lilium longiflorum
MFLLVLAALILSSPVAGYGSTVEDVKARTNIAAEEAKVKADETAQEAKESTESWAGWARDRISEGLGIKSDVKVSDISSGSAEMASEKAAGAKDAVMSGAGKAKENILEAADATQKTVGGCGGNAADAAGRTYEGAKQKVGEAYESAKGAVSGSADLAGRTYDGAKQKVGDAYASTKDTVSGSVDSAGRTYEGAQQKVGEAYDNAKDTMTESAKANYEAAKEKASQAAGDVGGRTEEL

SEQ ID NO: 40690 - protein, 530 aa, Chlamydophila pneumoniae CWL029
MSIVLDKIGKSLGTRILFDDVSVVFNPGNCYGLTGPNGAGKSTLLKIIMGMIEPTRGSISLPKKVGILRQNIDSFHDTTVLDCVIMGNTRLWEALQRRDNLYLQEFTDAIGMELGEIEEIIGEENGYRADSEAEELLTGIGIPNEMFDKKMAMIPIDLQFRVLLCQALFGHPEALLLDEPTNHLDLYSINWLGNFLKDYEGTVIVVSHDRHFLNTITTHIADIDYDTIIIYPGNYDDMVEMKTASREQEKADIKSKEKKISQLKEFVAKFGAGSRASQVQSRLREIKKLQPQELKKSNIQRPYIRFPLSDKSSGKVVLSLEAITKDYGDHQVIHPFSLEIYQGDKLGIIGNNGLGKTTLMKLLAGVEAPSSGSIKLGHQAICSYFPQNHSDVLADCGQETLFEWLRNRKTGINDQEIRSVLGKMLFGGDDAFKQIQALSGGETARLLMAGMMLENHNVLILDEANNHLDLESVSALSWAINDYKGTAIFVSHDRGLIQDCATKLLIFDKDKITFFDGTMVDYTAGHKQLL

SEQ ID NO: 40691 - protein, 422 aa, Moritella sp. PE36
MSFETISVVGLGYIGLPTAAMFASRKKQVIGVDVNQHAVDTINRGEIHIVEPELDMIVHATVTEGYLKAVTSPEPADAFLIAVPTPFKVCAEGEIPEPDLRYIEAASKAIALVLKKGDLVILESTSPVGATEQMAEWLAEIRPDLSFPQQSGENADVNVAHCPERVLPGHVVRELVENDRVIGGMSKRCSERSVELYKIFVQGDCVITNARTAEMAKLTENSCRDVQIAFANELSMICDKLDIDVWELISLANRHPRINILQPGPGVGGHCIAVDPWFIVSKTPEEARMIHTARKVNDSKPGWVINKVKIAIADFLQENPEKTAKDVTIACYGLAFKPDIDDLRESPALDITKNIAKMHCGQVISIEPNINMLPSELSNVQLVCFDIASAEADIHILLVDHNEFKTKKPKSGVLIDTKGIWN

SEQ ID NO: 40692 - protein, 389 aa, Kineococcus radiotolerans SRS30216
MRALVWNGVNDLAVETVADPTVLNPHDVVLKVSLTTTCGSDLHFIDGYLPGMQPGDVFGHEFMGVVVEVGPEVRSTAVGDRVVVPSFIACGTCAYCKREMYSLCDTTNPNGALQQPLLGYPSGGIYGYTHPFGGYAGSHAEYVRVPFGDVNCFPVPEGVDDVSALFTSDAVPTGFMGADFCDITPGDTVAVFGAGAVGLMAAASARLLGAERVIVVDRLASRLTLARDRIGAETIDYSEVDSVQEVLRESTGGRGPDAVIEAVGMEGHGTGLQNVVDRAKQAVRLETDRATPLREAVLACRKGGVVSILGVYGLTDSFPTGVVLNKGLTIKAAQQHGQRYVPRLLAHLAAGELDTSFLATHRMSLEDSVEGYRIFKEKEDDCLRAVFQP

SEQ ID NO: 40693 - protein, 249 aa, Xylella fastidiosa Ann-1
MRPKIVAGNWKLHGSHAFAQALVAQVAAGLPLPGVSVIILPPLLYLSDLVQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLDLVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 40694 - protein, 273 aa, Oryza sativa Indica Group
MWWWPAFLYPPPAPAFVAAASVAQFALLANAGLGELRGEHMAYSKFWQVVAGKKKNGGGALLPSRQGMLVAYVPAFVAAAASFAVPGAVVGVRAQVLSAALTVHFLKRILEVLFIHQYSGSMPLNTAATISSSYLVITATMIYAQHLAAGLPDPPVDLLYPGVAVFAVGIAGNFYHHYLLSQLRNAAGGSGGGERQYRIPTGGLFGLAACPHYLFEIVGFFGFAMIAQTAHALAVASGTAAYLAGRSCATRRWYESKFEDFPDSIKALVPYIL

SEQ ID NO: 40695 - protein, 472 aa, Oryza sativa Japonica Group
MEPRVGNKFRLGRKIGSGSFGEIYLGTNIQTNEEVAIKLENVKTKHPQLLYESKIYRILQGGTGIPNVRWFGVEGDYNVLVMDLLGPSLEDLFNFCSRKLSLKTVLMLADQMINRVEFVHSKSFLHRDIKPDNFLMGLGRRANQVYIIDFGLAKKYRDTSTHQHIPYRENKNLTGTARYASVNTHLGIEQSRRDDLESLGYVLMYFLRGSLPWQGLKAGTKKQKYEKISEKKVATSIEALCRGYPTEFASYFHYCRSLRFDDKPDYSYLKRLFRDLFIREGFQFDYVFDWTILKYQQSQIASAPPRAVGHGAGPSGLAPPALQNDRQSGVDEGRTSGWSSMDRRRAPPPIASVGPWANQKAPVGNDASFSKEPVISASNFLGRSSGSSRRPAVSSSRDVMPIDTSEPSRTRATDASPGAFRRTSGPQKSSPVNSAEPKHSSSARHSSNVKNYESALKGIEGLNFDGDERVQY

SEQ ID NO: 40696 - protein, 710 aa, Vibrio angustum S14
MLVPVGAGVGLTSVSLGVLRAMERKGVRVSFFKPIAQPRKGGDQPDLTTTIISANSDMKIAESFSMASAEELIRNDKTDVLLEDIVARFKAATADADVTLIEGLVATRKHPFANQINFEIAKTLDAEIVFVVSPGTDNPAQLKERIEVACSNFGGIKNKQISGVIVNKLNAPVDAEGRTRPDLSEIFDDAEGTVPSNVEIMQVFNSSPIRVLGCAPWSAELIATRATDIAQHLNAEIINAGDIETRRIKSITFCARSIPNMVEHFRPGSLLVTSADRPDVIVAACLAAMNGVELGALLLTGGYDLPKPVMDLCERAFATGLPVMTAQGNTWQTSLNLQSFTLEVPADDKERVELVNEYMASHIDGNWIESLTEGSNRERRLSPPAFRYQLTELARKAAKRIVLPEGDEPRTVKAAAICAERGIAECVLLGNPDEIRRVAEQQGVVLGTGVTIINSDEVRENYVARLVELRGAKGMTDVVAREKLQDSVFLGTMMLENDEVDGLVSGAVHTTANTIVPPFQIIKTAPDASIVSSVFFMLLPDQVLVYGDCAINPDPTAEQLAEIAIQSADSAKAFGIDPRVAMISYSTGESGKGADVDKVREATKIAQEKRPDLVIDGPLQYDAAIMENVAASKAPNSPVAGKATVFVFPDLNTGNTTYKAVQRSADLVSIGPMLQGMRKPVNDLSRGALVDDIVYTVALTAIQAEQAAAK

SEQ ID NO: 40697 - protein, 282 aa, Kineococcus radiotolerans SRS30216
MPAPTTVGDTTVARVAAARHHVRSLGRDDGPVLLLVHGFGTDQQCWNRMLPALLPTHRVVLLDLAGAGGFDTAAYEREKYVTLDGYAADLVELCEELDLRDVVVVGHSVSSMIAARAALRAPERFAQVVMIAPSARYTDDPATGYDGGFSTEDVAELLDSLDVNYLSWTATVAPMIMGNPERPELGEEFTESFRQLHPGTARDFARATFHTDSRELLTRVTTPTLVLKCRDDALAPDSAVQEVVDRLPHATLVALQASGHCPHVSAPDETAAAVLAHLRRSA

SEQ ID NO: 40698 - protein, 240 aa, Zea mays
MMEGGSRADGRNPNQLRPFTCTGNPLHRAHGSARWAQGDTVVLAAVYGPKSGTRKGENPEKASIEVVWKPKTGQIGRQEREYEMTLKRTLQSICLLTVHPNTTTSVVLQVVGDDGSLMPCAINASCAALAFAGIPMKHLAVAIGCGVMDNGAVILNTSRAEEQQARSFAHLVFPNSRKSVESKDPTQRDEESERGLITCITHGAMSEDDYFNCIERGVMASSRISDFMRKTLQKEASTDA

SEQ ID NO: 40699 - protein, 148 aa, Dehalococcoides sp. CBDB1
MSFKRSLTAVLALCMVFTGTLTGCDTDRTDPLDNTDSNLPKVQDISVDEAKDLIDRNTNSTEFVILDVRTPSEYAQGHIAGAVNLDYYASFENSLFALDKNKTYLVYCRSGNRSVSASQLMVDNGFTSIYNMLGGINVWIANGLPLAT

SEQ ID NO: 40700 - protein, 189 aa, Zea mays
GVGPLGIAWAVGGMIFVLVYCTAGISGLAKSVMKHYYNTLGGGTNVVVAGNSKGAALGAEIIGTFVLVYTVFSATDPKRNARDSHVPVLAPLPIGFAVFVVHLATIPITGTGINPARSLGAAVIYNNGQVWDDQSESAHNCKKEQNIQIIRATTRENQVIFLRNNSAYHVDQGALLQGTLELVLEELRL

SEQ ID NO: 40701 - protein, 250 aa, Vibrio angustum S14
MQRHVFVCHLKLSTSPDSGYIFGETMNQTSLLAEFGSPTTRVENALNALRRGLGVMLLDDENRENEGDLIFSAEHITATQMALMIRECSGIVCLCLTEKHVKQLDLPAMVENNNSANKTAFTVSIEAKEGVTTGVSASDRVTTIKTAIALNAQPSDLARPGHVFPLCANRKGVLGRRGHTEGTIDLMKLAGLEPAGLLCELTNIDGTMAKADEVVYFAKRHNIPVLTIEDIVAYRLQQKKDKSQEFEMVL

SEQ ID NO: 40702 - protein, 359 aa, Annona cherimola x Annona squamosa
QMGFAENQVSFDLLEQYLEQHPEASGWGSRLSSFRDNALFQDYHGLKTFRQAMASFMEQIRGGRAKFDPERIVLTAGATAANELLTFILADPGDALLVPTPYYPGFDRDLRWRTGVKIVPIHCDSNNKFQVTPQALENAYAAAKSMDIKVRGVLITNPSNPLGAAISRPILEEILDFVSRKNIHLISDEIYSGSVFSAAEFTSVAEILAASNYKDSERVHIVYSLSKDLGLPGFRVGTIYSYNDKVVTTARRMSSFSLISSQTQNLLASMLSDVDFTKKYIETNRERLRRRYASTIRGLRNAGIECLKGNAGLFCWMNLSPLLEKPTREAELKLWDSMLHEVKLNISPGSSCHCLEPGW

SEQ ID NO: 40703 - protein, 311 aa, Dehalococcoides sp. CBDB1
MNTKDLLSISDLSPDDIGRLLSDAVELKARGWNNSLSGKTLALVFEKPSLRTRVSFELAMKQMDGEALYLSPAEVGLGKREPVADVARVLSRFVDVIACRTFGHETLVQLAKYADIPVINALSDLEHPCQALADILTIYEKKGDLKGLSLAYIGDGNNCANSLLLACAMTGINCRLASPKGYLVDKDLFARAEAYAEDSGAELYSGTDLKTALRGADVIYTDVWTSMGQEAETEKRLKDFTGFQVNAKLVSMAKKDAIIMHPLPAHYGEEVDREILECPQSVIFDQAENRLHAQKAVLRDMLGGLEIGGRH

SEQ ID NO: 40704 - protein, 559 aa, Methylobacillus flagellatus KT
MSADFFTRTDIMIAILEAKHAGLLSRQYWSRNIMSGLIVGVVALPLAMAFAIASGAKPEQGLYTAIVAGTLASLFGGSRLQITGPTGAFIVILSGITAKYGIAGLQIATLMAGAMLLLMGLARMGSVIRYIPEPVIIGFTSGIAVIIFVGQWQDFFGLAPQASHHFHEKLLHLVEALPQLQWQTSLLGAFTLAVLVLSNRYLKKIPGPLVAIVAATVVQSVFQFQQVATIGSAFGGIPQALPHFSLPEGIGPAVMIELIGPAFTIALLGAIESLLSAVVADNMAGTRHQPNQELIGQGIANIASPLFGGFAATGALARTATNIRNGANSPLSGIVHAVTLVLIVVLLAPLAVNAPLAALAAILFVVAYNMSEVHRFLHIARTAPRADVAVLLITFLLTVFSDLVIAVNIGVVLAALLFMKRMADTVNVTQLSDDDLQQEYGPHAWHLPPGTLVYRLEGPFFFGAAEHLQRRLQTIGENTDTIVLRMARVPIMDATGLQALWNLLDTCKQHNIRLVIVEARPNILEKLRRSGIIGQIGPHHVLPHLHLLWQEAPSSPLPG

SEQ ID NO: 40705 - protein, 503 aa, Pisum sativum
MAITVSSRQLFIDGEWRVPILNKRIPNINPSTENIIGDIPAATKEDVDLAVDAAKRAISRKNGRDWSAASGSLRARYLRAIAAKIKEKKDELGKLESIDCGKPLEEALADLDDVVACFEYYAGLAEELDSKQKAPISLPMDTFKSYILKEPIGVVALITPWNYPFLMATWKIAPALAAGCAAILKPSELASVTCLELGEICKEVGLPRGVLNIVTGLGHEAGASLASHPDVDKISFTGSSATGSKIMTTAAQLVKPVSLELGGKSPIVVFEDVDLDKVAEWTGFGCFFTNGQICSATSRLIVHESIAVEFVDKLVKWAENIKISDPLEEGCRLGPIVSEAQYKKVLNCISSAKSEGATILTGGRRPEHLKKGYFVEPTIITDVTTSMQIWREEVFGPVLAVKTFSTEEEAINLANDTHYGLGSAVMSNDLERCERLSKALQAGIVWINCAQPSFIQAPWGGIKRSGFGRELGEWGLENYLSVKQVTRYTSDEPWGWYQPPSKL

SEQ ID NO: 40706 - protein, 506 aa, Methylobacillus flagellatus KT
MSLDSLKGLGIKVPYKNKYDNYIGGQWVAPVDGEYFDNISPVTGKVFCQVPRSNEKDINLALDAAHAAKEAWARTSGTGRANILLKIADVMEANLETIAIAETIDNGKPIRETMAADIPLAIDHFRYFASCIRTQEGGISEIDHETVAYHFHEPLGVVGQIIPWNFPILMAAWKLAPALAAGNCIVMKPAEQTPASILVVMELIGDLLPPGVLNVVNGHGVEAGKALATSPRIAKIAFTGSTSVGRLIMQYASQNLIPVTLELGGKSPNIFFEDVMDKDDAYFDKALEGFTLFALNQGEICTCPSRALIQESIYEQFIERAIKRVKAIKQGSPLDKSTMIGAQASSEQVEIIMSYIKLGLEEGAQLLTGGNATKLPGDLSEGYYIEPTVFKGHNKMRIFQEEIFGPVLSVTTFKDEKEALEIANDTMYGLGAGLWTRDGSRAYRVGRGIQAGRVWTNCYHLYPAHAAFGGYKQSGIGRENHRMMLDHYQQTKNLLVSYSPNALGFF

SEQ ID NO: 40707 - protein, 413 aa, Candida glabrata CBS 138
MLSRSAVCAKRYITPRHVAAWKLPVQKVVPAYLSQYRWASTSVKVPSMAESLTEGSLKEFTKKVGEFVEQDELLATIETDKIDIEVNSPVSGTVTKLNFEPEDTVTVGDELAQIEEGGAPADGGAKPAAEESKPAEESKPAEQAKPAAPAAEKKSAPVKKPESPKQEASNAAQQAPSTAAFSRNENRVKMNRMRMRIAERLKESQNTAASLTTFNEVDMSALMEMRKLYKDEIIKKTGTKFGFMGLFSKACTLAAKDIPAVNGAIEGDQIVYRDYTDISIAVATPKGLVTPVVRNAESLSVIEIEQEIVRLGQKARDGKLTLEDMAGGTFTISNGGVFGSLYGTPIINMPQTAVLGLHGVKERPVTVNGQIVSRPMMYLALTYDHRLLDGREAVTFLKTVKELIEDPKKMLLW

SEQ ID NO: 40708 - protein, 266 aa, Prochlorococcus marinus str. NATL2A
MAKAIVSPLLERGEYNPQQVLGIVGRSSSIASALNDLPKEVKVVSSKDSLSKEVWKAPIKILAVKPQQLSKIKESVSSFQSNDQFPKPLLISVLAGITLKSLKKAFPRHTCVRAVPNTPSLVGQGLTGLAWPDDMTLDQKKVVRKIFEPISEIYELEEPKLDSFLALTSSGPAYIALVVEAMADGAVAAGLPRLLSNQLAHKTLSGTASLLREKSLHPAELKDMVASPAGTTISALRHLELAGLRSALIEAVVLAAQKSRQLAEEV

SEQ ID NO: 40709 - protein, 400 aa, Aspergillus oryzae
MTLDIAQVRSRFPALKQEQVFLDNAGGSQVLDTVIESIASYLTNTNVQLGATYKTSKLSTAGFANGYEAAAKFINAKPEETCLGVSTTQLLHNLSTALKFQPGDELILSKLNHEANSAAWVRIAERLGLEVKWWSASNPQNPVCDPNDLKQLISEKTRLVACPHASNILGSIVDVKEIAKIVHQYPRALLCVDGVALAPHRQVDVKDLDVDFYAFSWYKVYGPHIAQLYASSRIHDQIDTLGHFFKGTDTLDLKLNLASANYEHVQSIPRVVEYFEPDVSASWEKIAVQEERLQQIILDFLNGNDRVTVYGERSADKNLRVPVISFTVRGTKSQKLVEEVEKRSAYGFRSGHMYSHRLIKDIIGLEDVEDGVVRISMLHYNTEEEMTGLVKVLEEVIATL

SEQ ID NO: 40710 - protein, 433 aa, Candida glabrata CBS 138
MDIVQLLFKRDDDDGPPPACAVDNDFNGHTNLRILSVFMVLISSAIGVYFPLLASRYSFINLPSWVFFIAKFFGSGVIVATAFIHLLEPASDSLGNPCLGGTFANYPWAFGICLMALFALFLIEIVSHHYVGKTMGGGHNHSHNMPTTFGQTHMHGVEDDMVDEDGSSSTHSHSHVAMDDKYGDVVKNNNYNYDDGSDDIESQKRPAFNVAQQKVRNDSNENDSLVGHVHNTTVDPLEHMPGHNHFSHDEVHQDITQIGSKANDQQKEQYLNQLTSLFILEFGILFHSVFVGLSLSVSGDEFKTLFVVIVFHQMFEGMGLGARITECYWPHSKRWLPYLLGFGYTITTPIAIAIGIGVRHSFVPGSRRSLIVNGVFDAISAGILVYAGLVELMAHEFLFTNQFKGEHGLRNMLAAYFVMALGAGLMALLGRWA

SEQ ID NO: 40711 - protein, 426 aa, Xanthomonas campestris pv. campestris
MASAKEISQYLKRFSQLDAKRFAVVKVGGAVLRDDLEALTSSLSFLQEVGLTPIVLHGAGPQLDAELSAAGIEKQTVNGLRVTSPHALAIVRKVFQASNLKLVEALQQNGARATSITGGVFEAEYLNRDTYGLVGEVKAVNLAPIEASLQAGSIPVITSLGETPSGQILNVNADFAANELVQELQPYKIIFLTGTGGLLDAEGKLIDSINLSTEYDHLMQQPWINGGMRVKIEQIKDLLDRLPLESSVSITRPADLAKELFTHKGSGTLVRRGERVLRATSWDELDLPRLTSLIESSFGRTLVPDYFSNTKLLRAYVSENYRAAVILTDEGMLGASALIYLDKFAVLDDAQGEGLGRAVWNVMREETPQLFWRSRHNNQVNIFYYAESDGCIKQEKWKVFWYGLENFEQIQHCVAHCATRQPTLLG

SEQ ID NO: 40712 - protein, 305 aa, Pseudomonas aeruginosa PAO1
MSVRHFLSFMDYSPEELIGLIRRGSELKDLRNRGVLYEPLKSRVLGMVFEKASTRTRLSFEAGMIQLGGQAIFLSPRDTQLGRGEPIGDSARVMSRMLDGVMIRTFAHATLTEFAAHSKVPVINGLSDDLHPCQLLADMQTFHEHRGSIQGKTVAWIGDGNNMCNSYIEAALKFDFQLRVACPEGYEPKAEFVALAGDRLRVVRDPREAVAGAHLVSTDVWASMGQEDEAAARIALFRPYQVNAALLDGAADDVLFMHCLPAHRGEEISEELLDDPRSVAWDQAENRLHAQKALLELLIEHAHYA

SEQ ID NO: 40713 - protein, 305 aa, Yarrowia lipolytica CLIB122
MSDKSNFLVDFLMGGVSAAVSKTAAAPIERVKLLIQNQEEMIKQGRLSRPYKGIIDCFKRTAADEGIASFWRGNTANVIRYFPTQALNFAFKDKFKKMFGFKKSEGYWWWMAGNLASGGLAGATSLAFVYSLDYARTRLANDAKSVAKDGKAAGERQYNGLIDVYRKTIASDGIAGLYRGFGVSVVGIIVYRGLYFGLYDSLKPVVLVGPLEGNFLASFLLGWTVTTGASTASYPLDTVRRRMMMTSGTGVKYSSSMACMASIIKNEGVGALFKGCGANILRGVAGALVISMYDQMQMIMFGKKF

SEQ ID NO: 40714 - protein, 426 aa, Xanthomonas axonopodis pv. citri
MASAKEISQYLKRFSQLDAKRFAVVKVGGAVLRDDLDALTSSLSFLQEVGLTPIVLHGAGPQLDAELSAAGIEKHTINGLRVTSPEALAIVRKVFQASNLKLVEALQQNGARATSITGGVFEAEYLDRDIYGLVGEVKAVNLAPIEASLQAGSIPVITSLGETPSGQILNVNADFAANELVQELQPYKIIFLTGTGGLLDADGKLIDSINLSTEFDHLMQQPWINGGMRVKIEQIKDLLDRLPLESSVSITRPSDLAKELFTHKGSGTLVRRGERVLRATSWDELDLPRLKSLIESSFGRTLVPDYFDTTTLLRAYVSENYRAAVILTDEGQFGAGRLTYLDKFAVLDDAQGEGLGRAVWNVMREETPQLFWRSRHNNQVNIFYYAESDGCIKQEKWKVFWYGLENFEQIQHCVAHCATRQPTLLG

SEQ ID NO: 40715 - protein, 492 aa, Yarrowia lipolytica CLIB122
MSVQSVMDVLRDIQANPTDAKAMEQLVKQVSALEAASKTPAQTTKTLTPPMLPADDEDTEMETDKPFVTPLSPPKYEGRVILTTYPGQSGVKPIPLRWGAEDPKVRGPIVVARDQSSFKQRNAIGAHHGSYGIYHALAVATNDLPVTHRADYTNAYPLHTFGPHPQWSDPKKIVAMDPYGHLAPWLFHETIAEGVVVKPTIAVTRAQMQLAEIRDEVRDGTMEVDGEIVLNKSGDLAVTKVAVEPVWYLPGVAERFGITEGELRRALFEDTGGMYPELVTRPDIKVFLPPIGGLTVYIFGDPDRVSDPSKKLALRVHDECNGSDVFGSDICTCRPYLTFGISEAVKEAQKGGSGVVIYFRKEGRALGEVTKYLVYNARKRGGDSAATYFKRTENIAGVKDMRFQALMPDILHFLGIQKIDRMLSMSNMKHDAIVEQGIPIHERVPIPDEMIPPDSRVEIDAKIAAGYFTTGAVMSEEELSGVKGRTWDDVVH

SEQ ID NO: 40716 - protein, 436 aa, Pseudomonas aeruginosa PAO1
MRISIFGLGYVGAVCAGCLSARGHEVIGVDVSSTKIDLINQGKSPIVEPGLEALLQQGRQTGRLSGTTDFKKAVLDSDVSFICVGTPSKKNGDLDLGYIETVCREIGFAIREKSERHTVVVRSTVLPGTVNNVVIPLIEDCSGKKAGVDFGVGTNPEFLRESTAIKDYDFPPMTVIGELDKQTGDLLEEIYRELDAPIIRKTVEVAEMIKYTCNVWHAAKVTFANEIGNIAKAVGVDGREVMDVICQDHKLNLSRYYMRPGFAFGGSCLPKDVRALTYRASQLDVEHPMLGSLMRSNSNQVQKAFDLITSHDTRKVGLLGLSFKAGTDDLRESPLVELAEMLIGKGYELRIFDRNVEYARVHGANKEYIESKIPHVSSLLVSDLDEVVASSDVLVLGNGDELFVDLVNKTPSGKKLVDLVGFMPHTTTAQAEGICW

SEQ ID NO: 40717 - protein, 392 aa, Chlamydophila pneumoniae CWL029
MDYYSILGISKTASAEEIKKAYRKLAVKYHPDKNPGDAAAEKRFKEVSEAYEVLSDPQKRDSYDRFGKDGPFAGAGGFGGAGGMGNMEDALRTFMGAFGGEFGGGSFFDGLFGGLGEAFGMRSDPAGARQGASKKVHINLTFEEAAHGVEKELVVSGYKSCETCSGQGAVNPQGIKSCERCKGSGQVVQSRGFFSMASTCPECGGEGRIITDPCSSCRGQGRVKDKRSVHVHIPAGVDSGMRLKMEGYGDAGQNGAPSGDLYVFIDVESHPVFERRGDDLILELPIGFVDAALGMKKEIPTLLKTEGSCRLTVPEGIQSGTILKVRNQGFPNVHGKGRGDLLVRISVETPQNLSEEQKELLRTFASTEKAENFPKKRSFLDKIKGFFSDFTV

SEQ ID NO: 40718 - protein, 489 aa, Pseudomonas putida KT2440
MAAISVEPCTFALFGALGDLALRKLFPALYQLDRANLLHPDTRLLALAREVGSAQEHLDSIEAHLRRHVPEADIEPAALGRFLARLNYQHLDFLQPEGYQALAEQLPGELPLIAYFATAAAVYGAICENLDKVGLAARTRVVLEKPIGHDLESSRRVNDAVARFFPESRVYRIDHYLGKETVQNLIALRFANSLFETQWNQNSISHVEITVAEKVGIEGRWGYFDKAGQLRDMIQNHLLQLLCLIAMDPPSELSADAIRDEKVKVLKALAPITGDGLSTSVVRGQYIAGYSEGKPVPGYLEEDNANAQSDTETFVALRADIRNWRWSGVPFYLRTGKRMPQKLSQIVIHFKETPHYIFAPEQRLQIGNKLIIRLQPDEGISLRVMTKEQGLDKGMQLRSGPLQLNFSDAWRSARIPDAYERLLLEVMRGNQNLFVRKDEIEYAWKWCDQLIAGWRNAGDAPKPYAAGSWGPMSSIALITRDGRAWYGDI

SEQ ID NO: 40719 - protein, 424 aa, Vitis vinifera
MARESEKQPKPKAIIVGGSIAGVSCAHALTLAGWNVVVLEKTCAPPTGSPTGAGLGLDPLAQRLIESWVGDPDSLRKATVPLTIDQNQAIDGKKIRGTLTRDENLNFRAAHWADLDGLLYNALAEDVFLWGHLFLSFSISDDKSCVKVKSKVLETGEIIETVGDLLVAADGCLSAIREHFLPDLQLRYSGYCAWRGVLDFSENENSETIQGMRRAYPDLGKCLYFDLGSGTHSGIYELLNKRINWLWYVNQPQPEMKGKSVTMKVSSDMIEKMHQEAEMAWAPELVRVMKETKEPFLNAIYDCDPLEQIFWDNVVLIGDAAHPTTPHGLRSTNMSVLDAAVLGKCLEKWGVENLSSALEEYQSTRLPVTSKQVLHARRLGRLKQGLILADRKPFDPKTASLEDCEELQQKNMPFFADIPLPLNS

SEQ ID NO: 40720 - protein, 177 aa, Vitis vinifera
MAGPSSSWAHALVQISPYTFSAIGIAVAIGVSVLGAAWGIYITGSSLIGAAIKAPRITSKNLISVIFCEAVAIYGVIVAIILQTKLESVPASKIYAPESLRAGYAIFASGIIVGFANLVCGLCVGIIGSSCALSDAQNSSLFVKILVIEIFGSALGLFGVIVGIIMSAQATWPAGSA

SEQ ID NO: 40721 - protein, 776 aa, Zea mays
MDSLSRRERAHRAVDAMKPLGFSKKEVFAVLKNLLQLFDNSWEPIEDECYRALADAILEARDRPQMHCSNSTRGVRLPPEGEGCRPRPSTSRDIHDGLDGGTEALRIKRTRISASCSIDPQSPVSAAEALDEPIGVSSELSHPQMGTSTQCQRPTAYGGVPSHGNTAHKKRAIQMMDEDFQHTVFLREPKPEPDTDDLQCSAPASSCQNAQLGRIASHPLNASTLDALPVQAPLKISGANGRTVQHYRSTAPSSFVEPINSKTKQPQSLENGLDHATMMHNAGTGSAAGKTQEAPCLHTLVASSTMGEVEMSIKCCIDPSKFHMPDLEAVFKMVEEKCLRSHKSLPPDFSIAGLIKQICQCVARLGSDHAAEHNKQSDAFGKIRSSQDKPTTSSAPSLEPIDCMNSRSGEYKAVEESLIVEASENGPPNSTTHQQAHLVLPPNGCTHDLSDISKGKERLSISAVNEFGSENCLPSFYYIPRNLVSQDSYVNSVETIGDKDCCSDCSGNCLYASEPCACARKTGGEFAYTRDGLVRTKFLDECISMNRFPEKHNMFFCKSCPLESIRNEPSPELCRGHIIRNFIKECGSKCGCNAQCGNRVVQRGITCNLQVFSTREGKGWGLRTLDELPKGAFVCEYVGELLTNTKLHEMTTQNMHNARYSVLLDAGWGPDGVLKDEEALFLDATFCGNVGRFINHRCYDANLVEIPVEKETPDHHYYHFAFFTTKKVEAFEELTWDYGIDFDGDKHPVKSFECLCGSRYCRGRKHSRTRGKAASK

SEQ ID NO: 40722 - protein, 359 aa, Dehalococcoides sp. CBDB1
MSKVCIIGTTTWGITLGTIIAHKGREVMLWARTEDEAMLLSTQRRPADFLPENYHFPEFMNVTACLEEAVAGADMVLLAVPSQRMRPNIRLVAPLLTKSMLICSAAKGLEIGTAKRMSQVITDEISPDFAKNICVLSGPNLAMEILKGLPAVTVLAADTEKTAKKAAKLITAANFSAYTNTDIIGVELGGSLKNIIALGAGIVDGLNLGNNAKSALITRGLTEISALGAALGANPLTLSGLAGLGDLIATCSSNLSRNHFVGVELTKGRSLNDIMYNMSNVAEGVSTTAVAYEMARSMDLEMPVTENIYNVLYNNADPKEAARILMDAQATHELAGRKWNLFKMFRKRKARKTPELNPD

SEQ ID NO: 40723 - protein, 380 aa, Vitis vinifera
MEDRKDVINGGENGSSSEGRPPNPISSAYRQCFGSAKVNAPCKKSLVRHPSLLKMKTTENSVESGLSVEDHETDFIPIVRSGAWTDVGFRKSMEDVYVCVDNFTSEYGFKNLNEEPNAFYGVFDGHGGKHAADFVCYHLPRFIVEDEDFPREIERVVASAFLQTDNAFAEACSLDAALASGTTALAALVVGRSLVVANAGDCRAVLCRRGKAIEMSRDHKPVCSKEKKRIEACGGYVYDGYLNGQLNVARALGDWHMEGLKDVDGGPLSAEPEFMTTRLTEEDEFLIIGCDGIWDVFRSQNAVDFARRRLQEHNDPALCSKDLVDEALKRKSGDNLAAVVVCFQPQAPPNLVAPRPRVQRSISAEGLRELQSFLDGLGKD

SEQ ID NO: 40724 - protein, 387 aa, Oryza sativa Japonica Group
MAAKAAALSSSPFVSSRRLSSPAASLRARTPRCVMGSEQVRVVVEEEGKTKKRMGVAEPRSAPPAVWTPRAPAQEARLAALRTDGRDSRLKIFSGTANRPLAQEIASYLGVDLGKVLIKRFADGEIYVQLQESVRGCDVFLVQPTCSPVNENLMELFVMIDACRRASARSITVVIPYFGYARADRKAQGREAITAKLSANLLTEAGSDRVIVCDIHSTQALGYFDIPVDHIHGQPVILDYLASKTISKDLVVVSPDVGGVVRARAFAKKLSDAPLAIVDKRRQGHNMSEVMHLIGDVKGKVAIMVDDMIDTAGTITSAAALLKQEGAEAVYACSTHAVFRFGSWFIVTSMIHVIVLIHWLVAKEPCYGMIRQIGFMFDQYKNDRVEQ

SEQ ID NO: 40725 - protein, 309 aa, Fusobacterium nucleatum subsp. vincentii ATCC 49256
MSKKSTRQAYGEALVELGRINNDIVVLDADLSKSTKTDLFKKEFPKRHLNIGIAEADLMGTAAGFATCGKIPFASTFAMFAAGRAFEQIRNTIAYPKLNVKIAPTHAGISVGEDGGSHQSIEDIALMRAIPGMVVLCPCDAVETKKMVFAAAEYNGPVYLRLGRLDVETVLDDNYDFQIGIANTLRDGSDVTIVSTGLLTQEALKAADELAKENISVRVINCGTIKPLDGETILKAAQETKFIITAEEHSVIGGLGSAVSEFLSETHPTLIKKLGVYDKFGQSGKGTEMLEKYELTAAKLISMVKENLK

SEQ ID NO: 40726 - protein, 359 aa, Dehalococcoides sp. CBDB1
MVNKRDYYEVLGLERSASDEDIKKAFRKMAMKHHPDRNHEEGAADKFKEVNEAYEVLSNPEKRAAYDRFGFSAGADSFGQGGFENFDFGGLGSIFETFFGGATQGAKRGPRRGPDMSYDIKISLEEAATGVEKDITTERLEYCTECSGTGAKAGTSPVKCTSCNGTGQVYQVQKSVFGRFTSVTPCPKCRGEGTIIGEPCTKCRGTGKEYVKRTVQVKIPAGVADGNQIRLNGYGGVGDKGASAGDVYINVGIAEHADFKRDGDDVIYELEINFAQAALGTEVNVPGLNTEHKLKIPSGSQNGKYFVLKGKGIPHLNRFGSGDEMVHLNVVTPEKLSRKQKQLFEELEKSFAEDKKQAT

SEQ ID NO: 40727 - protein, 303 aa, Glycine max
  misc_feature (24)..(24): Xaa can be any naturally occurring amino acid
VGLEGDMQLISEAYDVLKHVGGLXFRGLADIFAEWNRGELESFLIEITADIFKVKDEDGEGFLVDKILDKTGMKGTGKWTVQQAAELSIAAPTIAASLDCRYLSGLKEERESAAAVLKEAGLSDELGRVNVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNSGAGVGALN

SEQ ID NO: 40728 - protein, 473 aa, Synechococcus sp. WH 7803
MASTAQDVLRQIKDEGIELIDFKFTDLHGKWQHLTICSDLLEADSFEEGLAFDGSSIRGWKTIDASDMAMVPDPSTAWIDPFYSHKTLSMICSIQDPRTGTLYDRCPRALAQRALAYLSGSGLADKAFFGPEPEFFLFDDVRYNSSEGGSFYSVDTIEASWNSGRLEEGGNLGYKIQLKEGYFPVAPNDTAQDIRSEMLLMMAQLGIPIEKHHHELAGAGQHELGMKFAELIKAADNTMTYKYVVRNVAKKYGKTATFMPKPVFNDNGSGMHVHQSLWKAGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALEALNADHHYLMEGGVFSKDFINNWIDLKYEEVQQLRQRPHPHEFTMYYDA

SEQ ID NO: 40729 - protein, 134 aa, Lactobacillus delbrueckii subsp. lactis
HARGLLCTSIGREIAERLELPQMWQDNTDPFGTAFTVSVDYKTTTTGISAYDRATTIKALADPEAKPEAFFKPGHCFPLVAKDGGVLERNGHTEASVTLARLAGEAEVAYICEILKEDGHMARRPEMEEIAKEY

SEQ ID NO: 40730 - protein, 299 aa, Yarrowia lipolytica CLIB122
MNRLGAAQRLTRGLSATRSQLHRLRAFSTSGSCLNDDKSTHFGFKTVDKDSKESLVGQVFSSVASKYDIMNDVMSFGIHRLWKDEFVNTLNPGRRAGSNEQLSFLDVAGGSGDIAFRILDNAKRRHGDVSSNMTVVDINPNMLAEGEKRAAAHPEYANDPRIKFLVQNAETLDQIPDESQDLYTVAFGIRNFTNIPKALETAHRVLKPGGVFACLEFSKVDNFILDQVYTQYSFNVIPMMGQIVAGDRDSYQYLVESIVRFPTQEKFAQMIQDAGFTLAGDGYKNLTFGVAAVHIGVKL

SEQ ID NO: 40731 - protein, 418 aa, Zea mays
SRRLFAAERAAAMNGASAGVGGEAPLVYKAWKGNNVFLLKGRFIFGPDARSLFITMFLIVAPVSIFCAFVAKELMDKFSYGLGLPVMIAAVLFTAYDLSLLLLTSGRDPGIIPRNAHPPEPEGFDGNAEVGANQTPPVRLPRVKDVVVNGITVKTKYCDTCMLYRPPRCSHCSICNNCVERFDHHCPWVGQCIGLRNYRFFYMFVFSTTLLCLYVFGFCWVFIIKIRNAEQITIWKAMTKTPASIALIIYTFIAVWFVGGLSVFHLYLMSTNQTTYENFRYRYDQRDNPYNKGVMENIKEIFFTTIPPSKNNFCGRVEQEHGLRPRPTNGFMSPNMGRAVGDIEMGRKPVAWDEPRMAAEIGDLGAGLSNLLEDKDGRFRTTSPDLSRDALAVGGGLEEHGSSAMNPGRSSWGVEAGR

SEQ ID NO: 40732 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGMDEKLLALPIDKVDPTHSYVKDIDDLSKHTLDKIKHFFETYKDLEPNKWVKVKGFEN

SEQ ID NO: 40733 - protein, 305 aa, Coprinopsis cinerea okayama7#130
MTSNDSSSQADVYKAPRNEDGSIKFHTTSFRDTIERGGKFEPECAWATRTLIVRKLKGLEDIIHEFPGAETDPLYNSQYVKELYLRANTAYTGRFSVPLLWDKKNQTIVNNESAEIIRIFNSAFNEFLSEDKAKLDLYPEDLRAEIDSVNDWVYHGINNGVYSTGMAATQAAYEKNVHELFDSLDKVEKILQGRDYLVGDRLTEADIRLWVTIIRFDPVYVGQFKCNIRTIRDGYPAIHSWLRKLYWNIPAFKDSTDFDHIKTTYYWSHASSSRRAIQIIYSAPPTRTEIQRQSSDRYMIYEQVM

SEQ ID NO: 40734 - protein, 143 aa, Vibrio angustum S14
MTIERTFSIVKPDAVKRNLIGAIYQRFENAGLNIVAAKMLHLDSAKAQGFYAEHEGKPFFDDLVAFMTSGPVMVQVLEGENAITRYRELMGKTNPEEAACGTIRSDFALSMRHNSVHGSDSPESAAREIAYFFAEDEICPRGE

SEQ ID NO: 40735 - protein, 202 aa, Rickettsia conorii str. Malish 7
MNMSVFVGKTAPDFTAKAIMPNNNIDDKFKLSNYAAGDNIVLFFYPLDFTFVCPSEIIAFHNKLGEFTERRTKVVAVSVDSHFSHLAWKNTPHNKGGLGQVQFPMVSDIKKDISSKYNVLNEDGVALRGTFLIDKDFIVRHMLVNDLPIGRDINYTLKVIDALTHHQKHGEVCPAGWHKGEEAITPSHEGIAHYLSSHAEKL

SEQ ID NO: 40736 - protein, 403 aa, Zea mays
  misc_feature (62)..(62): Xaa can be any naturally occurring amino acid
MGALSRPEEVLALVKLRVAAGQIKRQIPPEEHWAFAYSMLQKVSRSFALVIQQLGPELRNAXSVCIFYLVLRALDTVEDDTSIPTEVKVPILQEFYRHIYNRDWHYSCGTNHYKMLMDKFHHVSTAFLELGEGYQKAIEEVTRRMGAGMAKFICKEVETVDDYDEYCHYVAGLVGYGLSRLFYAAGTEDLALDSLSNSMGLFLQKTNIIRDYLEDINEIPKSRMFWPREIWSKYADKLEDFKYEENSKKAVQCLNNMVTDALIHAEECLQYMSALKDHAIFRFCAIPQIMAIGTCALCYNNVHVFRGVVKMRRGLTARIIDETNSMTDVYTAFYEFSSLIESKIDDSDPNAALTQRRVDSIKQTCKSSGLVNQRGYHLEKSPYRPMLIMIVLLLVAILFGVMF

SEQ ID NO: 40737 - protein, 660 aa, Arabidopsis thaliana
MISPLTLKTPSSSSSYFKPERFLASFGSGQDDALQYILFGSGRRCCLGVNLSYIFVGTAIGMMLQCFDWKTKGDKVDMEEAIRGLNLTMAHPLKCIPVARNLNPLACSNLKPCNFEFAKKLLVRGSSAPLSFERERDFHVSEADFYKSLWSRHGLPNITYFAWPDTRRKPKEPRLHYDLPPSPPTLPIIGHLHLLLSVLVHRSLQTLSTKYGSILYLRVFSFPVALVSSASIAYEIFREHDVNISSRGFPPTDDSLFAGSFSFTSAPYGDYWKFMKKLLVTNLLGPQALERSRGFRADELDLFYENLLDKAMKKESVDICVEALKLSNNSICKMIMGRSCSEENGEAERVRALATQLDGLTKKILLANMLRAGFKKLVVSLFRKEMMDVSSRFDELLERILVEHEDKLDMHHQGTDLVDALLAACRDKNAEYKISRNHIKSFFADLLFASTDTFVQTTQWTVAEIINNPNVLERLRGEIDSVVGKARLIQETDLPNLPYLQAVVKEGLRLHPPGPLFARFSQEGCRIGGFYVPEKTTLMINAYAVMRDSDSWEDPDEFKPERFLASSRSEQEKERREQAIKYIAFGSGRRSCPGENLAYIFLGTAIGVMVQGFEWRIKEEKVNMEEANVGLSLTMAYPLKVTPVPRTLVPLTQNPLNRSS

SEQ ID NO: 40738 - protein, 556 aa, Coprinopsis cinerea okayama7#130
MAGYTSLKDIEKIHKEVHETFLAASLPSLVDSARTRSTSPFPLFSIPYRIHQLHQLAKLVQDNASAFQEALHGDLGKPPREVLMAEVGPVIERSLAAAAQVEEWAKTEYVQGVPAWQSEWKARVEKRAKGVVLIISPWNYPMILTFQPLMGALAAGCCAVIKPSEMVPRFSALLADLVPKYLDSAAYRVVQGAVPEITRLIELKWDHIFYTGNGRVGRIISAAAAKHLTPLTLELGGKSPVIVDVDTCGDLELVAKRIIWGKINNAGQICIAPDYVLIQSSHIPALIQGIKKALDEFFPSGALSSKDYGRIVTPLHFNRVKSLLERTKGRIVLGGKTGKGGEDAQDRGIEPTVVVFESLEEAGRDVLLEDELFAPLLPVVGVESVVDALEYVRRRDHPLVLYAFTNDENLKQYISDSTMSGNLVFNDTFQQLSVDQLPFGGVGESGHGRQTLKYTFDEFVYQRSVVDIPQSAEPGLQIRYPPTTQANLDFFSVALKREIPEVKPKPESEVHGVKTAMKTAVPLVNGKGVNDVNGVNGVKGVNDVVVDVKPVNGTGV

SEQ ID NO: 40739 - protein, 279 aa, Bacillus pumilus SAFR-032
MNHLQSTKTLNNGVHMPGFGLGVFKVEDGAELIDAVKTAIQLGYRSIDTAAIYGNEEGVGRGIQLGLAETGLRREDLFVTSKVWNADLGYESTLKAYEESLKKLQLDYLDLYLIHWPVEGKYKDAWRALETLYREGKVRAIGVSNFQPHHLDELLKDADIIPAINQVEFHPKLTQEALYTYLNTHGIQMEAWSPLMQGELLHHPVIKELADTYGKTPAQIILRWDVQKGVITIPKSTKAHRLKENADIFDFALSDEDMKRLSDLNENKRIGPDPDNFDF

SEQ ID NO: 40740 - protein, 159 aa, Glycine max
RLPPWPPPNCFLTASYSLTLRRVMDTAKLVTKSGNLNEFSMVLLNNTLSLPLGIFMIIVFNEVDYLLTTPLLRLPSFWLVMTFSGFLGLAISFTSMWFLHQTGATTYSLVGSLNKIPLSIAGILLFKVPTSLENSASILFGLLAGVFFARAKILERSQS

SEQ ID NO: 40741 - protein, 334 aa, Methylobacillus flagellatus KT
MLLVTGGTGYIGSHACVELINAGYEVVVLDNFSNSQAHIVDRIKQITGKAPVLVEGDVRDEALLSDLFSRYPFQAVMHFAGLKAVGESVAQPLRYYDNNVAGSVTLLRVMQAHDVKRLVFSSSATVYGDPASVPIREDFPLSATNPYGASKLMVEDILRDLAVSDPEWRIAILRYFNPVGAHESGLIGENPNGMPNNLMPYITQVAQGQRESLSVFGSDYPTVDGTGVRDYIHVVDLVVGHLRALERLDKEAGVFTCNLGTGQGYSVLEMVKAFEDASGQAVPYQLVARRPGDVAASYTDPAYAEQALGWKATRGIEQMCKDSWHWQQNLAQRG

SEQ ID NO: 40742 - protein, 328 aa, Prochlorococcus marinus str. NATL2A
MSRIYEDNSFAIGHTPLVKLNSITKNAKATVLAKIEGRNPAYSVKCRIGANMIWDAEKKGLLNKDKVIIEPTSGNTGIALAYTAAARGYKLILTMPESMSIERRRMMAVLGAELILTEAAKGMPGAIAKAKEIADSDPKKYFMPGQFDNPANPEIHFKTTGPEIWDDTDGQIDVLVSGVGTGGTITGVSRFIKQEKNHSLLSVAVEPTHSPVITQTLNGEEVKPGPHKIQGIGAGFIPQNLDLSVVDQVEQVSNDESIAMALRLAQEEGLLVGISCGAAAAVALRLAEKEEFSGKTIVVVLPDLAERYISSVMFENVPTGVIKEPSLA

SEQ ID NO: 40743 - protein, 201 aa, Escherichia coli CFT073
MIRSKRAVSTTVTSRHTLMTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 40744 - protein, 487 aa, Vigna radiata
MRRGLDNQAYYVLGHKTPNIRDLYTLGRKLGQGQFGTTYLCTENSTSNEYACKSISKRKLISKEDVEDVRREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKPGQIFTDVVGSPYYVAPEVLLKHYGPEADVWTAGVILYILLSGVPPFWAETQQGIFDAVLKGHIDFDSDPWPLISDSGKDLIRKMLCSQPSERLTAHQVLCHPWICENGVAPDRAIDPAVLSRLKQFSAMNKLKKMALRVIAESLSEEEIAGLREMFQAMDTDNSGAITFDELKAGLRRYGSTLKDVEIRDLMEAADVDKSGTIDYGEFIAATVHLNKLEREEHLIAAFQYFDKDGSGYITVDELQQACAEHNMTDAFLEDIIREVDQDNDGRIDYGEFAAMMQKGNAGIGRRTMRNSLNLSMRDASSAQ

SEQ ID NO: 40745 - protein, 643 aa, Escherichia coli CFT073
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGTLDDDQALSLVEAMVEANGERVMALINEAAARGIEWEALLVEMLGLLHRIAMVQLSPAALGNDMAAIELRMRELARTIPPTDIQLYYQTLLIGRKELPYAPDRRMGVEMTLLRALAFHPRMPLPEPEVPRQSFAPVAPTAVMTPTQVPPQPQSAPQQAPTVPLPETTSQVLAARQQLQRVQGATKAKKSEPAAATRARPVNNAALERLASVTDRVQARPVPSALEKAPAKKEAYRWKATTPVMQQKEVVATPKALKKALEHEKTPELAAKLAAEAIERDPWAAQVSQLSLPKLVEQVALNAWKEESDNAVCLHLRSSQRHLNNRGAQQKLAEALSTLKGSTVELTIVEDDNPAVRTPLEWRQAIYEEKLAQARESIIADNNIQTLRRFFDAELDEESIRPI

SEQ ID NO: 40746 - protein, 847 aa, Rosa hybrid cultivar
MEMPGRRSNYTLLSQVPDDHFAAATATSFYESEGKNNNNKAKGDSRGFDWETGGGEYRAAPANRIGNVYSSVGLQRQSSGSSFGESSLSGEYYAPTLSTTAANEIDGFGYVNDDGFKTGGGGGEFRGKGGGMDGGVGPPGGSSSGKSWAQQTEESYQLQLALALRLSSEATCADDPNFLDPVPDESSSRLSSSADAVSHRFWVNGCLSYFDKVPDGFYLIHGIDSYVWSMCTDVQESGRIPSIESLKSVDPGTGSSIEVVLIDRRSDPSLKELQNRVLSISYACITTTEIVDQLAKLVCSRMGGSASVGEAEFFSIWRESSDDLKDCLGSVVVPIGSLSIGLCRHRALLFKVLADTIDLPCRIAKGCKYCTRDDASSCLVRFGIDRELLVDLIGNPGCLCEPDSLLNGPSSISISSPLRFPRLRTVEPTIDFRSLAKQYFSDCQLLNLVFDEAPAGSAGDEDNKGFSMYPKQKFTDGNNLFLVSGLGDDTSMHVDDRNPQFLKSFNPSQNIVHQQTVLKDQIPLKRIPPIGHRDISRLDTSKDSRFGEGLQVVPSKPNKELTLDVDDLDIPWSDLVLKERIGAGSFGTVHRADWHGSDVAVKILMEQEFHAERFNEFLREVAIMKRLRHPNIVLFMGAVTKPPNLSIVTEYLSRGSLYRLLHKPGPILDERRRLYMAHDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDLNPQVASIIEACWANEPWKRPSFASIMESLRPLIKAPTPQPSHADMPILT

SEQ ID NO: 40747 - protein, 530 aa, Bordetella parapertussis 12822
MHQRILILDYGSQVTQLIARRVREAGVYSEIHAGDVDDAFVRDQVAQGLKGIILSGSHASAYEEGSMRVPAAVFEVGVPVLGICYGMQSMAQQLGGTVSFSDHREFGYAEVRAHGHTKLLDGLADFTTDEGHGMLKVWMSHGDKVTELPPGFKLMASTASCPIAGMADEDRGFYAVQFHPEVTHTVQGKAMLARFVKDICGCEGDWNMPDYISEAVARIREQVGSDEVILGLSGGVDSLVAAALIHRAIGDQLTCVFVDHGLLRLDEGKQVMQTFAENMGVKIVHVDATSQFMGKLTGVADPEAKRKIIGREFVEVFQDEAGKLQGAKWLAQGTIYPDVIESAGAKTGKATSIKSHHNVGGLPDTLNLQLLEPLRELFKDEVRELGVALGLPPQMVYRHPFPGPGLGVRILGEVKHEYAELLRRADAIFIEELRNAKDPASGLTWYELTSQAFAVFLPVKSVGVMGDGRTYEYVVALRAVQTFDFMTADWAPLPHPLLARVSSRIINEVRGINRVVYDVSSKPPATIEWE

SEQ ID NO: 40748 - protein, 504 aa, Kluyveromyces lactis NRRL Y-1140
MSKDELKDKKRKVEDEELKSKKKLKKDKKDKKDKKDKKDKKDKKEKKEKKEKKDKKSETESFAASASQSDIDEFLKENEVTVSDPSGSNIVPYLDFSQVSFIDQIQKEISKFPKPTPIQAVSWPYLLAGKDVIGIAETGSGKTFAFGVPAINNIVTSGDKSSSVKVLVISPTRELASQIYDNLIVLTDACGLRSCCVYGGVPKDQQREDLRRSQVVVATPGRLLDLIEEGSVDLSHVNYLVLDEADRMLEKGFEEDIKKIIRQTRSTSRQTLMFTATWPKEVRELASSFMSEPVKVSIGNRDELSANKRITQIVEVVDPFRKEKKLLELLKKYHSGPTKNDKVLIFALYKKEASRVERNLKYNGYDVAAIHGDLSQQQRTQALNEFKAGKCNLLLATDVAARGLDIPNVKTVINLTFPLTVEDYVHRIGRTGRAGQYGTAHTLFTEQEKHLAGALVNVLNGAGQPVPEELKKFGTHTKKKEHSAYGAFFKDVDLSKKPKKITFD

SEQ ID NO: 40749 - protein, 481 aa, Pseudomonas aeruginosa PAO1
MIPVILSGGSGSRLWPLSRKQYPKQFLALTGDDTLFQQTIKRLAFDGMQAPLLVCNKEHRFIVQEQLEAQNLASQAILLEPFGRNTAPAVAIAAMKLVAEGRDELLLILPADHVIEDQRAFQQALALATNAAEKGEMVLFGIPASRPETGYGYIRASADAQLPEGVSRVQSFVEKPDEARAREFVAAGGYYWNSGMFLFRASRYLEELKKHDADIYDTCLLALERSQHDGDLVNIDAATFECCPDNSIDYAVMEKTSRACVVPLSAGWNDVGSWSSIWDVHAKDANGNVTKGDVLVHDSHNCLVHGNGKLVSVIGLEDIVVVETKDAMMIAHKDRVQDVKHVVKDLDAQGRSETQNHCEVYRPWGSYDSVDMGGRFQVKHITVKPGARLSLQMHHHRAEHWIVVSGTAQVTCDDKTFLLTENQSTYIPIASVHRLANPGKIPLEIIEVQSGSYLGEDDIERLEDVYGRTAEPALQVVAGSR

SEQ ID NO: 40750 - protein, 170 aa, Bacillus cereus G9241
MIYPYKEKNPKIASSAFIADYVTITGDVTVGEESSIWFNTVIRGDVSPTIIGNRVNVQDQCTLHQSPQYPLILEDDVTVGHQVILHSCHIKKDALIGMGSIILDGAEIGEGAFIGAGSLVSQGKKIPPNTLAFGRPAKVVRELTEEDRKDMERIRTQYVEKGQYYNSLQK

SEQ ID NO: 40751 - protein, 442 aa, Chlamydophila pneumoniae CWL029
MTLQPYQASSRKYRPQIFREILGQSSVVAVLKNALVFNRAAHAYLFSGIRGTGKTTLARILAKALNCVHLSEDGEPCNQCFSCKEIASGSSLDVLEIDGASHRGIEDIRQINETVLFTPVKAKFKIYIIDEVHMLTKEAFNALLKTLEEPPQHVKFFFATTEIHKIPGTILSRCQKMHLQRIPEKTILEKLSLMAQDDHIEASQEALAPIARAAQGSLRDAESLYDYVISLFPKSLSPDTVAQALGFASQDSLRTLDNAILQRDYATALGIVTDFLNSGVAPVTFLHDLTLFYRNLLLTNSTTSKFSSQYKTEQLLEIIDFLGESAKHLQNTIFEQTFLETVIIHIIRIYQRPVLSELISSIKSRQFEGLRNIKEPTLTQQVSAPQPQPTYKEQSFLEKKNQPAAEGKIISVEVKSSASIKSAAVDTLLQFAVVEFSGILRQ

SEQ ID NO: 40752 - protein, 536 aa, Yarrowia lipolytica CLIB122
MAASTSSSIPDNVEKSASVEKSASAEDYEMVHAPVEENPEFVVDDVKRNRRQRIADGFTVLAAGFALISDGYQNSMMTMMNVTFQERYGKEVYNSTVSTRVSNALLVGEVIGMIVIGLTCDYMGRKTAIVVTTILIVLGGIMATASHGVTTDGMFWMLVVSRGVIGFGSGGEYPAASTSASEAANEKHLRKRRGAIFVLCTNLPLSFGNPFCVIVFLIVYAACGFKGQHLSTVWRTCMGIGCIWPLTVFYFRLKMAQPRLYTKSAIKKSVPYWLILKFYWRTIIGTAGTWFIYDFVVFPNGVFSGSIIATIIKPDEPDKLLKTAEWQLLIGAIGLPGVFIGAWLCENRVLGRKYTMLIGFALWIVVGLIIGCAYTPLKRSTGAFVFMYGMLSSSGNLGPGNMLGLVSSEAYATAVRGTLYGFSAAVGKAGAAVGTQVFKPIQGNLGDRWTFIIAAILGLCGVIVTLFFVPRLNGEDLEEEDVRFKQFLRAHGWEGEFGTVADKVDDIEETTSDEAHDTDGIETQQIITETPNKMSN

SEQ ID NO: 40753 - protein, 143 aa, Methylococcus capsulatus str. Bath
MAVERTLSIIKPDAVAKNVIGEIYSRFEKAGLRIVAAKMAQLSREQAEGFYAVHRERPFFNDLVSFMISGPVMIQVLEGENAIAKNRELMGATNPRDAAPGTIRADFAVSIDENAVHGSDGPETAAQEIAYFFESDELCPRTR

SEQ ID NO: 40754 - protein, 458 aa, Erwinia carotovora subsp. atroseptica SCRI1043
MSATEVSANANATVIAKFGGTSVADFDAMNRSADVVLSNPNVRVVVLSASAGITNLLVALAEGQTQETRAEHLAKIRQIQYAIIDRLTNQSVIRDEIDRMLDSVTTLSEAAALATSNALTDELVSHGELMSTLLFVEILRQRDVIAEWFDVRKIMRTDDHFGRAQPDCDVLGELTRSLLQPRLEQGLVITQGFIGSEAKGRTTTLGRGGSDYTAALLGEALNVNRIDIWTDVPGIYTTDPRVVPTAKRIDQIMFEEAAEMATFGAKVLHPATLLPAVRSDIPVFVGSSKDPAAGGTLVCNKTENPPLFRALALRRKQTLLTLHSLNMLHTRGFLAEVFSILARHNISVDLITTSEVNVALTLDTTGSTSTGGSLLSSALLTELSSLCRVEVEENLSLVALIGNKLSQACGVGKEVFGVLEPFRIRLICYGASSNNLCFLVPGDDAERVVQTLHRSLFE

SEQ ID NO: 40755 - protein, 525 aa, Pseudomonas putida KT2440
MALDIHAHRILILDFGSQYTQLIARRVREIGVYCELHPFDMDDEAIREFNPRGIILAGGPESVHEANSPRAPQAVFDLNVPVLGICYGMQTMAEQMGGKVEGSDLREFGYARVDVVGKSRLLDGIEDHVDDDGVLGLDVWMSHGDKVTQMPGNFNILASTPSCPIAGMYDDVRGYYGVQFHPEVTHTKQGGRILSRFVQDICGCEALWTASNIVEDAIAQVRAQVGSANVLLGLSGGVDSSVVAALLHRAIGDQLTCVFVDNGLLRLHEGDQVMAMFKENMGVKVIRADAEKQFLDNLEGEADPEKKRKIIGRTFIDVFDAEASKLENIQFLAQGTIYPDVIESAGAKSGKAHVIKSHHNVGGLPEEMNLKLVEPLRELFKDEVRKIGLELGLPYDMVYRHPFPGPGLGVRILGEVKKEYADILRRADHIFIEELRKADWYHKTSQAFVVFQPVKSVGVVGDGRRYAWVVALRAVETVDFMTARWAHLPYELLETVSGRIINEIDGISRVTYDVSSKPPATIEWE

SEQ ID NO: 40756 - protein, 484 aa, Erwinia carotovora subsp. atroseptica SCRI1043
MKTKTSYGLNWLAMIVILVIAAFFWQMEPPAGLNPAAWHSAVIFVATIVCIVANVLPIGAIGIISITLFALTYAAGDKTASGAIQTALSDLNSSLIWLIVVAFMIARGFIKTGLGRRIALQMIRLLGKRTLGLAYGLAFADLVLSPAMPSNTARCGGIIYPIADSLSRSFDSKPEDASRSKIGTFLITCIGNVNDVTAAMFMTAYTGNLLAVKLAANAGVTITWGSWFLAALVPCLISLAIVPLLVYWLTKPEIRHTPDAPKLAVAELAKMGSISRGEWLMAFTVILLLVLWIFGDRLGVDATTASFVGLSFLLLTGVLSWEDVKNEKGAWDTLIWFAALLMMANQLKKLGFTNWFGDLIGSNIGHLMQGTSWVLVLLLLNAAYFYTHYFFASGNAQIAALFAVFLGVGINLNIPAVPMAFMLAFTSSLYCSLTQYTHARGPILFGAGYVPTAVWWRTGFVVSLVNQAIFMGAGLLWWKAIDLY

SEQ ID NO: 40757 - protein, 330 aa, Dehalococcoides sp. CBDB1
MANEKNLYETLGVPKTASADEIKKAYRKLARKYHPDLNPGDKASEETFKKINQAYEILSNPENRTKYDKYGEQWQYGEQYEKARASQQQTQGSPFGGYDFNFGSSEGGGFEDILSQMLGGRTGRRRSHPQPGQSIEQPIDISLEEAASGTSRLLSFQMQKPCETCGGSGAKDKKVCPTCQGTGVNPGIERLEVKIPAGVNTDSKIRLAGKGGYGQAGGQRGDLYLRIHVRPHEKFERKDDDLTVNVPVNLTTAMLGGEIFIPSLKGKLALKIPAETQNGRTFRLKGQGIPHLGKDGSGDLLAKVSIVLPEKLTDTERDLFEKLRQLRPDS

SEQ ID NO: 40758 - protein, 353 aa, Arabidopsis thaliana
MAPRIRSIGSYATQGKFSVDFFGDEFIVTVTSDPSVIGQWIHDVLRFSSRPLVVGVGVQWTPHPTSPPARYHSPVSYHSDSSPVTHHYDSPPVCYRSDSPPAQYCSVSPPARYSSDSPPAQYRSVSPPAQYRSVSPPALYRSVSPPARYRSVSPPVRYRSDSPPAQFRSVSPPARYLSDSPLVRYRSVSPPARYLSVSPPARYRSVSPPARSDPPANTLQLCVGNRCIIIQLFYCNRVPHVLRRFLGDRNHTFVGFWNSQDAGKLKRSRHRLEIAELLDLRNHVVDSRGRGLKGRSFEVVVGECLGYRGVRLEKAIGMSDWSVYDLSYDQILQASIDVYVCSKLGFRNRLWEF

SEQ ID NO: 40759 - protein, 222 aa, Staphylococcus epidermidis RP62A
MDVKENLAKIETEIDASVKKSAHSAQPHVIAVTKYVTIERAREAYKAGIRHFGENRLDGFKEKKESLPSDIKLHFIGSLQSRKVKDIINEVDYFHALDRLSLAKEINKRANHVIKCFLQVNVSGEKSKHGIALEEVNQFINQIKEYENIQIIGLMTMAPLTDDLSYIKNLFKELRHKRNEIQQFNLAHAPCTELSMGMSNDYQMAVEEGATFVRIGTKLVGE

SEQ ID NO: 40760 - protein, 336 aa, Arabidopsis thaliana
MSTKKHNLLANFASSDSRFTQQELPACKPILTPKWVILTFLVSGVVFIPLGVICLFASQGVIEIVDRYDTDCIPLSSRDNKVRYIQGLEDKRCNRTITVTKTMKNPVYVYYQLENYYQNHRRYVKSRQDGQLRSPKDEHETKSCAPEDTLGGQPIVPCGLVAWSLFNDTYDFTRNNQKLPVNKKDISWKSDRESKFGKNVFPKNFQKGSLIGGKSLDQDIPLSEQEDLIVWMRTAALPTFRKLYGKIDTDLQAGDTIKVLLQNNYNTYSFNGKKKLVLSTTSWLGGRNDFLGIAYLTVGSICLFLAVSFSVLYLAKPRQLGDPSYLSWNRSAGGGR

SEQ ID NO: 40761 - protein, 128 aa, Vibrio angustum S14
MAYSEKVIDHYENPRNVGSFDKDNQNVGSGMVGAPACGDVMKLQIKVTEEGIIEDAKFKTYGCGSAIASSSLITEWVKGKTLDEAASIKNSAIAEELELPPVKVHCSILAEDAIKAAVSDYKKKHEQK

SEQ ID NO: 40762 - protein, 479 aa, Methylobacillus flagellatus KT
MQIQAVILSGGSGTRLWPLSRENYPKQLLTLLDNDSLLQSTLRRVDPLIGTECSPILVCNEEYRFVIAEQLRMMGRRGSILLEPVGKNTAPALTLAALEAASHGQDPILLVMPADHAIINVQDFQDTVRTGAEHAAAGKIVTFGIVPDRAETGYGYIKSGAVLEGFGSAFSIEQFVEKPDEATAQQYVVSGNYFWNSGLFMMRATVWLNAIAKTRPDILSSCKQAWDGQQRDGDFVRVDKLKFQQVPSDSIDYAVMEHVARGADNLPAGIVIPLNAGWSDVGAWDSFGKILPQDNAGNSHLGDVLFNDCSNTLAVSSGRLLACVGLQNIAVIETADAVLVIDKSKTQDVKKIVEQLKVQKRPEAKTHRKVHRPWGWYDSIDMGARFQVKRIVVNPGATLSLQMHHHRAEHWIVVTGTAKVTRGDEEFLVSENQSTYIPLGVTHMLANPGKLPLEMIEVQSGAYLGEDDIVRFNDQYGRS

SEQ ID NO: 40763 - protein, 548 aa, Oryza sativa Japonica Group
MATSAAAAASTLPYLVSSASSSAAARRRGAHRIRASSAAAEVEGAMDVVSEAELREKGFMGLRKTKLVCTVGPACVGALPALARGGMGVARVNLCHGGRGWHRAVMREVRRLNEEEGFCVSLMVDTEGSQLLVADHGGAASVKAEDGSEWLFTSKRTDESHPFTMHVNFDKFSEDILVGDELVIDGGMATFEVIEKVGNDLRCKCTDPGLLLPRAKLSFWRNGKLVERNFGLPTLSAKDWADIEFGIAEGVDCIALSFVKDANDIKYLKTYLSRKSLEHIKIFAKVESLESLKNLKDIIEASDGVMVARGDLGVQIPLEQIPAIQEAIVDLCRRLNKPVIVASQLLESMVEYPTPTRAEVADVSEAVRQYADAVMLSAESAIGAYPQKALAVLRAASERMESWSREENMQKLLPQHQLAIALPDRISEQICTSAAEMANNLAVDAIFVYTKYGHMASLLSRNRPNPPIFAFTDNANSRKSMNLYWGVIPLQLPLSNNMEDNFNQTIKLMKSKGSVKSGDTVLVVADSDLNRPRAATSVFQSIQVRIVD

SEQ ID NO: 40764 - protein, 452 aa, Pseudomonas syringae pv. tomato str. DC3000
MRLDRVSFGKRLAGYAESISLPAQPVVEGRLLRMVGLTLEAEGMRAAMGSRCMVINDDSHHPVEVEAEVMGFSGGKVFLMPVGSVAGIAPGARVVPLADTGRLPMGMSMLGRVLDGAGRPLDGRSPIKAEDWVPMDGPTINPLKRDPISQPLDVGIRCINGLLTVGRGQRLGLFAGTGVGKSVLLGMMTRFTEADIIVVGLIGERGREVKEFIEHILGEEGLKRSVVVASPADDAPLMRLRAAMYCTRIAEYFRDKGKNVLLLMDSLTRFAQAQREIALAIGEPPATKGYPPSVFARLPKLVERAGNAEKGGGSITAFYTVLSEGDDQQDPIADSARGVLDGHIVLSRRLAEEGHYPAIDIEASISRVMPAVVSPEHMARAQHFKQLWSRYQQTRDLISVGAYVAGGDRETDMAIALHPVLVRYQRQALRENESMQGSGDALASIFAPAPGG

SEQ ID NO: 40765 - protein, 243 aa, Leptothrix cholodnii
MSDTHFGFKTVDERQKADLVRGVFDSVASRYDVMNDAMSMGMHRLWKAYAVAVSGAREGHQVLDIAAGTGDLTRQFARKVGASGTVVHTDINESMLRTGRDRLLDEGLQLPTVLCDAERLPFPSARFDIVSVAFGLRNMTHKDVALGEMARVLKPGGKLLVLEFSRVAEPLRRAYDWYSFNVLPRLGQVLTGDAQSYRYLAESIRMHPPQAELKSMMKTAGFGHVDVHNMSAGVVALHVGLKC

SEQ ID NO: 40766 - protein, 340 aa, Myxococcus xanthus DK 1622
MTKFGSEGLMPPLDVVCFGETLVDFLPAAPGHRVRDVPAWHPCPGGSPANVAVGLARLGLRPAMLGVVGADEFGHFLRERLAAEGVDVSHLRQTAEARTGLVFISLDGKGERSFTFFRTRSAEFLLGQADVDAAFLSGAKAVHCGSNSLQWPEAQEAAVRMLGLARDAGLIVSCDPNLRLHAWEDTSLLKGLLARMLPLCTVVKLSEEEIGFVTGTEVPHEALTRLAAMGVPLPVVTLGERGALLQWKGECIHVAAPQARVVDTTGAGDGFVAGLLQGLVRWYGGAGGLRDATGEELVTLATFACEVGARVVEKLGAVDGLPRAEVLAHVMPSRPDSSRA

SEQ ID NO: 40767 - protein, 147 aa, Bacillus cereus ATCC 10987
MTRRHFNIESISVGHTESSDISRMTIVVHVENEQQVEQLIKQLHKQIDVLKVSDITEEAMIARELALIKVATSVARAELYSLIEPFRAAVIDVGKDSIVVQVTGTQEKVEALIELLRPYGLKEIARTGVTAFTRSMKKQDKQVMLIQ

SEQ ID NO: 40768 - protein, 535 aa, Kluyveromyces lactis
MSITAGPKVTTTAALVNTDRKMNNHHSTQVLHGSGQHGMQPSGNNVLNGLANGATGLQSSASSTSTRDDSTIVGLHYKIGKKIGEGSFGVLFEGVNMINNVPVAIKFEPRKTDAPQLKDEYRTYKILSGSEGIPQAYYFGQEGLHNILVIDLLGPSLEDLFDWCGRRFSIKTVVHVAIQMITLIEELHDHDLIYRDIKPDNFLIGRPNQPDANMVHLIDFGMAKLYRDPKTKQHIPYREKKSLSGTARYMSINTHLGREQSRRDDMEALGHVFFYFLRGQLPWQGLKAANNKLKYEKIGEKKRSTNVYDLSQGLPVQFGRYLEIVRNLGFEETPDYEGYRKLLLSVLDELGQKLDGEYDWMKLNGGRGWDLAINKKPNLHGYGHPTPPNEKSKRHRNKFNQVPLAVNNLNGSNVPLQSHSPLPGGTDLTQGVSNAPQQPQQIMSQQQYQQHTQQRLDPMSYEAYKQQVQQRYAQQPQPTQQKAQKSPNNDTSQQQFSQNRQQQPQYQFQQNQPQNGKVQVADSNSEKGFFKLGCC

SEQ ID NO: 40769 - protein, 534 aa, Synechococcus elongatus PCC 6301
MLPFLLADLSLAAVTAKPEPSADLATTLTICLLGATLVALISRRFRIPYVTGLVLAGLTITNLLPRRLGIDSGLILNLFLPILVFQAAINTDISRLRSSFAPISVLAGPGILLATGVTASVLKFGLNLDWIPALLVGSILAITDTVSVIAVFREIAVPSRLTTIVEGESLFNDGVALVIFGLIVELQAGEQVTAISAVQSFFLVVLGGGLLGLATGYLASGLFRTLADDSLSGILLTVAVALGTFQLGEALNVSGVVAVVVAGLTVGNLALDRAQSPSSRLTLINFWEYAAFCVNTFIFLFIGVEVDPRSLLQTLPAVLLAIVAYQLARLVTVYPLMALVNRFDRPIPFRWQHVLFLGNIKGSLSMVLALSLPATLGNRSELVNLVFGVVLLSLVVQGLSLPWFVKRLKVATRSTRSQEAEQLQAQLIAGKAVQSELLNLYDAGVLPKAVHEELRARYQLAIAGAEQSLRGLYNRRSTNLRNSAAPAFSSLQRRLLLVEKNALLDSARKGILTEEAIADRLQVIDAELLRAEAD

SEQ ID NO: 40770 - protein, 334 aa, Myxococcus xanthus DK 1622
MATTRTVTIINGDGIGPEVMAATVRVLEALKVPLDFEYKDAGTEVVAKYGTNLPHETVEAVLRSGIALKGPTGTVVGGGLPSANVGLRKRLDLYSSLRPVKSVPNVKTRYEGVDLVVVRENTESLYAGLEHIIVPGVVESLKIITEKASTRIARFAFEYARKHGRKKVTAVHKANIMKLSDGLFLDCCRKVGREFPDVTYEEVIIDNLAMQLVKDPTRFDVLVAENFYGDVLSDLCAGLVGGLGVVPGANIGERTAVFEAVHGTAPDIAGKGIANPTALMMSAVMMLDHLELGEAARRMENAIWKVYGSGEVRTGDLGGKATTREFTDAIIGAL

SEQ ID NO: 40771 - protein, 186 aa, Zea mays
MARIKPQALLNQSKKKKGPSRISISTIVVCNLVVAVVVLSLVTTYRHWSQRSINVIETQSQRFEDTNAASEQKSYDLPGYADISTSKGLITVELFKDASPEAVDRFLDLCQKDHFKGMPFHRVIKNYLVQAGHSQSSIPVEEWTSKGKLRGRLNTSPKHEAFMLGTPKTKGNNNNKDFELLITTAQ

SEQ ID NO: 40772 - protein, 369 aa, Anabaena azollae
MQVKAAVAYSVVQPLTIETVELEGPQAGEVLVEIKASGVCHTDAYTVSGADPEGLFPAILGHEGAGVVVEVGADVKSVKPGDHVIPLYTPECRQCEYCLSFKTNLCQAIRVTQGRGLMPNATSRFSIVGKMIHHYMGTSTFANYTVLPEKAVAKIREDAPFDKVCYIGCGVTTGIGAVIYTAKVEAGANVVISGLGGIGLNIIQAAKMVGANMIVGVDINPKKRALAEKLGMTHFVNPHEIEGDLVSYLIDLTKGGADYPFECIGNINVMRQALECCHKGWGVSVIIGVAGAGQEISTRPFQLVTGRVWKGSAFGGARGRTDVPKIVDLYMNGQINIDDLITHVMPIEQINHAFDLMYRGESIRSVVTF

SEQ ID NO: 40773 - protein, 253 aa, Synechococcus elongatus PCC 6301
MNGLARSEQSAVRRIIIAGNWKMYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 40774 - protein, 289 aa, Desulfitobacterium hafniense DCB-2
MNQKKILREVLLPDGTKLPKLGQGTWYMGEKSRLWQQEVKALAMGIEYGMTLIDTAEMYGEGAAEELVGEAIKPYPRETLHIVSKVYPHHAGRKTIFKSCEASLRRLGLDYLDLYLLHWRGNIPLEETVECMNELVAQGKIKHWGVSNFDTEDMEELWQTPGGDRCSTNQVLYHLNSRGTEYDLQPWLKAHRLPMMAYCPMAHNLSTRQRIAQNPVVQEIAQNYGLTVEQILLCFVLGQENVMAIPKASQPDHVKDNAQVYDISIHEEDWQRINLAFPAPQHKTYLDIL

SEQ ID NO: 40775 - protein, 207 aa, Brassica napus
  misc_feature (145)..(145): Xaa can be any naturally occurring amino acid
  misc_feature (163)..(163): Xaa can be any naturally occurring amino acid
  misc_feature (190)..(190): Xaa can be any naturally occurring amino acid
MALRSISRRFGSRVLSYRSSSVASLHSHATSFGFQQVKEEEKRKLVGNVFSNVASSYDIMNDVMSGGLHRLWKERLVGKLSPFAGMKHLDVAGGTGDVAFRIFDAVNSVKRRALRKVDEDSLEETQIYVCDINPNMLNVGKQRAXETGLGDNKALVWVEGDAXALSFDDNSLDGYTIAFGIRNVTHIEKXALAEAYRVLKRGGRSCA

SEQ ID NO: 40776 - protein, 927 aa, Oryza sativa Japonica Group
MASSIAMSLRSLAATDAFLPKPSPSSAPFLLLLSPSTPRLRLHLHLRSTRRLPLAPLAASDSFESASSSSAAALDFAEPGAAEESDVPEESDQEEEGYAPEAEEEAEADEEVEEEAVEASAEVAEEAEDVEEVGEYVEPPEEAKVYVGNLPYDIDSERLAQLFEQAGIVEVSEVIYNRETDRSRGFGFVTMSTVEEAEKAVEMFHRYDVDGRLLTVNKAAPRGARVERPPRQFGPSFRIYVGNLPWQVDDSRLVQLFSEHGKVVDARVVYDRETGRSRGFGFVTMATQEELDDAIAALDGQVSSGYAVLSEETIISYVGFRCICGWPNLPPDLLREISGQLHDAVDLSRFHTVCTAWRDMVRLPAAEPQCPALLPWLVARGWPGCFSRSHLRSIFSNATPAWHSPRTTTRDMWLASTDGAGVWVLTADGDRLVDPLTGATVRRLPRLPRTSNNDHVCYIDGVVCGDGTIVAYATSDGFKHTSQIEAAILRPGDTAWTTVESKGMNYSALGYGCCTTYHQGGVVFADLYQTFVARVLVDDAGGGGRVVESRTRRWPPDYGFLYKRLLSTYTFEFRGKLMSACVEIPWQSSAYQIDAAALSVSLYTLGTAAAAGDGDELAHLWVRAADGGRLLGEHALFLGCPTSFAVDAARFGAGGEVSGGCAYFVIWTMPDVCHVYKYSFHDDAATPMAELPFEWTFMIKRTLWFLPQYSSVAPTPTQEIRERLIRHGERPKTFKIKLNNLTPRARLGSSGDSWLRGEFRDHGYVIDANVHYRNGAIFGVVTMTTVQKPADIVAAFDKRGFLDLHPLLAVEFAEQQPRQEWILTEAALAIAPTTVHSFSPKDFSIYVGNLRWDVDRLRLLKFFGEHGRVLVAQVVCDRQTGRSRGFGFVSMATLREPDDVIASLNGQIMDGRPMRVSFAKWQPRLGY

SEQ ID NO: 40777 - protein, 464 aa, Pseudomonas aeruginosa PAO1
MKISVFGSGYVGLVQAAVLAEVGHDVLCMDIDRNKVERLAQGLASIYEPGLDALLREGLDSGRLRFSSDARLAVEHGRVQFIAVGTPPGEDGAADLGAVFVVADAIAEHRRKPVIVVEKSTVPVGTGDRLRAHIERRLEADGRELEFEIVSNPEFLKEGSAVADCRRPDRIVVGCDNEEVRQVMRELYEPFNRNHDRMLFMGLRSAELTKYAANGMLATKISFINQIAELAEHLGADIEAVRQGIGADPRIGYHFIYPGCGYGGSCFPKDMRALIHSAEQAHCSSDLLQAVEAINRRQKHKLFERIRVFYDGDLRGKTFALWGLAFKPNTDDMRDAPSRELMEALWRHGAQVRAYDPEAMQETQRLYGHDERLSLMGTPEATLGGADALVICTEWQQFKAPDFELLKERLKAPVIFDGRNLYDPERMARHGFHYYPMGRGQSCSLPINEASLAQEDGMRLLRQA

SEQ ID NO: 40778 - protein, 237 aa, Oryza sativa
  misc_feature (55)..(55): Xaa can be any naturally occurring amino acid
TRPRADSARGKHKILVLSGKGGVGKSTFSAQLSFALAEMDCQVGLLDIDICGPSXPKEMLGLEGQDIHQSNLGWSPVYVESNLGVMSIGFMLPNPDNAVIWRGPRKNGLIKQFLKDVDWGEIDYLVVDAPPGTSDFRFVKQGEGGETDATEWALNYIKEKAPELLTMVACSEVFDSSKGGAENMCNEMGVPFLGKVPMDPQLCKAAEEGRSCFVDQKCSASAPALKSIVKKLIENQD

SEQ ID NO: 40779 - protein, 383 aa, Arabidopsis thaliana
MEESRESPAEHGYYMPAEWDSHAQTWIGWPERQDNWRHNALPAQRVFAGVAKAISKFEPVTVCASPAQWENARKQLPEDIRVVEMSMNDSWFRDSGPTFIVRKRPVKLSSLNRNIAGIDWNFNAWGGANDGCYNDWSHDLLVSRKILALERIPRFQHSMILEGGSIHVDGEGTCLVTEECLLNKNRNPHMSKEQIEEELKKYLGVQSFIWLPRGLYGDEDTNGHIDNMCCFARPGVVLLSWTDDETDPQYERSVEALSVLSNSIDARGRKIQVIKLYIPEPLYMTEEESSGITQDGEAIPRLAGTRLAASYVNFYIANGGIIAPQFGDPIRDKEAIRVLSDTFPHHSVVGIENAREIVLAGGNIHCITQQQPAEPTSVAENGH

SEQ ID NO: 40780 - protein, 956 aa, Pseudomonas aeruginosa PAO1
MLELDTRQIRMGQRAADKAEALRLLGAALVADGLAAPGYAEGLKAREAQGSTYLGQGIAIPHGTPDTRELVFSTGVRLLQFPEGVDWGDGQQVYLAIGIAAKSDEHLQLLQLLTRALGEADLGPALSAAASAEEVLGLLQGAPQELALDAQLVGLGQNAEDLDELAWLGARLLKKAGCVENGFAAVLQQTEPLPLGDGLCWLHSEQLVKRPGLAFVTPAQPLQHQGQLVTGLFCLASLGEAHQALLERLCDLLLEGRGAELVRATSSRSVLAALGGELPPDWPSARAVLANPHGLHARPAQALAQLAKGFAGEIRVRLADSEAAPVSAKSLSKLLALGARRGQTLEFSAEPAIAEDALPALLAAVREGLGEEVEALAEEALPDAVGEAEEDARPAPLRAGERLQAIAASPGIASGPAHVQVAQRFEFQPRGESPAHERERLLRAKRAVDEEIVGLVERSTVKAIREIFVTHREMLDDPELAEQVQLRLNRGESAEAAWSRVVEDSAAQQEALHDALLAERAADLRDLGRRVLARLCGVEAPREPEQPYILVMDEVGPSDVARLDAQRVAGILTARGGATSHSAIIARALGIPALVGAGAAVLGLEPGTALLLDGEHGWLQVAPSTEQLQQAAAERDARQQRQARADAQRLEPARTRDGHAVEVCANLGDTAGAARAVELGAEGVGLLRTEFVFMNNARAPDLATQEAEYRRVLDALDGRPLVARTLDVGGDKPLPYWPIPHEENPYLGLRGIRLTLQRPQILETQLRALFRAAGERPLRVMFPMVGSLDEWRQARDLALRLREEIPLADLQLGIMVEVPSAALLAPVLAREVDFFSVGTNDLTQYTLAIDRGHPSLSAQADGLHPAVLQLIDMTVRAAHAEGKWVGVCGELAADPLALPLLVGLGVDELSVSARSIALVKAGVRELQLVAARGLARKALGLASAAEVRALVEAEVQ

SEQ ID NO: 40781 - protein, 301 aa, Bacillus cereus G9241
MRRWGIELLILAVVIIWGINFTIAKYGLLEFTAIEFTALRMISAAPLMLLLTFFIEKSVYMERKDIPRLIIVSVVGIVLYQTLFMETVKYTSATNASLLISISPIFTTVFAIFLKQEKFSSRKLIGSIIAFCGAALVLVAGNSLASSFYGNGIGLITSICWGLYPVLAGPLIKKYSALRVTAWSALVGAIPLLLLSGPHVFIMPFHITHGMTLFALLYSIFFVTVFGLVMWYVGVQKIGASHTMVYMYITPLVAVLFAAVWANEYVSFQQIIGGIIIFFGLWFVKSEKVKVHVAAGEPISK

SEQ ID NO: 40782 - protein, 470 aa, Desulfococcus oleovorans Hxd3
MGNHTVEKIGGTAMSQFDKVLDNIIVGDRKEKDLYNRIIVVSAYGGITNELLEHKKTSDSGVYSLFSKDDDSWAWGEAITRVGQRMCTINKGFEHLGLDVQLADRFVKERIEGVRSCLIDLTRLCSFGHFKLDEHLMTVREMLSAIGEAHSAHNSYLILKSMGINARLMDLSGWMDTDQLSLDETIKKAFESVDVAEELPIVTGYTQCKEGIMGSYDRGYTEITFSRIAVLTGAREGIIHKEYHLSSGDPKIIGEDRVETIGSTNYDVADQLSDLGMEAIHPGAARGLRKTDIPLRVKNVFEPDHPGTLITNDYRSTDARVEIIAGRKGVTGIEVWDQDMVGRWDHDLEMLKHLAAAKIRYLAKDTNANTLTHYIAAPLAKIKRLTDNIKQDFPSADILVKKVALVSAIGTNMADTWVLPTAVHSLTNAGVEILGLHKCMRQVDIQFVVDEKDFQNAICALHRDLVETGR

SEQ ID NO: 40783 - protein, 182 aa, Erwinia carotovora subsp. atroseptica SCRI1043
MSAKIFRRYKGISPVLGERVMVDHSSVVIGKVTLGDDVGIWPLVAIRGDVNYITIGARSNIQDGSVLHITHCSEKKPEGNPLIIGEDVTVGHKAMLHGCQIGSRVLVGMGSILLDGVVVEDDVMIGAGSLVPPGKRLEKGHLYVGSPVKKIRPLTQEEIEGLIYSANNYVRWKDEYLAQDNE

SEQ ID NO: 40784 - protein, 162 aa, Cryptococcus neoformans var. grubii
MSDVYFDIAINSQPAGRITFKLFDDVVPKTAQNFRELCTGQNGFGYAGSGFHRVIPQFMLQGGDFTNHNGTGGKSIYGNKFADENFKLRHDRPFLLSMANAGPNTNGSQFFITTVVTSWLDGKHVVFGEVSSGQDLVKKIESYGSGSGATKAKITIAASGTV

SEQ ID NO: 40785 - protein, 570 aa, Xanthomonas campestris pv. vesicatoria str. 85-10
MALAQPLQAQPKLVAELSVRLGHSQDSQNCVVSLARLSNSGLGMEGVDANNAKYWPAMARCPSQQASPAMSQSVPRVFLLIDGEMVVSASTQWQDVVNPADQSVLAQVPFATTAEVDAAVAAASRAFVTWRKTPIGTRARIFLKYQQLIRENMPELAALLSAEQGKTLADAEGDVFRGLEVVEHAAAIGNLQLGELANNVANGVDTYSLLQPLGVCAGITPFNFPAMIPLWMFPMAIATGNTFVLKPSEQDPMVTMRLVELALEAGIPKGVLNVVHGGEEVVNALCDHPDIKALSFVGSTKAGTHVYRRASLAGKRVQCMMGAKNHAVVLPDANREQTLNAMVGAAFGAAGQRCMAASTLVLVGDARTWIPELVAKAKSLKIGAGNAPGTEVGPLISCAARERVEGLIASGVEQGATLELDGRAPQVPGFEQGNFVGPTIFSGVKPGMRIYDEEIFGPVLVILEAATLDEAIALVNANPNGNGTALFTQSGAAARRFQEDIDVGQVGINVPIPVPVPLFSFTGSRASKLGDLGPYGKQVVMFYTQTKTVTARWFDDQTLAHGVNTTISLK

SEQ ID NO: 40786 - protein, 162 aa, Cryptococcus neoformans var. grubii
MSQVYFDIAINNAPAGRITFKLFDDVVPKTARNFRELCTGQNGFGYAGSGFHRVIPQFMLQGGDFTNHNGTGGKSIYGNKFADEEFKLRHDRPFLLSMANAGPNTNGSQFFITTVVTSWLDGKHVVFGEVSSGQDLVKNIESYGSDSGKPKAKVTITGSGTV

SEQ ID NO: 40787 - protein, 534 aa, Triticum aestivum
  misc_feature (223)..(223): Xaa can be any naturally occurring amino acid
MLRAVLLRSASGLRRSPMAAPLSTAAASWLAEGTSSPPRVRLLIGGDFVESKATEHVDVTNPATQEVVSRIPLTTADEFRAAVDAARTAFPGWRNTPVTARQRIMFKYQELIRANMDKLAENITTEQGKTLKDAWGDVFRGLEVVEHACGMGSLQMGEYVSNVSHGIDTFSIREPLGVCAGICPFNFPAMIPLWMFPIAVTCGNTFVLKPSEKDPGAAMMLAXELAMEAGLPKGVLNIVHGTHDVVNNICDDEAIKAVSFVGSNTAGMHIYSRASASGKRVQCNMGAKNHAIILPDADRDATLNALIAAGFGAAGQRCMALSTAVFVGGSEPWEDELVKRASNLVVNSGTANDADLGPVISTQAKDRICKLVQSGADSGARLVLDGREIVVPQFEDGNFIGPTVLADVKSDMECYQEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTITQQWKESSPQRVSLSMPTSQK

SEQ ID NO: 40788 - protein, 335 aa, Arabidopsis thaliana
MFTQQELPACKPILTPRWVILTFLVAGVVFIPLGVICLFASQGLRFCGFIEDMFHSYLKVVEIVDRYDTDCIPTSSRNNMVAYIQGEGDKICKRTITVTKAMKHPVYVYYQLENFYQNHRRYVKSRNDAQLRSPKEEHDVKTCAPEDNVGGEPIVPCGLVAWSLFNDTYSFSRNSQQLLVNKKGISWKSDRENKFGKNVFPKNFQKGAPIGGGTLNISKPLSEQEDLIVWMRTAALPTFRKLYGKIETDLHAGDTITVLLQNNYNTYSFNGQKKLVLSTTSWLGGRNDFLGIAYLTVGSICLFLAVTFAVLYLVKPRQLGDPSYLSWNRSAGGLQ

SEQ ID NO: 40789 - protein, 459 aa, Fusobacterium nucleatum subsp. vincentii ATCC 49256
MESNQKMKFWSIVLLTINSIIGTGIFLSPGAVAKLVGDKAAIIYLAAAVFAAVLAVTFAAASKYVVKSGAAYAYAKAGFGDEVGSYVGITRVVSASIAWGVMATGVVKTTLSIFGQDSSNMKNVTIGFITLMLILLIINLIGTKLLTIISNISTIGKMGALGITIIAGIFILIFSGGNHIEELNLLKDAEGNNLIPEFTTSVFVTALIGAFYAFTGFESVASGSADMEKPEKNLPRAIPLAIAIIAAIYFGIVFVSMYIDPVAMVTSKDPVVLASIFKNQLLQKIIVIGALMSMFGINVAASFHTPRVFEAMAKEKQVPEFFAKRTKGGLPLTSFILTAAIAVVIPLAFNYNMAGIIIISSISRFIQFIIVPLAVIVFFYGKSKEEVLNANKNFMIDVVIPIIALLLTILLLIKFNWVQQFSTKLDDGTTTINLKAVISMIIGYLILPIILRIYMRAKK

SEQ ID NO: 40790 - protein, 463 aa, Ehrlichia chaffeensis str. Arkansas
MQNYDMVVIGGGPGGYKCAIRGAQLGLKVACIDKNEILGGTCLRVGCIPSKALLHFSHEYYHLKNNLSEVGITFDNLNFDLEKIMSFKDKNIAELGNGISYLFSSHKIDYLCGVGKIQSVGPNNFIIVISGNNGKQEIISRYVVIATGSDVANFPDIDEERVVSSTAALSFKEPPKRLIVIGAGAIGLEMSSVWSRFGSEVTVVEFSDKIAPSMDGDIGKALLTSLKKQGINFKLSTKVSSIDKKGSNLAVHLESVKDGKSEIIEADKVLVSIGRVPYTNGLIDNNSIECDARGFIKVNNKYETNIPGVFAIGDVIGGAMLAHKAEEEGIAVAELISGHVPHVDYEIIPSVIYTHPAVASIGKTEESLKKVNYSYNVGKSNFSANGRSKVTDNVSGFVKVLASKENDAILGVHIIGAYADTMINEAAVAMAYRASSEDIFRICHSHPDVNEAFKDACEAAFLK

SEQ ID NO: 40791 - protein, 416 aa, Ehrlichia chaffeensis str. Arkansas
MPIEVLMPALSPTMKSGTIRKWYKAEGDVVKSGDVIADIETDKAVMECEYTDEDGIMGKIFFAEGSKNIEVNQLIALIAVDEQDLAKVHSYEKGDNVVKNELVALQDSQPAQDESVVLQMNQQIVNASEVLVNSSNSSERVKVSPLAKKIASNLGVDVNLVKGTGPYGRIIKADILDVINQHGHIANSPEDASFTEISSMRRVIAERLVYSKQTIPHFYVSIDCLVDSLLKLRLEINAENPDTKVTVNDFIIKAVAMSIKKFPEINVSWSDDKIVVFPSIDISVAVSIDNGLITPIIFGADKKSLLEISREVKALASKAKSGKLKPEEFQGGGFTVSNLGMFGIKEFYAIVNPPQSCIMSVGCSEKRAMVVNEQICISNVVTVTLSVDHRVIDGVLAAKFLNCFKSYLEKPFLMLI

SEQ ID NO: 40792 - protein, 266 aa, Vibrio angustum S14
MHPMLNIAIRAVRKAGDHVIKSLEKPQSIEVANKGNDVVTNVDHEAEAIIIETILKAYPDHCIVAAESGNKEGRDKECQWIIDPVDGTMNFVRGYPHFAVSVALRMRGRTEVAAVYDPVRNELFTATRGAGAQLNSQRVRSSQPRDLTGTVLATGLPFAAKQHAESYLKIQNALFADCDDMRQSGSTALDLCYLAAGRVDGVFKLGQKPWELAAGELIARESGAICADFTGNTNYLTSGNIVAGNARVVKPMLAKIREFGSDALAK

SEQ ID NO: 40793 - protein, 509 aa, Arabidopsis thaliana
MDAQSVSEKLRSSGLLRTQGLIGGKWLDSYDNKTIKVNNPATGEIIADVACMGTKETNDAIASSYEAFTSWSRLTAGERSKVLRRWYNLLSRSEPLHFTKHRYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 40794 - protein, 282 aa, Zea mays
MAGGGQAAISFMTRMAKVAAGLGVAASAASTSFYTVDGGERAVIFDRVRGVLPRTMSEGTHLLVPILQKPFIFDIRTRPHSFSSTSGTKDLQMVSLTLRVLSRPDVEHLPDIFTSLGLEYDEKVLPSIGNEVLKAVVAQFNADQLLTERPHVSALVRESLTKRAREFNIVLDDVAITHLAYGQEFAQAVEKKQVAQQEAERSRFLVARAEQERRAAIVRAEGESEAARLISEATTTAGNGLIELRRIEAAKEIASVLSRTPNVSYIPAGDNGQMLLGLNAAR

SEQ ID NO: 40795 - protein, 171 aa, Bacillus pumilus SAFR-032
MIYPYHQFTPEIHESVFVADNATITGDVTIGEYSSVWFQTVIRGDVAPVRIGKNVNIQDLSCLHQSPGKTLLIEDGATIGHQVTLHSSIIRKNALIGMGSIILDGAEIGEGAFIGAGSLVPQGKVIPKGSLAFGRPAKVVRQLTDEDIQDMDRIRREYVEKGQYYRSLISR

SEQ ID NO: 40796 - protein, 575 aa, Bordetella parapertussis 12822
MASSPADTPHRNWLRWLPGLAVLKTYQAAWLPRDLAAGLVLTAMLVPVGIAYAEASGVPGVYGLYATIVPLLAYALFGPSRILVLGPDSALAAPILAVVLSVSEGDPMRAVATASLMAIVSGLFCIILGLLRLGFITELLSKPIRYGYMNGIALVVLASQLPKLFAIPTDDGGPLRELWQLAQAVLDGRTNGYSLAVGSAALGLILLLKRFKRLPGILIAVVLATLAVSLFGLDGRGVQVLGEIPQGLPGFTIPWLSNADLARIVLGGCAIALISFADTSVLSRTYAARTHTRVDPNQEMVGLGVANLATGFFQGFPVSSSASRTPVAEAAGSRTQLAGVVGALAVAALLLAAPNLLRHLPSSAMAAVVIAAAIGLFEFKDLRRIFRIQQWEFWLSMLCFAAVVAFGAIPGICLAVVVAVLEFLWDGWRPHFAVLGRVPDLRGYHDLKRYPHAALIDGLVLFRWDAPLFFANAELFQQRLLEAVQASPTPVQRVVVTAEPVTSVDVTSADMLRELSHHLAESGIALHFAEMKDPVRDKLKRFELSEVFGADRFHPTVESAVDDYLKRPPQGTIDP

SEQ ID NO: 40797 - protein, 714 aa, Salmonella typhimurium LT2
MSRIIMLIPTGTSVGLTSVSLGVIRAMERKGVRLSVFKPIAQPRAGGDAPDQTTTIVRANSTLPAAEPLKMSHVESLLSSNQKDVLMEEIIANYHANTKDAEVVLVEGLVPTRKHQFAQSLNYEIAKTLNAEIVFVMSQGTDTPEQLNERIELTRSSFGGAKNTNITGVIINKLNAPVDEQGRTRPDLSEIFDDSSKAQVIKIDPAKLQESSPLPVLGAVPWSFDLIATRAIDMARHLNATIINEGDIKTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYVNAEWIESLTATSERSRRLSPPAFRYQLTELARKAGKRVVLPEGDEPRTVKAAAICAERGIATCVLLGNPDEINRVAASQGVELGAGIEIVDPEVVRESYVARLVELRKSKGMTEPVAREQLEDNVVLGTLMLEQDEVDGLVSGAVHTTANTIRPPLQLIKTAPGSSLVSSVFFMLLPEQVYVYGDCAINPDPTAEQLAEIAIQSADSAIAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQASQQQQ

SEQ ID NO: 40798 - protein, 198 aa, Triticum aestivum
MAEQTFIMIKPDGVQRGLIGEVISRFEKNGFYLPGLQLQELEKSFADHAYSALVLQPFHARVAPYIISGPVAAMGCEGTTLASTATKITGATRSRASYPGAICGDLCARHRCAQSFHAKRFPSLWAALAPAAWPVPSQAPLARRPSPAPRGLGMHSFRRGGLALPPFSSPAGASASSAAPPPPVRPRAAVRAPDPAPL

SEQ ID NO: 40799 - protein, 317 aa, Salmonella typhimurium LT2
MIKLAPAGLKDDIEMRKVYAGFIAGQIEAGSPIIALEADLMSSMAMDSVARDYPQHVINCGIMEANVIGTAAGLALTGRKPFVHTFTAFASRRCFDQLFMALDYQRNNVKVIASDAGVTACHNGGTHMSFEDMGIVRGLAHSVVLEVTDAVMFADILRQLMDLDGFYWLRTIRKQARSIYAPGSTFTIGKGNVLREGDDITLIANGIMVAEALEAARQLEQEGVSAAVIDMFTLKPIDRMLVKNYAEKTRRIVTCENHSIHNGLGSAVAEVLVENCPVPMRRVGVKERYGQVGTQDFLQKEYGLTAEAIVEAAKSLL

SEQ ID NO: 40800 - protein, 2157 aa, Oryza sativa Indica Group
MSAAQGMAYKLRTDAAPTGAGRRARRSHSSVAAPYRAARLVQGGVSIEGGLVGGCQLTEERVAARPPRAAARDAEPVRPLSTLPESSIGLYDPSRERDSCGVGFVAELSGDYKRATVNDALEMLERMAHRGACGCEKNTGDGAGILVTKDAGFELPQPSEYAVGMVFLPIDEKRRERSKAEFQKVAESLGHVILGWRRVPTDNSDLGESALQTEPVIEQVFLTKSSSSEADFEQQLYILRRLSILSIRAALNLRRGGKRDFYMCSLSSRTIVYKGQLKPCQLKGYYYADLGHENFTSYMALVHSRFSTNTFPSWDRAQPMRVLGHNGEINTLKGNKNWMKAREGLLECEKLGLTKDQFSKILPIVDATSSDSGAFDGVLELLIRGGRSLPEAVMMMIPEAWQNDVNMEPEKKALYEFLSALMEPWDGPALISFTDGRYLGATLDRNGLRPGRFYVTHSGRVVMGSEVGVVDVPSKDVLRKGRLNPGMMLLVDFENHTVVDDEALKAQYSKAHPYGEWLKRQKIYLKDIVESVPETERVAPGISGSLTQKNEKKEHAGVNGIVTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALEGPLVSIDEMEAIKKMNYRGWRSKVLDITYPKKSGRKGLEETLDRICTEARGAIKKGYTVLVLSDRGFSSDRVAVSSLLAVGAVHQHLVANLERTRVGLLVESAEPREVHHFCTLVGFGADAVCPYLAIEAIWCLQNDGKIPPNGDGKPYSKEELVKKYFYASNYGMMKVLAKMGISTLASYKGAQIFEALGLSSEVIRKCFDGTPSRIEGATFEMLARDSLRLHELAFPSRAPPPGSADAKALPNPGDYHWRKNGEVHLNDPLAMAKLQEAARVNSRAAYKEYSRRIQELNKTCNLRGMLKFKDTADMISVDEVEPASEIVKRFVTGAMSYGSISLEAHTALAMAMNKLGGKSNTGEGGEQPSRMEPLADGSMNPKRSAIKQVASGRFGVSSYYLTNADELQIKMAQGAKPGEGGELPGHKVIGDIAVTRHSTAGVGLISPPPHHDIYSIEDLAQLIHDLKNSNPRARISVKLVSEAGVGVVASGVVKGHADHVLISGHDGGTGASRWTGIKNAGLPWELGLAETHQTLVANGLRGRAILQTDGQLKTGKDVAVACLLGAEEFGFSTAPLITLGCIMMRKCHTNTCPVGIATQDPVLREKFAGEPEHVINFFFMLAEELREIMSQLGFRTITEMVGRSDMLEVDPEVVKSNEKLENIDLSLILKPAAEIRPGAAQYCVEKQDHGLDMALDNKLIALSKAALEKEVRVFIETPIQNTNRAVGTMLSHEVTKRYHMKGLPAGTIHVKLTGSAGQSLGAFLCPGITLELEGDSNDYVGKGLSGGKIVVYPPRDSTFIPEDNIVIGNVALYGATIGEAYFNGMAAERFCVRNSGAQAVVEGIGDHGCEYMTGGTVVILGKTGRNFAAGMSGGIAYVYDIDGKFSVRCNHELVDLYHVEEEDDITTLKMMIEQHRLNTGSVVARDILSNFDTLLPKFVKVFPRDYKRVLDNMKAEKAAAKLAKEPKISNGVSVTTKKVQPEQSTNRPTRVSNAKKYRGFISYERESISYRDPNERVKDWKEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGKKVAIIGSGPAGLAAADQLNKMGHFVTVFERADRIGGLMMYGVPNMKTDKIEIVQRRVNLMAEEGITFVVNANVGSDPLYSIERLRSENDAVILACGATKPRDLGIPGRELSGVHFAMEFLHANTKSLLDSNLEDGRYISAKGKKVVVIGGGDTGTDCIGTSIRHGCTSIVNLELLTKPPSKRAADNPWPQWPRIFRVDYGHQEASSKFGNDPRTYEVLTKRFIGDENGNVKALEVVRVKWEKVDGRFQFKEIEGSNETIEADLVLLAMGFLGPEATIAEKLGLEKDNRSNFKAQFGNFATSVDGIFAAGDCRRGQSLVVWAITEGRQAAAAVDKYLSRNEQDAAEDITPSGAGFVQPVAA

SEQ ID NO: 40801 - protein, 449 aa, Myxococcus xanthus DK 1622
MDTLRRWLDEKGVQKVKVGAVDVDGVWRGKYISLEKFLSAAKGGLGFCDVVFGWDLSDDLLDNTQVTGWHTGYPDAHAKVDPSTGRVIPWEPDTAAFLLDFENPDGTPFEASPRQLLQKVAARARSLGYLPRFGAEYEFFIFKEQPQSLRDKDFQGLTPLTPGMFGYSWLRTSLNAPLVHALIDGCNAFGLGIEGFHTETGPGVFEAAIRYDDIEKSADKAALFKTVVKEICARHGVTACFMAKVDAKLPGCSGHVHQSLWDLDGEQNLFHDAKAPHGMSKLLRHYIGGQVALMPELTALYWPTINSYKRSVENTWAPTTVTWGLENRTTAIRVIGESAKAMRLEYRQLGADMNAYIGMAVSLAAGLWGIENEVEPPAPCESNAYAKNDAPPLPRNLKDAVALLKGSERARELLGYGFVDHFVRTREWEVRQYERAVTNWELERYLELI

SEQ ID NO: 40802 - protein, 355 aa, Oryza sativa Japonica Group
METSPALRPAHIPRSTAVRPPCATPFSRAHWHATCAAIRRVPRVNGDSNSSIKPALADHAAPPLDLDLLPVSNLPRPLTITDLSPAPMHGSQLRVAYQGVPGAYSEAAAAKAYPSCDAIPCDQFEVAFQAVELWIADRAVLPVENSLGGSIHRNYDLLLRHRLHIVGEWPAKPLKKTGAAAENVAAAGLRDTAAIASSRAAELYGLQVLADGIQDDAGNVTRFVMLAREPIIPRTDRPFKTSIVFAHDREGTSVLFKVLSAFAFRDISLTKIESRPHRHRPIRLVDDANVGTAKHFEYMFYIDFQASMAEVRAQNALSEIQEFTSFLRVLGSYPMDMTPWEYSSSGQTAGDTSSS

SEQ ID NO: 40803 - protein, 314 aa, Oryza sativa Japonica Group
MHGSQLRVAYQGVPGAYSEAAAAKAYPSCDAIPCDQFEVAFQAVELWIADRAVLPVENSLGGSIHRNYDLLLRHRLHIVGEVQLPVHHCLLALPGVRRDLLTRVISHPQALAQCELTLNAMGLNVAREAFDDTAAAAEHVAAAGLRDTAAIASSRAAELYGLQVLADGIQDDAGNVTRFVMLAREPIIPRTDRPFKTSIVFAHDREGTSVLFKVLSAFAFRDISLTKIESRPHRHRPIRLVDDANVGTAKHFEYMFYIDFQASMAEVRAQNALSEIQEFTSFLRVLGSYPMDMTPWEYSSSSSPSPAPGGDTSR

SEQ ID NO: 40804 - protein, 497 aa, Staphylococcus aureus subsp. aureus N315
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 40805 - protein, 476 aa, Vitis vinifera
MEQRLASTFRMTVNEKKFIEKALLSDLRIDGRRPFDFRRISIKFGRQVFIRTICAEDGSSEVQLGQTHVMGFVTGQLIQPYRDRPNEGTLSIYTEFSPMADPSFEAGRPGEAAVELGRVIDRGLRESRAVDMESLCVLAGKLVWSIRIDLHIIDNGGNLIDAANIAALAALLTFRRPECSFGGEDGQELIVHPPEVREPLPLIVHHLPIAVTFAIIGNENIMVIDPTHSEEAVMGGRMTATLNTNGDVCAIQKAGGEGIIQSVIMQCLRIASVKAADITSKIKNAVEAFNTERALRKIKRHSSSIAVDVSGPGAKMRENKNQSVDEKVVNELSSHHMERLKMESEESCVTQSSDVEVKTQLSEQGRTNRSDENTRSFIGGPSSWDPYSKGIDSDFLKASLASHGLIKQNTKQKDSRGEMKAPDVKSEEPNADIDPALCPMKTVGTTPQTNGEKTLKDAVKPKNKRKKKASPNTNAR

SEQ ID NO: 40806 - protein, 509 aa, Desulfococcus oleovorans Hxd3
MILIIDFGSQFNQLIARRVRENKVYCQIEPPTITISRIRALAPEGIILSGGPSGIYEKHSPKVTKAVFDLGVPVLGICYGMQFMVGALGGAVHAATKREYGFAELAVKAQAKIFKGVGKKTTCWMSHGDSAETVPPGFKIIGSTENTKIAAIADTRRKFYGLQFHPEVAHTAEGTTMIANFLFDICKCRPTWSMAAFAEETIAEIRERVGEKRVILGLSGGVDSSVAALLIHHAIGRQLTCIFVDNGLLRKDEAKKLKAVFAEKLQLNIRFVNAAGRFLKALAGVADPEKKRKIIGKIFMDVFEAEAKKIKGADFLAQGTLYPDVIESQSAFGGPTSIIKSHHNVGGLPAKMKLSLIEPLRFLFKDEVRLLGKTLGLDDDMVHRQPFPGPGLAIRIIGKVDRRQLTLLREVDAILLEEIRKAGYYRKLWQSFAVLLPLKSVGIMGDKRTYENIAAIRAVTSVDAMTADWARLPHDLMGRISNRIINEVKGVNRVVYDISSKPPSTIEWE

SEQ ID NO: 40807 - protein, 497 aa, Pseudomonas aeruginosa PAO1
MSVPVRHLIAGAFVEGLGAQRIPVSNPLDNSTLAEIACASAEQVEQAVASARETFASWKETPVSERARVMLRYQALLKEHHDELAKIVSSELGKTFEDAKGDVWRGIEVVEHACNVPSLLMGETVENVARNIDTYSITQPLGVCVGITPFNFPAMIPLWMFPLAIACGNAFILKPSEQVPLTSVRLAELFLEAGAPKGVLQVVHGGKEQVDQLLKHPQVKAVSFVGSVAVGQYVYHTGTAHNKRVQSFAGAKNHMVIMPDADKAQVISNLVGASVGAAGQRCMAISVAVLVGAAREWIPEIRDALAKVRPGPWDDSGASYGPVINPQAKARIERLIGQGVEEGAQLLLDGRGYKVEGYPDGNWVGPTLFAGVRPDMAIYREEVFGPVLCLAEVDSLEQAIRLINESPYGNGTSIFTSSGAAARTFQHHIEVGQVGINIPIPVPLPFFSFTGWKGSFYGDLHAYGKQGVRFYTETKTVTARWFDSDSVAGTNFSIQMR

SEQ ID NO: 40808 - protein, 109 aa, Vitis amurensis
RIVARGHYTERAAAAVTRTIVEVVQLCHKHGVIHRDLKPENFLFANKKENSPLKAIDFGLSIFFKPGERFSEIVGSPYYMAPEVLKRNYGPEIDIWSAGVILYILLCGV

SEQ ID NO: 40809 - protein, 109 aa, Vitis amurensis
RIVQRGHYSEREAAKLIKTIVGVVEGCHSLGVMHRDLKPENFLFDTTAEDAALKATDFGLSVFYKPGETFSDVVGSPYYVAPEVLCKHYGPEADVWSAGVILYILLSGV

SEQ ID NO: 40810 - protein, 693 aa, Xanthomonas campestris pv. vesicatoria str. 85-10
MLPGFDGLRFSHWQADLREDGVVVLSLDRQGAPVNAFSQEVLLELGAVVERLALDPPKGVVLRSGKPNGFIAGADLKEFQEFDRKGTVNDAIHRGQQVFQKLAELPCPTVAAIHGFCMGGGTEIALACRYRVASDDGSTRIGLPETKLGIFPGWGGSARLPRLIGAPAAMDLMLTGRTVSAKAARAMGLVDKVAAPAVLVDVAASLALAGTARAFKQRATAWATNTLLARKLLAPQMRKQVARKARKEHYPAPYALINVWERAGGSGIQARLAAERKAVVKLASTPTARNLIRIFFLTERLKALGGKDAAGAAAAPIRHVHVIGAGVMGGDIAAWAAYKGFEVTLQDREQRFIDTALTRGGELFAKRVKDDAKRPAVAARLRGDLAGAGVTQADLVIEAIIENPQAKRDLYQSIEPQLKPDALLTTNTSSIPLTELRGHIQRPAQFAGLHYFNPVAMMPLVEIVQHDGLDPANVARLAAFCKALDKFPVPVAGTPGFLVNRVLFPYLLEAATAYAEGIPGPVLDKTAVKFGMPMGPIELIDTVGLDVAAGVGAELAPFLRLPIPAALATVEAGKRGKKDGQGLYKWENGRAVKPEVASGYTAPADLEDRLILPLLNEAVACLHDGVVADADLLDAGVIFGTGFAPFRGGPIQYIRSVGADALLERLHALHARYGERFAPRPGWDSPLLREAVA

SEQ ID NO: 40811 - protein, 537 aa, Trichoderma viride
MVHLGAVNRSASVSPGPQMAPAGGSSSLHPDQALHKSLSQVKLSSYQDEFTTSVYGSQFAGQDLPKHTIPSGAMPKDVAYHMIKDHLSLDNNPKLNLASFVTTFMEDEAEKLMTEAFSKNFIDYEEYPQSADIQSRCVNMIGELFHAPPGGDSVGTSCIGSSEAIMLGVLAMKRRWKLKRQAEGKPTDRPNIIMSSAVQVCWEKAARYFEVEEKYVYCTPDRYTIDPQQAVDLVDENTIGIAVILGTTYTGHYEDVKGINDLLEEKGLDVSIHVDAASGGFVAPFVLPDLEWDFRLPRVVSINASGHKYGLVYPGVGWVVWRSHEYLPQDLIFNINYLGAEQSSFTLNFSKGASQVIGQYYQFIRLGKRGYESIMSNLTRTADYLTEVLEHDGFVIMSERGGQGLPLVAFRFKSAAEGGKDRHYDEFALAHHLRSRGWVVPAYTMAPHTEGLKMLRVVVREDFSKSRCDMLIHDIRLCLGMLENADEETIKRQEAFIRDHVASHGKSKQQAKHHATKHYQGESHSLQGKHGKTHAIC

SEQ ID NO: 40812 - protein, 219 aa, Caragana korshinskii
MANEVVLLDFWPSPFGMRLRIALAEKGIKYEYKEEDLRNKSPLLLQMNPVHKKIPVLIHNGKPVCESLIAVQYIDEVWSDRSPLLPSDPYQRAQARFWADYVDKKIYEVGRNVWTKKGEEQEAAKKEFIDALKLLEEQLGDKTYFGGEKLGYVDIALIPFYTWFKAYEVFGNLNIEKECPKFITWAKRCMQIENVSRSLPDQHKVYEFIVEIRKRFGIE

SEQ ID NO: 40813 - protein, 196 aa, Nostoc punctiforme PCC 73102
MSTDSPVNSSDKSESSLGKRLRNFLVVMVAIALSVALVLGLRTETTSASLAKLSNSSTPLEVAVSNGKPSLVEFYADWCTVCQKMAPDITQLETEYADKMNFVMLNVDNTKWLPEMLKYRVDGIPHFVFLSQQGETIAQAIGDQPRTIMASNLEALVTGSSLPYAQASGKVSKFSAPVAPTASQDDPRSHGSQVVN

SEQ ID NO: 40814 - protein, 366 aa, Lactobacillus acidophilus NCFM
MSLTAGIVGLPNVGKSTLFNAITKAGAEMANYPFATIEPNVGMVEVPDKRLARIQELIPAKKIVHTTFEFTDIAGLVKGASKGEGLGNKFLENIRQTDAIVHVVRAFDDDNITSVTGKVDPEEDINTINLELAIADLDAVNKRIGKVQKIAQQGDKDAKAEMAVLEKLKPVLEEGNAARSIDFNKDEQKIVKGLFLLTSKPIIYVANIAEDSMADPESDKYYQIVKRHAESEGAECLGISAATEEEIAGMEDDEKKEFLEMEGVEESGLDRLIRAAYHILGLRTFFTAGGPETRAWTFHKGMKAPQVAGVIHSDFERGFIRAEVVSYDDLDELETMQKVKEAGKLRLEGKDYEVQDGDIIEFRFNV

SEQ ID NO: 40815 - protein, 490 aa, Bordetella parapertussis 12822
MTISPLQLLNDPSLLRTDALVDGRWIAASQRFAVHDPATGRKLADVANLDAAHAREAIAAAQAAWPAWRARTVKERSAILRKWFDLLLANQDDLARLLTAEQGKPFGEARGEIAYAASFVEWFAEEAKRINGETLPAFDNNRRLLVLREPIGVCAAITPWNFPLAMITRKVAPALAAGCPVIVKPAEHTPLTALAAAQLAVRAGVPAGVLGVLPADGANSIAIGKELCANDAVRHLSFTGSTEVGRILMAQSAATVKKLSLELGGNAPFIVFDDADLDSAVEGAMQSKYRNAGQTCVCANRIYVQDGVYDAFVEKLADAVRALKVGPGFDEGVTQGPLIEPEAVDKIERHIEDAVSKGGRVVAGGRRLGGLFFEPTVLVDATSQMLCAREETFGPLAPVFRFHADEDAIAAANATEFGLASYLYSRDVGRIFRAAEALESGMVGVNVGILATEHVPFGGVKQSGLGREGGRHGIDDYVEIKYMCVGDILK

SEQ ID NO: 40816 - protein, 741 aa, Candida albicans SC5314
MGFHAPLNGSSKNSKSSAFASFDSASVMQIVNKAKDKIVPDAQFHQTITDQGIRHYQEKLSPLLQNSYHGANVNTNKQDSSPMKSPVTLQHALNVRLESILSLNVRPGEPFFVLWFLISSYFPLIAACLGPLANMISIVALVEHWKVDIITRKNVPDIPKVVVMNAVSLALGLIGNISLLMNFSRSVKYLVSQSVSIIAWLCASALLAAALFVTNREFGGENPKYVPSEGFYFAAFTSGNYFVCMLILVINFMGYSLKKYPPTFNLDQRQRTLMLFTILFSTWTVIGAFTMGSLIDDISYGSALYYCIVSFLTIGLGDILPETSGAKVAVLVFSLGGVLIMGLIVATLRSVILSSAAPAIFWNDVEKTRIALLAQLDKENRHLTSEESFHEMRVLRRKVKSRHKKVSLALTIAVFMIFWLIGALIFQKIEKWSYFNAMYFCFLCLITIVYGDYAPKTSLGRVFFVSWAVGAVPLMTILVSNVGDTLYEISNDISAWFSTWMFSTKEEYRDLKWKKKKLQEDQEDQLTVNSEAVRSSELDEDLDLAKMEQEASLEARDNSSNGEIGAASIDNPNEDVKVKDNDTCITNSSNSNMRKDQENNSYSERSVCKSEKQNFDIERIRQKIASKKQVHEMLIDYLEKMKPLIGDSIESPNRKYSYKQWKGAYDGFWLSESSPLRLPLKEPNYLILKIYFEIEMMLRGLVDMEIEDLKTLTIQDVSNELSSSSSTDIKFARTIKFDDDK

SEQ ID NO: 40817 - protein, 147 aa, Zea mays
  misc_feature (122)..(122): Xaa can be any naturally occurring amino acid
MKLNIANPATGCQKTIDFDDERKTRIFYDKRISAEVAVDSLGDEFKGYVFRITGGNDKQGFPMKQGVLLPSRVRLLLSKGHSCYRPRRTGERKRKSVRGCIVGSDMSVLSVTIVKQGEQDLXGLTDTTVPKRLGPKRANHIRKFFNL

SEQ ID NO: 40818 - protein, 778 aa, Kluyveromyces lactis NRRL Y-1140
MASRSNVFVGIKPHSEHSADVLGTSSTDKRVENYDYVLLPLTNTRYKDAMKAKFEDFRDHGHGWNEELKLDPPQLQELGVLPSNGNVSYIGLVSYFLELESHDADVRTLSLQVLEHELHYANFVGIRQVILAPPKKLHTLHYYAQSLCTVFDTFKEACPTISISLPLFEDSDPLSTWELWNTIRKMCGYEPKLTVSLALPRQKTPSFVLNRWLSEPVTCLLISASIFTTNQYNYPVLNKFNQHLITEFQRVNGNASTFGELAIVLHGMEKYTDKLKIEPTQYLEYLNYLLKKGDKLILMETQDVVHSAPTIMPPLLPHHDNLSNAVYQVFEKDTVKYELYERAIMVAVSEILTENSSSWRGPTELITLVAGAGRGPLVDKTFQVLHKLGVTNFRLLAIEKNPQALLYLQKRNFEHWDNKVEVIRTDIREWDENIKVDLCISELLGSFGCNELSPECIAPIEAFHSKPNTRFIPQGYSSYASPISSPILYQSLIEKGPEYLEKPSIIHNVPYCRTSSRVNEIWSFSHLHQQQHQFNKSSISHFRVKHKSEIHGIAGYFIATLYGDITLSIVPNDSVIKTLEDQENSNIDNSRSHNGSTATKVNHTENMKSWSPMFFPLKEPLFLNDDTELEVFITRNDLNSRVWYEWSVSSFVYLVSSSEIPKSEGERVPRTGSKENADIDTQNLTKAFARFGPQNDSSEIEDKYFEDSINHTNFMSGRTNEWDSVKDLHEIQNRHDSSNLTKDQEQRKKSLTEEYHVRVRTNISKLHNPNGCIYSIPL

SEQ ID NO: 40819 - protein, 912 aa, Neurospora crassa
MANAEGAPSITASERERTVSRASQTGIPRSPMVGPDRGRPRPRKPPMARRTSSNAQAPHRGEVFSVDDDITEVEADAAERQKSYSGSTARRRNLLPAPLSRVHSILDEDGANDSRDRDTPDVIEEVDTPGQEGDLNLPPPAEEDSAEGETPVEDDDGDISDAESFTLKDRQQAINETHPFGIRLWKPALYKKHRSVQKTAEGDIHSSPGGHVSRWLLFFNIMWTLAFGWWMSLIAYTGAIVCFVFAAAPSGREYGRVLWGLAGYLFYPFGKFIRLEQQDGYLDEDQDEGRSISEYEQWQSGDLEDGRLFFGPERDRSIIGHSRRSLDSEPDETESLLGRGRGHGSDSDLPRMKRRLFGRGQWNVGRVIYFLFFYTMIMPSLFIVSAICWFLVFWIPMGKVTMLLIDHLRRHPLALWFESDISTARASTTPHSSILICTYRAVGIKYWKYTIDGTNIFLVNMMAIVIFVIFDWIVLEGVLEIHNFFTSPAFLFVTGLLSIIPLAYFIGQAVASISAQSSMGFGAAINAFFSTIVEVFLYCVALQQGKAQLVEGSIMGSIFAGILFLPGISMCCGAIKRKTQRFNAKSAGVTSTMLLFAVIGAFGPTLFYQIYGTHELTCQDCLYFDHPRGSVRDCRRCYFSQTPAMNDRFYLEAVRPYCYIAAGMLFLSYIIGLWFTLRTHAAVIWNTEADEKKHEENTARNRGGHDAPNWSRLKSSIILMGATVLYAVIAEILVDTVDVVLESFEIDEKFLGITLFALVPNTTEFLNAISFAMNGNIALSMEIGSAYALQVCLLQIPALVLFSAIYPPDVPVADMARYTFSLLFPQWDMVTVILCVFLLSYMYGEGKSNYFKGSILLLSYLVVVIGYYFSGYSTGLEKSNSGISRFDTLGDDGQYMSYGFKTVGRGTSGVAY

SEQ ID NO: 40820 - protein, 263 aa, Moritella abyssi
MTMKATMTTPLVLKLGGALLQNETALEQLFTALSEYKSTCTSLILVHGGGCFVDDLLAKMNIESEKKNGLRITPASDIGYITGAYVGTANKVLMAQGIKLGFNVVGLTLADGGISTVTLSTAGLGAVGECEAGDPTLLTALLSGGFLPIISSIGIDAQGLLLNVNADQAATAICETLDADLVMLSDVAGILDADMQLIAEMNSHYADELIMAGVIHGGMEVKVKAALKAAASLNRDIKLASWKVPERLVALLNGEAEGSKVSS

SEQ ID NO: 40821 - protein, 395 aa, Zea mays
MAGVTATGMAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEAIREIEQQIQQSSDVQFDDIVVACGSGGTIAGLALGSRLSSLNTKVHAFSVCDDPEYFYDYVQGLIDGLNSGFDSHDIVSMENAKGLGYAMNTAEELKFVKDIAASTGIVLDPVYSGKAVYGLLKDMAGNPAKWKGRKVLFIHTGGLLGLYDKADQLSSLAGSWRRMDLEDSVPRKDGTGKMF

SEQ ID NO: 40822 - protein, 261 aa, Pseudomonas aeruginosa PAO1
MQLEFHQVDAFSSRPFSGNPAVVYRLDAWLADELMQMIATEHNLSETAFVVREGEAWRIRWFTPSVEVALCGHATLAAAHVLFEVYDEPGERLEFISRSGALRVNREDERLVLDFPAQYPSEVGSTVELEQALGLPPVDVLGSTDKLLVLLESEEAVRACRPDFAALARLPWRGVIVTARGLQKDFVSRFFAPAMGVDEDPVTGSAHCSLIPYWAQRLNKLSLTAQQCSARGGELWCRLEGERVSIAGHAVLVASGRIRLS

SEQ ID NO: 40823 - protein, 264 aa, Moritella profunda
MTMTATMTTPLVLKLGGALLENETALEQLFTALSEYKSTSSRPLVLVHGGGCFVDELLAKMNIVSEKKNGLRITPFSDIGYITGALAGTANKVLMAQGLKSGAKVVGLSLADGGIATVTQSTAGLGAVGECEAGDPTLLTALLSGGFLPIISSIGIDAQGQLLNVNADQAATAICETLDADLVMLSDVAGILDADMQLIPEMNSNYAAELIAAGVINGGMEVKVKAALKAAASLNRDIKLASWKVPERLVALLNGEVEGTKVSS

SEQ ID NO: 40824 - protein, 180 aa, Methylococcus capsulatus str. Bath
MAIQTYNGIHPTLGHNVFVAESAFVAGDVSLGDDVSIWPCVVARGDVHRIEIGPATNIQDGSVLHVTQPSAFNEAGFPLIVGAGVTVGHRAVLHGCTIGDLCLIGIGAIVMDGAVIEDRVMVGAGTLVPPGKRLESGYLYVGSPVRQARPLKDSELEFLVHSRDGYVRLKERYLRDGVML

SEQ ID NO: 40825 - protein, 472 aa, Pseudomonas putida KT2440
MPVGNHSAHGQATEGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVLGGIGIIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYTFRLAPKDAQGVTSTAS

SEQ ID NO: 40826 - protein, 85 aa, Glycine max
  misc_feature (81)..(81): Xaa can be any naturally occurring amino acid
MASQEKPITPSPAPPAPPQPPTPEGAPRIRGFGGGAAGGGYPNPPDAALPDAATLRDQWRFAVRQYSRWYSQAWGTAILAXGAFF

SEQ ID NO: 40827 - protein, 191 aa, Magnetospirillum magnetotacticum MS-1
MTYRVLRLILSLLAYVLLRPQVTGRNNIPRHGAVILASNHLSFIDSLLIPIVAPRHVTFLAKAEYFTGRGIKGRLSRWFFTTIGMIPVQRDDPRAGQRSLEDALEVLQRGGAFGIYPEGTRSRDGKLHPGRTGVAWLALAGHAPVVPVAVRGTDKVQPVGKRIPRLHRVEVHFGKPIDPQRQITAGTKPAQ

SEQ ID NO: 40828 - protein, 132 aa, Brassica napus
  misc_feature (119)..(119): Xaa can be any naturally occurring amino acid
  misc_feature (121)..(121): Xaa can be any naturally occurring amino acid
  misc_feature (124)..(124): Xaa can be any naturally occurring amino acid
  misc_feature (127)..(127): Xaa can be any naturally occurring amino acid
MAANFWESSQYKQLLDQEEVDVVQPLDKERGISVEDFKLIKFHMSNHIMKLAQHIKVRQRVVATAITYMRRVYTKKSMVEFEPRLVAIACLYLASKAEESIVQARNLVFYSKRLYPDEXKXELXDIXGMEMR

SEQ ID NO: 40829 - protein, 342 aa, Magnetospirillum magnetotacticum MS-1
  misc_feature (45)..(45): Xaa can be any naturally occurring amino acid
  misc_feature (52)..(53): Xaa can be any naturally occurring amino acid
  misc_feature (57)..(57): Xaa can be any naturally occurring amino acid
  misc_feature (60)..(60): Xaa can be any naturally occurring amino acid
  misc_feature (62)..(62): Xaa can be any naturally occurring amino acid
  misc_feature (68)..(68): Xaa can be any naturally occurring amino acid
  misc_feature (70)..(70): Xaa can be any naturally occurring amino acid
MVVVFAVINLWGVRQFGELEFWFAFVKVAAIVGFLVVGVLLVLGXAAPGRSXXSARXEPXLXGPRGGXSXPEGWGGIAAGLLVVVFAFGGIEIVTIAAAEAREPRTAVARATRSIVWRILVFYLGSVAIMVLVLPWDSPLLAESPFVAVLDLAGLPGAARVMEVVVVVALLSAFNANVYGTSRMAYSLAGRGDGPRALRRVSRRDVPWVSVLVSVFFALVAVGLNWLLPEALLGILLNAVGAALLVVWVLVAVSQLRLRRRIEAQARASGEPMTLRMWGFPWLTWAVLVGLAALAVLMLTDAAARAQLVSTAGLVVVILAVYLVTRRGRARRGAAAGARADG

SEQ ID NO: 40830 - protein, 166 aa, Erwinia carotovora subsp. atroseptica SCRI1043
MAHIEKQAGELQEKLIAVNRVSKTVKGGRIFSFTALTVVGDGNGRVGFGYGKAREVPAAIQKAMEKARRNMMNVALNNGTLQHPVKGAHTGSRVFMQPASEGTGIIAGGAMRAVLEVAGVHNVLAKAYGSTNPINVVRATIDGLANMKSPEMVAAKRGKSVEEILG

SEQ ID NO: 40831 - protein, 485 aa, Desulfococcus oleovorans Hxd3
MQNGSITPAGSGVFQAATPLKEIDRVFAAQQAAFRQAPWPGAKERVAHLYRLREGLKTYQKTIIEAIDADFEGRSADETLLAELFPSMEGLAYAARHVAGWMKPSRRTPGLMFRPARARVEYQPKGVTGIIVPWNYPLFLAVSPLTAALAAGNRVMVKMSEYAPRLAAVFQKMIAERFDENHVAVVWGGADVGMAFTGQPFDHVLFTGSTDVGRHVMRAAADHLTPVTLELGGKSPAIVSRDIPVERAAERIMFGKAFNAGQTCIAPDYVLCPADRMAPFLDACKTVFARCYPTVKENPDYTAIINDRQHARLQEMLRDAEMRGATVIPVNPAGEDFAGSRKMPLYLVRDCTEKMRLLQEEIFGPVLPVLPYDTLQQAVDYINDRPRPLALYYFGYNRKNADFVIRNTISGGVSVNETLVHAAADDLPFGGIGASGMGEYHGQEGFLTFSKARSVFEKSRFNLNRLILPPYDRPGFRLLRRLLLK

SEQ ID NO: 40832 - protein, 724 aa, Oryza sativa Japonica Group
MATVPTPSEAHGGATPTAADVEMVEASELRRRGKPSGDRATGPSRDGAAAAAEEAAAPSVERVFADRPVPSWREQLTVRAFVVSFFLVIMFSVIVMKLNLTTGIIPSLNVSAGLLGFFFVRLWTAAIERVGLLRQPFTRQENTVIQTCVVAGYDIAFSGGFGNYILSMSERIAGLGTEANNAQNIKNPHLGWIIGFLFLVSFIGLFGLVPLRKVMIIDYKLTYPSGTATAFLINGFHTPHGAKIAAKQVKKLGIFFILSFFWGFFQWFYTATDDCGFHKFPSLGLQAFQHKFFFDFSPTYVGVGMICPHIVNVSVLLGGILSWGIMWPLIAKKRGDWFSADLPDGSLHGMQGYRVFIAIALILGDGLYNFLKMIILTAFSLRSQIKKKNASTLPVSDDGMVTTTAAVSYDEERRNELFVKDQIPWYVAYGGYAVVAAISIGTVPQIIPQLKWYQILVAYIVAPILAFCNAYGTGLTDWSLVTTYGKLAIFAFGAWTGASHGGVLAGLAACGVMMNIVSTAADLMQDFKTGYLTLASPRSMFVSQVIGTAMGCVIAPCVFWLFYKAFDNIGISGSDYPAPNAAVFRSIAILGVDGFSSLPKNCLNLCYAFFAAAIVVNLIRDLVPKVSRFIPIPMAMAIPFYIGSYFAIDMFIGTVILFVWQRVDRAKADTYGPAVASGMICGDGIWVLPQSVLALAKVKPPICMKFLSRRTNDKVDAFLTTLGK

SEQ ID NO: 40833 - protein, 310 aa, Clostridium perfringens ATCC 13124
MKKVICPGEALIDFISMDVSKSLKETSGFLKKAGGAPANVAAAISKLGAEAYFCGTVGNDAFGNFLEDTLKRNNINTELMFKLNNRNTTLAFVSLMEDGERDFSFARDADACLELDMIKNKLKKFDLYHFGSATAFLDGSLKKTYYQLKEYALKNNKLISFDANYRDNLFKDNKEEFIKCCKDFIKDSDVVKLSDEEALLISNKTSIKEAADYIKSLGCKNLIITLGKKGAMLTTGDYQLIVPTKELEMKDATGAGDAFMGAVLAQMLNNTNRNMIEIVRLANLVGGITTTKLGALESIPTWDEVLLLSK

SEQ ID NO: 40834 - protein, 365 aa, Ehrlichia chaffeensis str. Arkansas
MENLFNRFHSNKYITEKSIAELRCGIPVLLYNSNDSLLIFPSELIDNQLLNTLKKHFKDINILVTGNRLNFIFQSSGNQLSRIKIKESHDLEYISSLLTGQELHKGSLVIDNVTVSTNSLDITAISLIKLTKLLPSAVVVDINDSDVLHWCTKNNITPIRQEIIENYNKEYEIQEVCSSPLFLKDCSNAKINVYRSHTGELEHYAIIIENPDYSNPIIRIHSSCYTGDLLNSLSCDCRCQLHTAIKLMIENKGGIILYLAQDGRGIGLANKIRTYQLQIKHNFDTVDANRFFGFEDDERVFIPAIKILQKLGISRLQLLTNNPNKISEIQNHGIQVTKILPIFVDTNQHNINYINTKAKRLGHVC

SEQ ID NO: 40835 - protein, 513 aa, Triticum aestivum
MVSNGELSQPQAGEYGLAVMRRRPKTKIVCTLGPASRSVDMIEKLLRAGMCVARFNFSHGSHDYHQETLDNLHAAMDRTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPGVVVDLPTLTEKDREDILQWGVPNKIDMIALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLDGTDCVMLSGETAAGAYPELAVQTMAKICLQAESCVDYSAVFKSIMSSAPIPMSPLESLASSAVRTANSAKATLILVLTRGGTTARLVAKYRPSMPILSVVVPELKTVEFDWICSDEGPARQSLIVRGVIPMLSAGTAKAFDSEATEEALRFAMKNAKEMGLCNAGDSIVALHRIGNASVIKLLTV

SEQ ID NO: 40836 - protein, 182 aa, Pseudomonas syringae pv. tomato str. DC3000
MTFDQSNFKSLIRPVVDFPKPGVVFRDITPLFQSPKATRQVIDSFVQRYIDADFSHIGVMDARGFLIGSVVAYQLNKPLVLFRKQGKLPADVLSEAYQTEYGEAYLEVHADSLCEGNSVIMFDDLIATGGTLIAAANLIRRMGAQVHEAAAIIDLPELGGSKRLNDLNIPTFCLTEFALDEQ

SEQ ID NO: 40837 - protein, 468 aa, Salmonella typhimurium LT2
MDTLQQSPPAEPEGGLRRNLKKRHLLMMSLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVYMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGTWFSEQGVVIMLVELAFMIGILLSWYLFRPTLSRLRNTVG

SEQ ID NO: 40838 - protein, 114 aa, Saccharomyces cerevisiae
MGHHHHHHSSYTSITKLTNLTEFRNLIKQNDKLVIDFYATWCGPCKMMQPHLTKLIQAYPDVRFVKCDVDESPDIAKECEVTAMPTFVLGKDGQLIGKIIGANPTALEKGIKDL

SEQ ID NO: 40839 - protein, 277 aa, Methylobacillus flagellatus KT
MSKILIAGCGDLGLELARRLTAQGHEVTGLRRSAQPMPAGVQTLIADVTRPDTLASIVHLRPEILVYCVAASEYSDEHYRLSYVEGLRNTLSALEGAPLQHVFFVSSTGVYGQEVEEWLDEDTPPIAKDFSGKRMLEAEALLAAYSSTILRFSGIYGPGRLRMIRQAQTPEQWPARNAWTNRIHRDDGAAFIAYLIQQRSHAVPERLYIVTDNQPLPVHDLLRWLADRQGIAYPAGATPPVQGNKKLSNARLLASGYQLIYPDYVSGYGALLAAMRP

SEQ ID NO: 40840 - protein, 346 aa, Oryza sativa Japonica Group
MDLQEAAMEARNGHRIPPTEEKVIIDTDPGIGTLILISPLLLPASVTVIHPSILTITNSYQFPDDSVAIMMAFEAPGVKCDRAGRPEVPVAEGSAEPLKGGKPHVADFVHGSDGLGNTSFPDPTTTNKVEQSAAEFLVDKVSESPGEISVLALGPLTNIALAMKKDSSFASKVKRIVVLGGAFFAAGNATPSAEANIHSDPEAADIVFTSGADIYVVGLNITTQVYFTDKDMLELRNSKGKHAQFLCDICKFYRDWHVHSYGVDALFLHDPVSFTALVHPEYFTFKKGVVRVETQGICKGHTSMDMGLKKWNSDNPWTGYSPISVAWTVDVPKVLAYAKELLFNAQ

SEQ ID NO: 40841 - protein, 512 aa, Pseudomonas aeruginosa PAO1
MSQAHTPSAPLAEVYDVAVVGGGINGVGIAADAAGRGLSVFLCEQHDLAQHTSSASSKLIHGGLRYLEHYEFRLVREALAEREVLLAKAPHIVKPLRFVLPHRPHLRPAWMIRAGLFLYDHLGKREKLPASRGLRFTGSSPLKAEIRRGFEYSDCAVDDARLVVLNAISAREHGAHVHTRTRCVSARRSKGLWHLHLERSDGSLYSIRARALVNAAGPWVARFIQDDLKQKSPYGIRLIQGSHIIVPKLYEGEHAYILQNEDRRIVFAIPYLDRFTMIGTTDREYQGDPAKVAISEEETAYLLQVVNAHFKQQLAAADILHSFAGVRPLCDDESDEPSAITRDYTLSLSAGNGEPPLLSVFGGKLTTYRKLAESALTQLQPFFANLGPAWTAKAPLPGGEQMQSVEALTEQLANRYAWLDRELALRWARTYGTRVWRLLDGVNGEADLGEHLGGGLYAREVDYLCKHEWAQDAEDILWRRSKLGLFLSPSQQVRLGQYLQSEHPHRPRVHAA

SEQ ID NO: 40842 - protein, 400 aa, Streptomyces clavuligerus
MSNQEFAQRWQGVMIDSYGTPGLSFVRGEGSTLWDADGTAYTDFVSGLAVNALGHAHPAVVGAVSRQIASLGHISNFYSAEPTITLAERLIELFGRPGRVFFCNSGAEANETAFKIGRLTGRSRIVAAQSGFHGRTMGSLALTGQPAKREPFLPLPGDVTHVPYGDAEALRAAVTEDTAMVILEPIQGESGVVVPPKGYLRAAREITEATGTLLVLDEVQTGIGRTGHWFAAQAEGVEADVVTLAKGLGGGLPLGAAVAFGRAAELMTPGHHASTFGGNPVSCARTRVLDTIAADGLLDRVKQLGSAPDEWSVRDAAAIRWSPMSGAGLMLGIVLNEPLAPQVQLAAQKAGFLVNVPAPDVVRLIPPLVIEETEVDAFLQALPGLLDAVHERDREGQTGE

SEQ ID NO: 40843 - protein, 302 aa, Streptomyces clavuligerus
MTRKNNALPKARTLIEALPWLTRHHGKTIVVKFGGNAMVNEELKGAFARPSFLVHHAGLRPVVVHGGGPQISAELDRYGLVSEFKAGLRVTTDEAMDVVRMVLAGQVQRDVWGCSIVHGPLAVGITGEDAHPISATRHRPLIDGEPVDIGRVGEVTRIDTGAVLALLEDGRIPVVSSIARAEDDGHVYNVNADTAAAALAAALGAETLMVLTDVEGLYEDWPNSDEVISRLTASELETLLPDLSSGMVPKMEGCLHAVRNGVRTARVIDGRVPHSILLEIFTDDGVGTMVVPDEPSVSEGTS

SEQ ID NO: 40844 - protein, 452 aa, Candida glabrata CBS 138
MSSDEEDFNDIYDTKDESKVDAKDDVKAEEKVPEAATSALDQLAALQASSANPDSNKDDAAKMPWETLQNTLNQLQTVTKEESPDKSKEEKSSNASVDSGTNVQSGNTGDRTVKADLSKDSCKMFIGGLNWETTEDGLRDYFSKYGKVEELKIMKDPATGRSRGFGFLTFESASSVDEVVKTQHILDGKVIDPKRAIPREEQDKTGKIFVGGIGPDVRPKEFEEFFAQWGTIIDAQLMLDKDTGRSRGFGFITYDTPDAVDKVCQNKFIDFKGRKIEIKRAAPRHLQKTGGARQPAQQSSNSQYGMGTGSNSSGQYPGYGFQDPMMFSNPMMSGYNPMFANNNPQMQEYFQKMQDYYKQVQQQGGMDYNQMYQQQMQQMAMMMPGFNPSTMGQQSQGSPDANSTKSQSNEASTPTPDDQDRGNKDSSRRSGGPGGFRGRPNDSRRGYHPYNR

SEQ ID NO: 40845 - protein, 114 aa, Desulfovibrio desulfuricans G20
MNIYVGNLSYQMSEDDLRGAFEEFGAVDKVRIITDHDTGRSKGFGFVEMAEDSEANAAIEALNGREMGGRSITVNEARPRPERSGGGGGGFRRSGGGGGYGNRGGQGGGYGRRY

SEQ ID NO: 40846 - protein, 421 aa, Xylella fastidiosa
MASTKEISQYLKRFSQLDAKRFAVVKVGGAVLRDDVDALTSSLSFLQEVGLTPIVLHGAGPQLDEELTAAGIQKKTVNGFRVTLPETMAIVRKVFHTSNLQLIEALQRNGARATSITGGVFEAHYLDQETYGLVGEISAVNLAPIEASLRAASIPVIASLGETPSGQILNINADVAANELVHVLQPYKIIFLTGTGGLLDADGKIINSINLSTEYEQLIQQPWVYGGMKLKIEQIKHLLDRLPLESSVSITRPADLAKELFTHKGSGTLVRRGERVIRATTWKDLDLPRLQHLIQSSFRRTLIPHYFETTPLLRAYVSENYRAAVILTKLGNVPYLDKFAVLDDAQGEGLGRAVWSIMREETPQLFWRSRHNNQANAFYYAESDGYYKQDHWKIFWNGLHHFQQIQQCVAHCAQHPPTLID

SEQ ID NO: 40847 - protein, 429 aa, Deinococcus radiodurans
MTGNEQNPSKWLAAEKKYDSGVYNKHDVVMVRGQGATVWDENGRSYIDCVVGYGVATLGHSHPDVVKAVQEQAGKLMVMPQTVPNDKRAEFLQELVGVLPQGLDRVFLCNSGTEAMEAAKKFAITATGRSRFVSMKRGFSGRSLGALSFTWEPKYREPFGDAVDNKSVDFVTYGNLDELRAAVTEQTAAVIMEPVQGEGGVRPASAEFIQEARRITREKGALLILDEIQTGFCRTGKMFACEHFGVIPDGMTLAKAIAGGTPTAAFAMMSEVADRMPAGGHGTTFGGNPLSMAAGVASLRAMKREGLAEQAREKGAYMMDKLRAIQSPKIREVRGLGLMIGVELKEKSAPYIHAMEHDEGVLCLAATPLVVRFLPPAVISKEQIDQVVAAFERVLNNVNPREERQAELRAQQSEMGQQQVSQGESVQTE

SEQ ID NO: 40848 - protein, 539 aa, Arabidopsis thaliana
MGLCFSSPKATRRGTGSRNPNPDSPTQGKASEKVSNKNKKNTKKIQLRHQGGIPYGKRIDFGYAKDFDNRYTIGKLLGHGQFGFTYVATDNNNGNRVAVKRIDKAKMTQPIEVEDVKREVKILQALGGHENVVGFHNAFEDKTYIYIVMELCDGGELLDRILAKKDSRYTEKDAAVVVRQMLKVAAECHLRGLVHRDMKPENFLFKSTEEGSSLKATDFGLSDFIKPGVKFQDIVGSAYYVAPEVLKRRSGPESDVWSIGVITYILLCGRRPFWDKTQDGIFNEVMRKKPDFREVPWPTISNGAKDFVKKLLVKEPRARLTAAQALSHSWVKEGGEASEVPIDISVLNNMRQFVKFSRLKQIALRALAKTINEDELDDLRDQFDAIDIDKNGSISLEEMRQALAKDVPWKLKDARVAEILQANDSNTDGLVDFTEFVVAALHVNQLEEHDSEKWQQRSRAAFDKFDIDGDGFITPEELRLNQCLQQTGLKGSIEPLLEEADVDEDGRISINEFRRLLRSASLKSKNVKSPPGYQLSQKM

SEQ ID NO: 40849 - protein, 839 aa, Desulfovibrio desulfuricans G20
MVGLVIVSHSAVLAEGVRELALQMTQGRVRIALAGGVDDAEHPIGTDPTRVMAALEEVQDGDGVLVLMDLGSALMSAETALDLLPPEVTANVRLSAAPLIEGCIAAAVQAAAGASLDDVQAEAESALAAKSAQLGSAVPDMAASSAGAAGAVPDAAAEHVRTLAVTVPNRLGLHARPASRIVGALAGLDADVRLAHGGHVVNARSLNQIATLAVRLGDSIEFRAAGADAQQALDALQALHAANFGDPREPEEGQADSHGAAPVRPAGAVAASAGYAAGPAVRFRAALPEVAEIQVDDQAAEKRVLQDALKQAADEIALVEKQTAGNVGGAESEIFGMHRMMLQDPELRDAALHELEERRCNAAAAWRRVIVSTAERYRGLDDDFMRARAADVLDVGARVLRIITGEAPQGPDIAEPSVLLAADLGPSDMARLDVTKVLGIVTEQGGATSHAAILARSMGIPAVAGAAAQIAGVTDGTPVGLDGNTGEVWAPADEHTVQRLRGLRRQWEESLRSEREKAAAPAVTRDGRAVRVHANIGSPADAHAAVRNGAEGVGLFRTEFLFLDRPSAPTEDEQTAAYTEAAQALDGRPVIIRTLDIGGDKPVPYLQQGQAAEANPFLGVRGIRFCLVHEDLFVTQLRALLRAAADHPVQIMFPMVAHPGELRAARTLLEKARAQLLAEGRPCGHDVPVGIMIEVPAAVALADQLAAEADFFSIGTNDLAQYVMAADRGNSAVAALSDALHPAVLRQIQQTVEAGHAAGIHVGMCGELAGAPLAVPLLAAMNLDSLSMSGPAVPRAKEIIRSIDAAALQPLVEQVLELPDAAAVRNLLQQAAGESADRA

SEQ ID NO: 40850 - protein, 556 aa, Vibrio parahaemolyticus RIMD 2210633
MFGSRFKDINFKGDIFGGVTTAIISLPLALAFGVASGAGAEAGLWGAIMVGLFASLFGGSNTLISEPTGPMTVIMTAVLTSMMAKYPETGMAMTFTVVMMAGAFQILLGTLKMGKYVTLMPYSVISGFMSGIGVILIILQLSPLLGHAAPAGGVLGTLSALPETISNLKFNELFLGLLTLGILFFFPKKYRKYVPAQLVALVAVTLLSVMLFDTEDIRRIGEIPAGLPSLVAPHIDPDMFVEMVIDALVLGTLGCIDTLLTAVIGDSLTRKEHDSDKELRGQGLANMISGLFGALPGAGATMGTVTNIQVGARSPLSGVVRALVLALVVLVAGGLTEPIPMAVLAGIAVYVGFNILDWSFIQRAHKVSFSGMAIMYGVMLLTVFVDLIVAVGLGVFVSNIMIIERLSREQARQVKAISDADEDDVPLTDSERGLLDRANGRVLFFYLSGPMIFSVSKAISRQHTSISDYDVMILDLTDVPMLDVTVGLALENAIKDALDARCEVYLLCPNQRTREQLEKFHVIDLVPDNNMYQFRYEALNAAVAHVESDQYQRMTA

SEQ ID NO: 40851 - protein, 153 aa, Triticum aestivum
NKFVQKSRLVPVRNSRDIVDPGENDLPGLTDTEKPRMRGPKRASKIKKLFNLGKDDDVRSYVNTYRRTFLNKKGKKVSKAPKIQRLVTPLTLQRKRARIADKKKRIAKKKSEAAEYQKLLAQRLKEQRDRRSESMAKRRSKLSAATKAPAASA

SEQ ID NO: 40852 - protein, 611 aa, Agrobacterium tumefaciens str. C58
MASFAKYIGGSPTNIAAGAARLGLNSAVITRVGDEHMGRFIREQLVREGVDVRGVKTDPERLTALVLLGIRDQNQFPLIFYRENCADMALSEDDIDPAFIADAGCICATGTHLSHPNTEAAVLKALKLARENGAKTALDIDYRPNLWGVAGHGDGESRFVESQKVTAKLQSTLHLFDLIVGTEEEFHIAGGSTDTLTALNAVRKVSNATLVCKRGPMGASVFTGDIPDSLDDGETGEGFPIEVFNVLGAGDGFMAGLFRGWLRGEDWPTTLKYANACGAFAVSRHGCTPAYPSWEELQYFFKAGIRNKALRKDEALEQVHWSTNRKGDWDTMRVFAFDHRMQLEAIADELGVKHEQIGAFKKLCLQAAQKVSGGEAGYGILCDGRLGRDALFAASGSGLWIGRPVEWPGSRPLTLEPDLGKDFGGLSEWPLENVVKVLCFYHPDDTDEMRAAQEETVIRLFEAARRNRLEMLLEVIPSKVGPTDDLTAARIIERFYEIGVYPDWWKLEPMKTTAAWKNACDAVHRNDPYVRGIVVLGLDAPQSELEESFRLAAGFDLVKGFAVGRTIFADAARGWLGGKITDEEAVKDMAQRYTSLCRIWDEARAKKGEAA

SEQ ID NO: 40853 - protein, 186 aa, Clostridium perfringens ATCC 13124
MKNNDSKISKYISLILRHKPEEIGLKLDEHGYLGVLDLIEGLNKSYEGFSMDDLERIVREDSKGRYSFNEDKSKIRANQGHSIKVDLGLEPIKPPKVLYHGTGRKYLESILKNGLIKKERNYVHLSKDIETASIVGKRHGDLVILEVDSESMFNDGIKFYLSKNNVWLCNYVPKKYIKELNLEEVF

SEQ ID NO: 40854 - protein, 281 aa, Cryptococcus neoformans var. neoformans JEC21
MVREIDPPSVQNEFLLAALAEGKRLDGRLPLQMRDVHYIFGDELGCVECRLGKTAILAQVSATIVKPRDDRPYEGFLLINSEIGPMASSVYENGRPGDDEVMIGRLLEKSIRRTEAIDREALCILAGEKVWQLRLTLHFLSDSGNLLDCAALAGMAALKHFRKPDVEVIGDEVIIHSPEERAPVPLAIHHTPLCLTFAYFENLPPILDPSHVEMMLCSGTLTLTLNAQREICVLSKAGGAPLGAEEIMGVVKVGVDKVRELVRHLEEELEKDRTSRVVEVR

SEQ ID NO: 40855 - protein, 454 aa, Erwinia pyrifoliae
MVMSALQQRLTQWAHQQQRRLERYSPVSRYGRVTGISGILIECILPGARIGDLCRIQRSDGGSVLSEIVGFSPEKILLSALGALDGISQGATIVPLYLPHRICVSEQLLGSVLDGFGRALEPGGHSAFAEPGTQVRAVPVLNDAPPPTERPRITTPLPTGLRAIDGLLTIGNGQRVGIFAGAGCGKTTLLAELARTPRCDAIVFGLIGERGRELREFLDHELDEELLSRTVLLCATSDRISMERARAAFTATAIAEAFRAEGKSVLLIVDSFTRFARAQREIGLALGEPPGRGGLPPSVYTLLPRLVERAGQTQQGAITALYTVLIEQDSMNDPVADEVRSLIDGHIVLSRRLAERNHYPAIDVLASLSRTMSNVVEPHHMMQAGRLRSLMAAYQQVEMLIRLGEYQPGNDSLTDAAVKPNDIINRFLRQSMRAPDPFEQTQYHLAEVSAHAPD

SEQ ID NO: 40856 - protein, 546 aa, Candida glabrata CBS 138
MSTSGAENGVGASRARKSTCTEANDTDKVGVKTISEVTDLQTIESSPSTCEEPMSNKDVIKAAFKKYIKFIGPGLLVSVAYIDPGNYSTATSAGAANQFSLLCVVLLSNFIAIFLQCLCIKLGSVTGMDLSRACRKHLPRWANWTVYFFAECAIIATDVAEVIGTAIALNILIKVPLPAGVCITLVDVLAIMATYRPGASSMKVVRMFELFVALLVVGVCICFAVELAYIPKSTSAAKVFRGFVPSRQMLEHNGVYTAISILGATVMPHSLFLGSALVQPRLLEYDVNHGNYSMLKDDEDEKNKETAVDERYQNYRPTRSAIKYCMKFSMIELGLTLFTLALFVNCAILIVAGSTLYGYPDAADADLYTIHDLLSKTLAPIAGTIFMLALLLSGQSAGIVCTMAGQIVCEGHIHWKLKPWQRRLVTRAISLIPCLAISISIGKEALSKALNASQVVLSIVLPFLVAPLIYFTCNKKIMETEITVKDAEEDPSDNDDMQLENGQTRKTVSMANNWVVSIIAFVVWVFLSALNIYAIVQLGITHGEIS

SEQ ID NO: 40857 - protein, 264 aa, Bordetella parapertussis 12822
MRQALFLGYGRMGAALGEAWLRAGLLAGIDAVDPGRDGAGLRARLVRGADELPEQAYDLVVLAVKPAMAQQALRPVPPARLARACLVSIMAGVPAGALRQALQPPRPVARAMPNTPVMAGQGCTGLYGGDDVAPAQRAAIGRLFEAVGAAFWVDTEDQLHAVTALSGSGPAYYHLFSEALAQAGEQLGLPAALARSLAARTALGAASLQCEEGADFAALRREVTSPHGTTHAAIEVFEQAGALRTLVRDAVRQAQARSRELARP

SEQ ID NO: 40858 - protein, 270 aa, Xanthobacter autotrophicus Py2
MAFSPDEIERYARHIVLHDVGGPGQQKLKAATVLVVGAGGLGAPVLLYLAAAGVGRLILVEDDVVSLSNLQRQVIHRTQDVGRPKTDSASDAIAALNPHVELVTHAVRLDAGNALDLIARADVVVDGSDNFATRYLVSDACVLAKKPLVTAALGAFDATVTTLRAHETAPDGTPNPTYRCLFPEPPPAGTVPACAEAGVLGALAGIAGSLAALEAIRAVVGFGEGLVGRLLMIDARAMRFETLSYGWDPDNPLTGTGERITDLSAHVRTR

SEQ ID NO: 40859 - protein, 485 aa, Mycobacterium tuberculosis H37Rv
MSSSESPAGIAQIGVTGLAVMGSNIARNFARHGYTVAVHNRSVAKTDALLKEHSSDGKFVRSETIPEFLAALEKPRRVLIMVKAGEATDADAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRGAVESAIDSWRRVVSTAAQLGIPTPGFSSALSYYDALRTARLPAALTQAQRDFFGAHTYGRIDEPGKFHTLWSSDRTEVPV

SEQ ID NO: 40860 - protein, 169 aa, Zea mays
  misc_feature (57)..(57): Xaa can be any naturally occurring amino acid
  misc_feature (65)..(65): Xaa can be any naturally occurring amino acid
IPPSRHTIASHLVSALSDPTEWYTSFIMIKTDGFHKLLVVEIISRLENKVFDLIVSXIVNAERSXANKLYIDVASCPSSTPPEIIISGPVEVMDWKGNTDSTTGRTIIVASNPQSYEAGTIQGIFAADVEKNDVHEEDGIVTADKDIALRVPEGHADCENSQHPYIYEE

SEQ ID NO: 40861 - protein, 475 aa, Vibrio parahaemolyticus RIMD 2210633
MSKEIKAQVVVLGSGPAGYSAAFRCADLGLETVLVERYSTLGGVCLNVGCIPSKALLHVSKVIEEAKAMADHGVVFGEPQTDINKIRIWKEKVVNQLTGGLSGMAKMRNVTVVNGYGKFTGPNSILVEGEGESTVVNFDNAIVAAGSRPIKLPFIPHEDPRIWDSTDALELKEVPEKLLIMGGGIIGLEMGTVYHSLGSKVEVVEMFDQVIPAADKDIVKVYTKRIKDKFKLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGIKYEVATFPWAASGRAIASDCSDGMTKLIFDKETHRVIGGAIVGTNGGELLGEIGLAIEMGCDAEDIALTIHAHPTLHESVGLAAEVFEGSITDLPNKKAVKKK

SEQ ID NO: 40862 - protein, 627 aa, Vibrio parahaemolyticus RIMD 2210633
MAIEINVPDIGADEVEVTEILVSVGDKVEEEQSLITVEGDKASMEVPASQAGIVKEIKVAEGDKVSTGSLIMIFEAEGAADAAPAPAAEAAPAAAPAPAAAAELKEVHVPDIGGDEVEVTEIMVAIGDSIEEEQSLITVEGDKASMEVPAPFAGTLKEIKVAAGDKVSTGSLIMVFETAGSGAPAAPAAVEAPAAAAPAASAAKEVNVPDIGGDEVEVTEIMVAVGDTVEEEQSLITVEGDKASMEVPAPFAGTVKEIKIAAGDKVSTGSLIMVFEVAGAAPAPVAAPAQAAAPAAAAPKAEAPAAAAPAAGDFQDNDEYAHASPVVRRLAREFGVNLSKVKGSGRKSRILKEDVQNYVKEALKRLESGAAASGKGDGAALGLLPWPKVDFSKFGETEVQPLSRIKKISGANLHRNWVMIPHVTQWDNADITALEAFRKEQNAIEAKKDTGMKITPLVFIMKAAAKALEAFPAFNSSLSEDGESLILKKYVNIGIAVDTPNGLVVPVFKDVNKKGIYELSEELMAVSKKARAGKLTAADMQGGCFTISSLGGIGGTAFTPIVNAPEVGILGVSKSEMKPVWNGKEFEPRLQLPLSLSYDHRVIDGAEGARFITYLNACLSDIRRLVL

SEQ ID NO: 40863 - protein, 465 aa, Oceanobacillus iheyensis HTE831
MNSIGVFGLGVMGANLAMNMANKGEKVAVYNYTSDLTEKFKSNFTSDNAEAHYDLERFVNSLEKPRKVFLMVTAGPVIDSVIDSLVPLLDKDDIMMDGGNSNFNDSNRRYHRLKEAGIHFVSVGVSGGEEGALHGPALMPSGDEKVYQEVAPILEKIAAQVDGKACCGYLGKEGSGHYVKMVHNGIEYADMQLITEAYQFLRERLGLSVEEIATTFREWNEGELESYLMEITSDILTHVDEETNKPMVDVILDKSGQKGTGKWTSQNALDVGVPLSIITESVFARFLSGLKEERVRADQMLSGPTKLDQDLDKQAWLELVRKALFMGKICAYAQGFHQYKQASEAYGWDLKLEEIALIFRGGCIIRAGILNEISDAFKADKQLPNLLLSPFFQEKMNDYQASLRKVVIKGMESGLSLPSLGASLTYYDGYRSSQSGANMIQAQRDYFGAHTYERVDKKGTFHTAW

SEQ ID NO: 40864 - protein, 238 aa, Vitis vinifera
MCTLEERGNLFLLILTGDNEHRLGPTLVDSIRSALAQVKSQATPGSALITTAHDKFFSNGLDLPWAQAAGSSGFRDRLNHLVNNFKPIIADLLSLPMPTIAAVSGHAAAAGFRLAISHDYVLMKNDRSVLYMSELDIGLTFADYFMAMLKSKISDPAARRDVMLRAKKVKAEEAVRMGIVDSTHDSAESTVEAAVRLAEQLSGRKWNGEVYAEIRKAMHPEVCGLLGLSHRAVVAPWL

SEQ ID NO: 40865 - protein, 332 aa, Methylococcus capsulatus str. Bath
MKAIVMTRPGEAAEVLELRDLPEPALTAPTQIKVRLRAAGVNPIDTKVRRRGLFYDDALPAVLGCDGAGEVVEAGAEVDRFRIGDRVWFCNGGLGAEQGNYAEYTVLDQRWAAPMPASSAFASAAAGPLVLITAWGALYDRGRLQPGQTVLVHAAAGGVGHVAVQLAKLRGARVIATVGSEDKAALARGWGADETIDYRTQDFVAEVNALTGGRGADLVLDTVGPEVFRRSVECTAHFGDLVTLLDTGATSLAEARMRNLRIGFELMLVPMLRKLDAARDHHVEILRACGEWIDDGKLELYVSGVHPLEEAARVHDIIEAGHTTGKRVLCID

SEQ ID NO: 40866 - protein, 495 aa, Kineococcus radiotolerans SRS30216
MSVEKDTGPGVGVQRDFSHEDGGLHKGLKNRQLQMIAIGGAIGTGLFLGAGGRLVTAGPGLFIVYGVCGFFVFLILRALGELVLHRPSSGSFVSYAREFYGEKAAFVAGWMYWFNWAMTAIVDITAIATYMHFWDTFSAAPQWLLALIALVVVLGLNLVSVKIFGEMEFWFALIKVIALTAFLLIGIVFLAGRFPVEGQPTGLSVISGNGGWFPTGAVPLVVVVSGVVFAYAAVELVGTAAGETENPEKIMPRAINTVILRIVVFYCGSLVLLALLLPHTAYSADESPFVTFFSKIGVPGAGDVMNFVVLTSALSSLNAGLYSTGRIVRSMAQNGSAPKFTAKLNKGGVPFGGIAITGVVAVLGVGLNYVAPGRAFEIVLNASALGIIASWGTIVLCQLRLHAWSKKGIVTRPDYRLFGAPYTGYLVLAFLVAVLGIMAYDEDSRPTVYALGVIVPLLVLGWFAVRKRVLAAAEERMGYTGEFPVKANRPADGGK

SEQ ID NO: 40867 - protein, 397 aa, Vitis vinifera
MSSFTAMSFHLAPFIQFHALLVNLHVAIPLCAFSLFHVINASSLSALCLHLTMNRLSIFSLLLLLLLLPLLISAQCTCESDPEEQSSRTGATRYKLAAIFSILAASLIGVALPTLGKKIPALRPENDVFFAVKAFAAGVILATGFIHVLPDAFESLTSPCLGESPWGSFPFSGFVAMLSAIGTMMMDAFATGFYQRLQRSKAQPVKEDEEMQCENQDQVHGHPHGSGFVSGELGSPELARHRVIAQVLELGIVVHSVIIGISLGASESPKTIKPLVAALSFHQFFEGMGLGGCISQAKFKSKAVAVMVVFFSLTTPVGIAVGMGISNIYDENSPKALVVEGVFNSASAGILIYMALVDLVAADFMSPRMQTNFKLQIAANILLLLGTACMSLLAKWA

SEQ ID NO: 40868 - protein, 673 aa, Fusobacterium nucleatum subsp. vincentii ATCC 49256
MDLLTQVMYLGIAVGILSLLAAFYYAKKVEHYQINIPKVQEITAAIREGAMAFLTAEYKILVVFVIVVAVALGIFISVPTAGAFVLGAITSAIAGNAGMRIATKANGRTAIAAKEGGLAKALNVAFSGGAVMGLTVVGLGMFMLSLILLVSRTVGISVNDVTGFGMGASSIALFARVGGGIYTKAADVGADLVGKVEAGIPEDDPRNPATIADNVGDNVGDVAGMGADLFESYVGSIIATITLAFLLPVDDATPYVAAPLLISAFGIISSIIATLTVKTDDGSKVHSKLEMGTRIAGILTIIASFGIIKYLDLDMGIFYAIVAGLVAGLVIAYFTGVYTDTGRRAVNRVSDAAGTGAATAIIEGLAIGMESTVAPLIVIAIAIIVSFKTGGLYGISIAAVGMLATTGMVVAVDAYGPVADNAGGIAEMSELPAEVRETTDKLDAVGNSTAAVGKGFAIGSAALTALSLFAAYKEAVDKLTSEPLIIDVTDPEVIAGLFIGGMLTFLFSALTMTAVGKAAIEMVEEVRRQFREFPGIMDRTQKPDYKRCVEISTHSSLKQMILPGVLAIIVPVIIGLWSVKALGGLLAGALVTGVLMAIMMANAGGAWDNGKKQIEAGYKGDKKGSDRHKAAVVGDTVGDPFKDTSGPSLNILIKLMSIVSLVLVPLFVSVMNR

SEQ ID NO: 40869 - protein, 705 aa, Coprinopsis cinerea okayama7#130
MSAFLEQYEPLDVIGNGSFGIIRKVRRKSDGLIFARKELNFERMSERDRKQIVAEVNILKDLHHEHIVRYHDRHVDRDAGILYIIMEYCGGGDLSTVIKQAAKHNRPISEDLIWNYFMQILLALHHCHHPNGHGRSGSGSGSALTEGEGGGSSRRPQILHRDLKPDNVFLDENNNVKLGDFGLSKALNQASFANTYVGTPYYMSPELMQEKAYDSKSDIWSLGCLIYELCALKPPFHEAKTHNELSILIRNGRIPPLPRGYSQALFGVIKAMLNLNPAMRPSAAQLLQHERLELVFKVAETEKMLSTVKAHKNAMVAREREVLAREQIIAEKEQHLQHLFSQKDSEIAHLQRVVSQLQAQIHTIQSEPRITQHDLEVATKHAVARREQELRILVQKREEEVAAAMAKREEEIMEAVRRREAEVCEAWAKREAEVRQEVEVSIKAVEERIQWISEKEAELIEEEERLEALREELEVREKRVEELANKKGRTKSPLEEIRNTMEPTPQRRNYDPPPSTIKRNRVDSTPRATTKQMFPAALETPITRPSYTDYLPSAMKGVVLTSTGETLATPSPNELATLFNASPKVGLNFGKIFDFGEGDDDVTSPTNTTTRLSLGGAGSGLNGVGASGVNGGVQFPNGAGSESDEDDAPPSPTTRKERELRERAESRSSLGGGEDATVTIAMNLGFELQLDGDRCSPDEDTTPFD

SEQ ID NO: 40870 - protein, 417 aa, Ehrlichia chaffeensis str. Arkansas
MKRILVKKFGGTSLQDIECINRVAEIIKQDVNNNYKVVVVVSAMGKFTDNIISQIKQISDVKSQSERSEYDLIISSGEQISCGLLSLALQKIGINAQSWLGWQLPIVTTEDHTKARIIDINTCSLQDSLANNDVAIVAGFQGMHKNNRVTTLGRGGSDTSAVAIAAALKVDLCYIYTDVDGIYTADPNVVPKARKLDYITYDEMIEMSSLGAKVLQVRSVEIAMKYNIKLCILSTFNPGKGTILRKKGESDMESQLITGVTCNNKTASITLKEVKAISGVTTVFNAIAEKNINVDMIIQSVNDNNANDITFTISEEDLPTTTKFLTEIQTELMYQDLIINSEVAKVSIIGVGMISHSGVAYKMFDTLTSNNIKILAVTTSEIKISVLISRKDSQLATIALHSTFGLDNTESDLHIIS

SEQ ID NO: 40871 - protein, 310 aa, Xanthobacter autotrophicus Py2
MQELEEPATAAFPPRSRDLSFLRAVIDRRLGLLVPPAASHPAVLHAAMRHILLSPGKRLRPLLTLAAAIQLNASEHAVLDFGCALEMIHASSLIVDDLPCMDDAAMRRAQPTTHVQYGEDVAVLASIGLLSRAFGVAAAAPGVSERARLEAVAILSMAVGSLGLCGGQYDDLRPSPGRSLSATEDVNRRKTGVLFSAAVEIAGHVAAADETQMGHLKALAGHVGRAYQILDDILDASASSASLGKDVGKDAHKATVIASLGAPRARKLLSEHLAGALATSQELGPNTEGQEPLRDFMTAAFGELMGPLAP

SEQ ID NO: 40872 - protein, 437 aa, Xanthobacter autotrophicus Py2
MKLAEWLSATGTKRSAFAKQVGMSPASVTALCNDDRAWISRETAEKIAQATGHEVTPNDFLGLPAPSIRGLAVTDNTQARVQSAIEAFARGEIVVVTDDDDRENEGDLILAASLATPEKMAFVIRNTSGIVCTPLPPSEAKRLRLDPMVSNNDAPMGTAFTISIDVKHGTTTGISAEERTNTVRALANPNMGAADFVRPGHVFPLIAKEGGVLMRSGHTEAAVDLCRLAGVPPVGVIAELVNDDGTVQRGPQVTAFSEKHGLTRISVADLISYRQAREKLVTRAAEFPVPTCVGELQGFSYVTPFDPVNHLALVKGRIGDGEKVLVRLHRADPIADAFGGGKTIQRALERIEAEGRGVLVYLRDGTAGVPAVAMGHGGEKSSSEIERDRHWREVGLGAQILRDLGIVSIRLLASKSRTYVGLAGFGIEIVDTEPLDA

SEQ ID NO: 40873 - protein, 530 aa, Bordetella parapertussis 12822
MRPPRDGKQSSRRHNDIRRQTMDLSDLKKLGLDVAYPFKEQYENYIGGQWVPPVGAEYFDNLSPITGQPFCRVPRSGAADIELALDAAHRARAAWARTSPAERANILLRIADRIEGQLPMLAVAESIDNGKPLRETTAADLPLAIDHFRYFAGCIRAQEGAISEIDANTVAYHFHEPIGVVGQIIPWNFPLLMAAWKLAPALAAGCVVVLKPAEQTPASILVLAELIGDLLPPGVLNVVNGYGKEAGQALATSKRIAKIAFTGSTPVGKHILHAAADNLIPATVELGGKNPNIFFDDVMDHDDEFLDKALEGLAMFALNQGEVCTCPSRILIQESIYERFIEKAIARVQSIKTGHPLDAGTMVGAQVSQVQMDKILSYIDIGRQEGAQCLTGGARNDMLPGGLDQGFYVQPTMLLGKNSMRIFQEEIFGPVAAVATFKDEEEAIAMANDTFYGLGAGVWSRDGARAYRVGRGIEAGRVWTNCYHLYPAHAAFGGYKQSGIGRETHKAALSNYQQTKCLLVSYSAKALGFF

SEQ ID NO: 40874 - protein, 296 aa, Zea mays
  misc_feature (192)..(192): Xaa can be any naturally occurring amino acid
  misc_feature (207)..(207): Xaa can be any naturally occurring amino acid
  misc_feature (220)..(221): Xaa can be any naturally occurring amino acid
  misc_feature (235)..(235): Xaa can be any naturally occurring amino acid
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKXAKGSTVAIFGLGAVXLAAMESARLAGAXXTHPMNFLSEKTLKXGTFFGNYKPRTDLPNVVEMYMKKELELEKFITHSVPFSEINTAFDLMLKGESLRCIMRMED

SEQ ID NO: 40875 - protein, 601 aa, Glycine max
  misc_feature (14)..(14): Xaa can be any naturally occurring amino acid
KHYRPPGKKKEGNXLAKFVIRSQALKQLQISLPLFRKLCILKGVTPREPKKKFKGTHQTYYHVKDVSFLHHEPLVEIHRAIRVHERKIKKAEAKKNLERANRLREKTPKPKIARIIRQRYPRFVDALGELDDCLTMVHLFAALPASESKKIDVECVHKCRRLAHEWQAFVSRTHKLRKTFVSVKGIYYQAEVEGQPITWLTPHSLQQVVSDDVDITTMLNFLQLYEPLLSFVNFRLYHSINLKYPPILDPQLEALAADLYALSRYASANTRPSVLNSEASQAESEQVETKQKEAETGNETSELRLAQLQHQLPSNEPGALMHLVEEVTGEDEEDQDTKDCKKLFKNMKFFVSREVPRESMFFVIPAFGGIVSWEGEGAPFGESDQSISHQIVDREAQGHRFLSREYVQPQWVYDCVNARIILPTDNYLVGRTPPPHLSPFINYDEEGAYIPDYAKTIKHLQAAARKEILPLPGVGKEDLEDPQNLLVEGIIDRAEANDAAQRKQKMMILEQQYRDDLKKELQGVTYTSAGSKETSTGVVQTGESTASVQENVDDDMSKVMMSRKKRKLAEAMKISKKLKEAQTDRIKQRKKKIDEAQRQRS

SEQ ID NO: 40876 - protein, 489 aa, Bacillus pumilus SAFR-032
MSQTLFIDGQWVGAKSGDTRDIINPFNQEVIAKVSEGSRNDAQLAIKAARKAFDQGDWANLPGIERGNMVFKMAELIRRDLDELAKLESLDTGKTLEESKADMDDIANVFQYYAGLADKDGGEIIASPIPNSKSELVREAVGVCGQITPWNYPLLQASWKIAPALAAGNTIVLKPSEITPLTTIKVFKLMEEAGIPSGVANLVLGPGATVGDELAVNDQVDLISFTGGIETGKKIMQGASGNVKKIALELGGKNPNIVFQDADLDVAVDQAMNAVFFHAGQVCSAGSRLLVEESIHDEFLEELVKRTKKIKLGSGFDEETQSGPLISAEHREKVEKYVSIGLDEGAKLETGGKRPDAEELSNGFFYLPTIFSGCTSEMRIVQEEVFGPVLTVESFRTEEEVIELANDTIYGLAGAVWSTDISKAERVARQLRLGTVWINDFHPYFAQAPWGGYKQSGLGRELGRTGLEEYTELKHVYRNTKPEAVHWFQ

SEQ ID NO: 40877 - protein, 544 aa, Cochliobolus heterostrophus
MPPRIKESEHGVPTYWGQSGRMLQVLITIVAVTDFLLFGYDQGVMSGIISAPAFQSAFPQVKGDSTYEGFVVSIYAVGCFLGACFIFIFGDKLGRRKSIFLGAFVMVIGVIIQIACVPPNGGATAQFIVGRCITGVGNGINTSTIPTYQAECCKAKNRGKVICIEGSMVAIGTLIAYWIDYGCLYGPDDFTWRFPIAFQCVFAFVVIIMMTSLPESPRWLLNHHREDEAATVLAGLNGVPRDDPEVLIQMQIIRDAVNASGGGGKVPTKALLTGGKTQHFRRALLGASGQFMQQLSGCNAVIYYFPILCQDALGTSHNLALLLGGVNMVVYAAFASTSFFFVERVGRRKLYLIGTVGQMLAMVLTFACLIDKTVSAPGAAVGLFVYIAFFGVTWLPLPWLYPAEITLLKTRQKANAFSTINNWLWNFFIVMITPVLITSIGWGTYLFFAALNASFIPIIYFFYPETAGRSLEEIDLIFAKGFTEKISYVHAAKQLPKMDEAQIAEAVRQYDISDSDVENRSAAGSLKEKRRQDEELMPQTSGQA

SEQ ID NO: 40878 - protein, 433 aa, Oceanobacillus iheyensis HTE831
MVRKQGNMKWWQLSLVGIGCTIGTGYFLGSSIAIEQSGAAVLWLFLFAAIGTYFVYESLAKLSIEYPDKGSFRTYAKKAFGDWAGFSNGWVYCLSELLIMGSQLIALGIFTRFWFPNLPLWLCMVIFAVLGLAIILTGLAGFEKMENIFGIMKASAIIMFILVAVLLLVKGTESLINPIPHIFSGDLPSIWWGGFIYAFYAFGGIEIMGLVATDLKNKQEALKAGRWMLLGLGSIYIIALGLALAFIDETKIIADESPFITALQPFDIPLIADVFNGVFIIAGFSTMVASLYAIITILVSLSEDHHAPAFLSKKGRLKIPFPAFVCLIVGLFVSIFIALLLPDRIFEYITTAAGLMLLYNWLFILASFMKLQRPTRWNFMKPIIAGVLIIIAVATTLFAEISRIGFFVSIGFIIMIAIAVLMMKEKWHITSSS

SEQ ID NO: 40879 - protein, 328 aa, Physcomitrella patens subsp. patens
MGGSDSEGYDSEELDFDELTEAHGEASAGLKDGTLKFANVDGTFRCPYSPARKKQDYKYREILQHAVGVGAGHRGPVAAGQHRALREYLEKDVAARAQPQAERPLHLQLQQNVPCRVDSEEKRMFYPWMGILQNIDNRTISPTDGSRIGPCAADIKEKLKAFNPRSIKVMHDDGGHLGVVIIGFRSSMDGFKDAVEFENSFNNVRQGRWDFERDSPNGYTGTQLYGWMATEKDVDSKEVLSEHLKLNGDLKTLPEIVWELEHRTQQRTQILKEALTKKDDDLQVTHEENWSLTNRVHNVTALLEQAQLENQKLLEGCTKVKMAVLCSD

SEQ ID NO: 40880 - protein, 378 aa, Zea mays
VDVFCSDGTFARAAVPSGASTVADSDVVLFTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNEFMILPTGAASFKEAMKMGVEVYHHLKAFASRTLEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTLLRIEEELGAIAVYAGAKFRAPVEPY

SEQ ID NO: 40881 - protein, 300 aa, Methylococcus capsulatus str. Bath
MKQQEPLETSFANRIAHVLTEALPYIRRFKGRTIVVKYGGNAMIDDHLKNSFARDVVLLKLVGINPVVVHGGGPQIGNLLQRLGKTSEFVQGMRVTDAETMDVVEMVLGGLVNKEIVNLINRQGGAAVGLSGKDGDLIRARKIRMSQPLSDAPEIIDLGHVGEVASIDPAVVDMLVNGDFIPVIAPIGVGEDGCSYNINADLVAGKMAEVLKAEKLILLTNTQGILGRDGALLTGLSLKEVDALIEDGTISGGMIPKVRCAMDALRGGVNSAHIIDGRIDHAVLLELFTDQGIGTLLLRR

SEQ ID NO: 40882 - protein, 270 aa, Erwinia carotovora subsp. atroseptica SCRI1043
MPISSDTPTRHDSHGRYPDAATVEDFQFNLAAVQMRIAAACHRVGRDPATVRLLPVSKTKPESRLRMAYTAGCRILGENKVQEAYGKWEAMQDLADLQWSVIGHLQTNKAKLVARFASEFQALDSLRLAEALDRRLHVEGRSLDVFVQVNTSGEASKYGLSPEDVPAFIQALPAFSALRVRGLMTLALFSSEAERVRQCFIRLRNLRDRLQQNAPVDIRLDELSMGMSGDFEIAIEEGATVVRVGQAIFGARPLPDSYYWPDETTTEVHL

SEQ ID NO: 40883 - protein, 90 aa, Triticum aestivum
MADASAPAPEGHREEGGRGFGRGRGRGGRGGRRGRGGRGGAPGDKKEWVPCTMLGRLVRDGKLTSLEEILLFSMPINEHDIVDRLLGESL

SEQ ID NO: 40884 - protein, 450 aa, Aspergillus oryzae
MFAARLFKAMPARASAFPSVNASIQSRFMATVRNGRVAHERATFTIRDGPIFHGKSFGARSNISGEAVFTTSLVGYPESLTDPSYRGQILVFTQPLIGNYGVPSAEKDQHGLLKYFESPHLQAAGVVVADVAEQYSHWTAVQSLGEWCAREGVPAISGVDTRAIVTYLREQGSSLARITVGEEYDADQDEAFVDPEQIHLVRQVSTKAPFHVSAADPQCHVAVIDCGVKENILRSLVSRGASITVFPYDYPIHKVAHHFDGVFISNGPGDPTHCQETAYHLRRLMETSQVPIFGICLGHQLLALAIGARTIKLKYGNRAHNIPALDMSTGRCHITSQNHGYAVDASTLPSDWKPYFVNLNDSSNEGMIHKTRPIFSTQFHPEAKGGPLDSSYLFDIYLDSVRKYKASQSAFHPTRDSLPSPLLVDLLAKERVGVQPTIGMQNVAAAAAAA

SEQ ID NO: 40885 - protein, 194 aa, Legionella pneumophila str. Paris
MNNLVEKKESFRFGVSGDIGSFSEEAALLYARKKGLNAHLVHLLDMEGVLNAIENETIELGVFPVVNLLGGLVKPAFQAMGKYSFTPIDEIWHDINQCLLVKSSNQHHKITHIVSHPQGFAQCKKFLRNKFKNAKKIEWIDTAKAAKDLAEGILPPHAAVIASARCAPLYDLKISARNIQDSHLNRTAFILVKK

SEQ ID NO: 40886 - protein, 388 aa, Legionella pneumophila str. Paris
MNHYEKMSLLKDSATVAINSLAQQKIHAGIKIHNLSAGEPKLPPHPSIINAVTQAMEQGHTLYPPIMGIPELRHMGCEWMYRSYDCSFQNEQCLIVNGGKLGIYLLMQLLLQPKDEVIIPSPYWVSYPAMVSLFGGTPVPVETTEAEEWKLTPQALQKACTTKSKILILNNATNPTGALYTQSELIHLLQIAKKHNLLVISDEVYSELTYDGHHYVSCGSLPQFRERVIIIQSCSKNFSMTGWRVGFIFAPEIFIKPLSALVSQSTSGVATLSQWAAVAALQEINQVNIWVQQNMEKRRNCLLRTLHDYLGLTITPPISSLYVFLSLKDIGCKNQNSEEFCKQALDKANVAMVPGIAFGKEGYVRLSFGGNEDDLKSGIYALAQWLHR

SEQ ID NO: 40887 - protein, 132 aa, Candida albicans SC5314
MSGGKGKAGTSEKASTSRSAKAGLTFPVGRVHRLLRKGNYAQRIGSGAPVYLTSVLEYLAAEILELAGNAARDNKKSRIIPRHLQLAIRNDEELNKLLGDVTIAQGGVLPNIHQNLLPKKSGKGGVKASQEL

SEQ ID NO: 40888 - protein, 563 aa, Bordetella parapertussis 12822
MPHSVACLDLRVIALLEAKRAGLLRRAHWLPNIVSGLIVGVVALPLAMAFAIASGAKPEQGLYTAIVAGLLVSLCGGSRVQIAGPTGAFIVILAGITAQHGVAGLQLATLMAGCILLALGAARLGAIIKYIPAPVIVGFTAGIGVIIWVGQWKDFFGLPSPAGTHFHEKLWQLVHSLPQLHLATTALAALSLALLLLNNRLPYLRRVPGPLVALVVATTLQAVLGLDGVATIGSAFGGIPQGLPSWQWPEITVSRVIELIGPAFAIAMLGAIESLLSAVVADGMAGTRHDSNQELVGQGLANIVAPLFGGFAATGAIARTATSIRNGGTSPLAGVVHCITLLLMVLLLAPLAENVPLAALAAILFVVAWNMSDAPHFVRMIKRAPRADVAILLVTFVLTVFADLVVAVNIGVVIAILHFLRRMASSVQVQAQSPAELGDELGHRGYGPLPDDVLVYAVEGPLFFGAAENFERALAATHTDPRTLIIRLRWVPFIDITGLQALEEVITDLQRRGVRVILSGANPRVKAKLHRAGLVGLAGADNVFDRFEDAVLSCRAPAAPATA

SEQ ID NO: 40889 - protein, 413 aa, Arabidopsis thaliana
MGSLSTILRHPDELYPLLKLKLAITKAQKQIPLEPHLAFCYSILHKVSKSFSLVIQQLGTELRNAVCVFYLILRALDTVEDDTSVPVEIKVPILIAFHRHIYDGDWHFSCGTKEYKLLMDQFHHVSAAFLKLEKGYQEAIEDITKRMGAGMAKFICKEVETIDDYDEYCHYAAGLVGLGLSKIFIASELEILTPDWKQISNSTGLFLQKTNIIKDYLEDINERPKSRMFWPREIWGKYVDKLEDFKNEEKATKAVQCLNEMVTNALNHVEDCLKSLASLRDPAIFQSCAIPQIVAIGTLTLCYNNVQVFRGVVRMRRGLIAKVIDRTKTMDDVYGAFYDFSCMLQTKVDNNDPNAMKTLNRLETIKKVCRENGVLHKRKSYVNDETQSKAIFVVMFVLLLAIVVVYLKANQRK

SEQ ID NO: 40890 - protein, 268 aa, Campylobacter upsaliensis RM3195
MCHLPQIPSFHPFFNEALAVMLKAGGKYFRAQLLLNVVYFYKKERFKEALDAALALEFIHTYSLIHDDLPAMDNADFRRSTPTLHKSYDETTAILVGDALNTEAFLLLSRLNLSATISLKLVETLAFNAGLNGMIIGQAIDCYFEDQKLNLKELEFLHTHKTAKLIAASLKMGCQICELDETITKQLYELGLKLGLIFQINDDIIDATLSEKESGKPTNADTHKNSFVNLLGLKEAKECKDKLLKECQFEGLNANFIANLKDLIKEYL

SEQ ID NO: 40891 - protein, 603 aa, Erwinia carotovora subsp. atroseptica SCRI1043
MESSALLTAGVLFLFVAVVAVPIAARLGIGAVLGYLIAGIAIGPWGLGFIRDVEAILHFSELGVVFLMFIIGLELNPGKLWTLRRSIFGVGAAQVGLSALILGGALYLTDFSWQSALIGGVGLAMSSTAMALQLMREKGMNRNESGQLGFSVLLFQDLAVIPALALIPILAGVQGDFGDWERIGLKVAAFLGMLIGGRYLVRPLFRFIAASGVREVFTAAALLLVLGSALFMEALGLSMALGTFIAGILLAESEYRHELEIAIEPFKGLLLGLFFISVGMALNLGILYTHIVKIMIAVLVLVAVKGAVLYFLARINRMRRSERLQFAGVLSQGGEFAFVLFSAAASFNVLKGEQLPLLLVTVTLSMMTTPLLMQVIDRVLARRYNVQDVPDEKPYVEDDEPQVIVVGFGRFGQVISRLLMANKMRITVLERDISAVSLMRSYGYKVYYGDATELELLRSAGADKARSIVITCNAPEDTMEIVHLCQQHFPNLEILARARGRVEAHELLQTGVRHFSRETFSSALELGRKTLVTLGMHPHQAMRAQQHFRRLDMRMLRELMPQLTGDVAQISRVKEARRELEDIFQREMLRERRRPSVWDEDDE

SEQ ID NO: 40892 - protein, 161 aa, Oceanobacillus iheyensis HTE831
MTIYEGNYNGQGKKIAIVTSRFNEFITSKLLSGAEDMLIRHGVARENIDVIWVPGAFEIPYITKRAVHSQKYDGVITLGTVIRGATTHYDYVCNEVSKGVAQVGMNSNIPVLFGVLTTESIEQAVERAGTKAGNKGAETALGLLEMISLNEQFHVESVGMN

SEQ ID NO: 40893 - protein, 179 aa, Streptococcus agalactiae NEM316
MKKENIPNLLTVVRILMIPLFIVLTSVTTSTTWHIVAAIVFAIASLTDYLDGYLARKWQVVTNFGKFADPLADKMLVMSAFIMLVGLDLAPAWVSAIIICRELAVTGLRLLLVETGGTVLAAAMPGKIKTATQMFAVIFLLVHWMTLGNIMLYIALFFTLYSGYDYFKGAGFLFKDTFK

SEQ ID NO: 40894 - protein, 635 aa, Erwinia carotovora subsp. atroseptica SCRI1043
MIVFSSLQIRRGVRVLIDNATATVNPGQKVGLVGKNGCGKSTLLSLLKGEISADGGSATFPQNWSLAWVNQETPALNKPALDYVIDGDREFRQLEAALQTANEENNGNAIATLHGKLDAIQAWTIQARASSLLNGLGFSQPQLQQPVSAFSGGWRMRLNLAQALICRSDLLLLDEPTNHLDLDAVIWLEKWLKNYAGTLVLISHDRDFLDPVVTKILHIEQQSLNEYTGNYSSFERQRATRLAQQQSLYEHQQERVAHLQNYIDRFRAQATKAKQAQSRIKMLERMEMIAPAHVDNPFRFSFRTPESLPNPLMKMEKVSAGYNDNLILESIKLNLVPGSRIGLLGHNGAGKSTLIKLLAGTLAPLKGEIGLAKGVKLGYFAQHQLEFLRADESPLQHLVRLAERETEQQLRDYLGGFGFQGDKVTEITERFSGGEKARLVLALVVWQRPNLLLLDEPTNHLDLDMRQALTEALIDFEGALVVVSHDRHLIRSTTDDLYLVHDQKVEPFDGDLEDYQQWLVGLQRQENAADETPKENVANSAQGRKDQKRREAELRTQTQPLRKQITKLEQQMEKLGETLAALEARLADSAIYDISRKAELTDCLQQQTKVKIELEDTEMSWLDAQEQLEQIMQSE

SEQ ID NO: 40895 - protein, 207 aa, Oceanobacillus iheyensis HTE831
MNELSKIEQAIEDLRNGKLIIVADDADREAEGDLVGLSEFVTPEKVNFMTKYGRGLICVPITEERALELDLHAMATNNTDTYGTQFTVSVDYYTNSTGISTADRADTIRALAEPLSKAADFKRPGHMFPLIAKNAGVLERRGHTEAAVDLARLSNSIPSAYICEILNDDGTMARYPALETLAKDWDLTLITVEDLVQYREKEIAIEN

SEQ ID NO: 40896 - protein, 577 aa, Novosphingobium aromaticivorans DSM 12444
MEPHPGIPFLREALVLLAAAGLAVPLLNRIRVNPILGYLLIGGVIGPYGLGLLAADYPFLSHAVISDIAGVRGLAEIGVVFLLFMIGLELSLERLWSGRALVFGMGSLQILLTAGLIAWIATGLGVEEPTALIVGAALSLSSTAIVMQLLIHGRRQFSAVGKTGFAILLMQDLAVVPILFMVGVIATPGSGGLAAGLAGALGKATLAIVLIYLAGRLLLRPVLRQVAQTRSPEMFTAAVLLTVIGVSALTARFGLSMALGAFLAGLLLAETEYRHQIEVDIEPFKGLLLGLFFMSVGMGIDWRQVLASPLEIAGMVTGLWLLKAVVITGLAIAFGRPRHVAAEAGMLLGQGGEFAFVIVGVAAGLGVVGGVLEQQILIVTGISMLLTPVVAHLARQLSAAMERKRLAAAADTDESFADCEGHIIIAGFGRVGQTLARALDAENVAFVALDADAAMTAGLKDRHLPVFYGDASRSEILAKAGIDHAAAVVVTMNDPEAASRIVHQIHQRWPSMPIHARARDPEHARRLLELGASFCTPETVEASLQLAANVLVGAGVDAEVTRRRITEQRAYETGDSP

SEQ ID NO: 40897 - protein, 108 aa, Zea mays
MRQLEEWYSSALLSQWIHPCVYKLPVSNSFDTRSGIYCSDTIWTEKLYFSSDAAFLGYSLILAILRTLNLRDEASRVMVAAPILAFVTTHILYLNFYELDKGNLGHDR

SEQ ID NO: 40898 - protein, 418 aa, Glycine max
MAASSLLRSALLAPSSCDRPKVYTNASSSNLKSKGLHSSIFGTSIQCDSLVLQNCNGRGIQPIKATATEIPLPTQQSRSTGKTRVGINGFGRIGRLVLRVATFRDDVDVVAINDPFIDAKYMAYMFKYDSTHGPFKGSINILDDSTLEINGKHVKVVSKRDPAEIPWSDFGADYVIESSGVFTTVEKASSHLKAGAKKVVISAPSADAPMFVVGVNEKTYNPKMDIVSNASCTTNCLAPLAKVVNEEFGIVEGLMTTVHATTATQKTVDGPSMKDWRGGRGAAQNIIPSSTGAAKAVGKVLPELNGKLTGMAFRVPTPNVSVVDLTCRLKKNASYEDVKAAIKYASEGPLKGILGYTDEDVVSNDFVGDSRSSIFDAKAGIALSASFVKLVSWYDNEWGYSNRVLDLIEHMALVGAQN

SEQ ID NO: 40899 - protein, 489 aa, Mycobacterium tuberculosis H37Rv
MSAASQRVGAFGEEAGYHKGLKPRQLQMIGIGGAIGTGLFLGAGGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 40900 - protein, 109 aa, Arabidopsis thaliana
MATSTFSSRGAQTMNTMFVKPMLRKSIHKKSASHDIVRDTVKTEGSSSGEEVKTMRGFYGAGETSSPASSWVPHEGTGIYYPKGQEKVMQDVPPPPAGSHADELVNWFS

SEQ ID NO: 40901 - protein, 379 aa, Lactobacillus plantarum WCFS1
MQDEMLGIILAGGQGTRLGKLTKDTAKPAVPFGGRYRIIDFTLSNCANSGVNTVGVITQYQPLELNAHIGSGASWGFDSLNGGVTVLQPYSSSEGEKFFQGTAHAIYQNIEYIDQQDPKYLLVLSGDHIYKMDYDAMLKYHQEKKASLTVGVIHVTNEEAKRFGMMNTDATDRIIEFEEKPEHPKSDKASMGIYIFNWPTLRDYLVKSYATDKSLEDFGKNVIPSYLANNESVYAYAFKGYWRDVGTIKSLWQANMEFLSPHNRLNIGDRYWRIYSKAEVLPPMFLTETSQVNNAMVVDSCYVAGEIDHSILSQRVSVGMGSRVVDSMIMPGATIGKNVVIDHALIGEDAVIGDDAQIIGTTDKIAVVGYHETMGVEQP

SEQ ID NO: 40902 - protein, 390 aa, Lactobacillus plantarum WCFS1
MRREQVSAIINLLEPSDALQPLTAVRPVGMLPFGGRYRLVDFQLSSVINAGIQNVMVTVPRSGRSVADHLRSGRDWSLNTIRGGLFLSPYNDLKLVAPEKKAALLHHYYDNSIQFLKCSQSEYSVVMSTRNVGNIDLKALLRYHEERNSPVTAVYKRVDPASLIPENTILQLTAKGEATAVVPMSKAKISPKTKQVAKSMAIYLMSTVDLIELLQSANQRGDMISLEELMRQAVIQHNANAFEYTGFQANIHDINSYFAANMAVLDEANFRALFYSSRRIYTKVKNEIPTFFATGSQCRDSLCGTGGYIEGQLDHSVIFRDVLINRDSQVKNAIIMQGARIGAGCKLENVIIDKDAVIGPNLVLKGTSTTPLVISKGQHVFQQAEVAVHD

SEQ ID NO: 40903 - protein, 337 aa, Saccharomyces cerevisiae
MSELKTGHAGHNPWASVANSGPISILSYCGSSILMTVTNKFVVNLKDFNMNFVMLFVQSLVCTITLIILRILGYAKFRSLNKTDAKNWFPISFLLVLMIYTSSKALQYLAVPIYTIFKNLTIILIAYGEVLFFGGSVTSMELSSFLLMVLSSVVATWGDQQAVAAKAASLAEGAAGAVASFNPGYFWMFTNCITSALFVLIMRKRIKLTNFKDFDTMFYNNVLALPILLLFSFCVEDWSSVNLTNNFSNDSLTAMIISGVASVGISYCSGWCVRVTSSTTYSMVGALNKLPIALSGLIFFDAPRNFLSILSIFIGFLSGIIYAVAKQKKQQAQPLRK

SEQ ID NO: 40904 - protein, 388 aa, Mycobacterium tuberculosis H37Rv
MTDRVALRAGVPPFYVMDVWLAAAERQRTHGDLVNLSAGQPSAGAPEPVRAAAAAALHLNQLGYSVALGIPELRDAIAADYQRRHGITVEPDAVVITTGSSGGFLLAFLACFDAGDRVAMASPGYPCYRNILSALGCEVVEIPCGPQTRFQPTAQMLAEIDPPLRGVVVASPANPTGTVIPPEELAAIASWCDASDVRLISDEVYHGLVYQGAPQTSCAWQTSRNAVVVNSFSKYYAMTGWRLGWLLVPTVLRRAVDCLTGNFTICPPVLSQIAAVSAFTPEATAEADGNLASYAINRSLLLDGLRRIGIDRLAPTDGAFYVYADVSDFTSDSLAFCSKLLADTGVAIAPGIDFDTARGGSFVRISFAGPSGDIEEALRRIGSWLPSQ

SEQ ID NO: 40905 - protein, 427 aa, Physcomitrella patens subsp. patens
MTVCATSNGVNGGSTPVDTTISPRVAALKPSKTMAIADAATALVESGVPVIRLAAGEPDFDTPKAIVEAGTKAIQEGFTRYTPNAGTLELRKAICHKLQEENGLSYKPDEILVSNGAKQSIMQAVLAVCSPGDEVIVPAPFWVSYPEMARLADATPVIVQTKVSENFILKPEALSAVLTEKSRVLILCSPSNPTGSVYTLEDLQAIAAIVAKHPRLLVISDEIYEHIMYTPATHHSFAALPGMWERTLTVNGFSKCFAMTGWRLGYLAAPKHFLVACNRIQSQSTSGASSISQKAGVAALALGKAGGEDVVTMVKAFRERRDFLVQRLQAMDGVVLAVPQGAFYLFPDFSAYFGSHADGFGFISDAETLCRFFLEKAKVALVPGDAFGNGGCIRISYAASMEELKTAIESIESVMALLKPASAASLA

SEQ ID NO: 40906 - protein, 289 aa, Erwinia carotovora subsp. atroseptica SCRI1043
MSHQHPIIAVTGSSGAGTTTTSLAFRKIFQQFDLRAAQLEGDSFHRYTRPEMDMAIRKARDLGRHISYFGPEANDFSLLEQSFIEYGLHGHGQTRKYLHTYDEAIPYNQVPGTFTPWEPMPEPTDILFYEGLHGGIVTDQNDVAQHVDLLVGVVPIVNLEWIQKLIRDVNERGHSREAVMDSVVRSMEDYITYITPQFSRTHINFQRVPTVDTSNPFAAKSIPSLDESFVVIHFQGLDNIDYPYLLAMLQGSFISHINTLVVPGGKMGLAMELIMAPLVQRLIEGKTIE

SEQ ID NO: 40907 - protein, 458 aa, Bradyrhizobium sp. ORS278
MPTTARVDVQAFLDDHPFSGFQWLIFALGFVIVLLDGFDTAAIGFIAPSLLKEWGIEKSALGPVLSAALFGLAAGALFAGPVADRLGRKLVLVGSVLIFGVACLASAFATNLTELTVLRCVTGVGLGAAMPNAVTLLSEYSPSRLRATMTNLMFCGFPLGAACGGFLAAWMIPQWGWRSVLVLGGVTPLVLTVLLIAILPESVHYLLSRGASVERVRKVMRRISAKAADVGQFVMLEPEHAETTRRVNATGIGMVLSPVLRIGSLMLWVTYFMGLVIFYSLINWMPILFKDVGLNPQTATLISALFPLGGVGAVFFGFLMDRFNANRIVAVGYALTAVTIFLIGQAAGNMGFLVVIVFVAGVVMNTAQSSLPALAASFYPTQGRATGVAWMMGIGRFGGIAGSFLVAELTARHLTFSEIFTVIAVPGLIAALALVVKQVVGPAGRASGKDAGAPVVAH

SEQ ID NO: 40908 - protein, 396 aa, Oceanobacillus iheyensis HTE831
MVYKNLKDEAIELHYKHKGKLEITGKMEINTEDDLSLVYTPGVADVCKQIADDPNKINTLTSRGNMVGIVTDGTAVLGLGNIGPKAAMPVMEGKALLFKKFANIDGFPICLDTTDVDEIVNIVKAMGPTFAGINLEDIAAPRCFEIEKRLKEELDIPVFHDDQHGTAIVVLAALTNALKVVNKQNRPIKIVINGAGAAGIAIAKLLYHAGLTNITLVSLEGVVAKGEDWLNPMQVEMAEVTNKDNVRGTLKDAITEADVFIGVSGPGALKKEHIQTMAKDPIIFALANPIPEIYPEEALEAGAAVVATGRSDYPNQVNNLLAFPGIFRGAIDAGARDITTEMKVAAAYGIADVLSDEEISKDKVIPNALDERAGERVAQAVMSSAIQQKKETSSVS

SEQ ID NO: 40909 - protein, 322 aa, Zea mays
ATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLRDTSGPSLNILIKLMAVESLVFAPFFATQGGLLFKYL

SEQ ID NO: 40910 - protein, 408 aa, Erwinia carotovora subsp. atroseptica SCRI1043
MAAEQKAVTRDTHDKVILPVYAPAKFVPVKGKGSRVWDQDGREYIDFSGGIAVTALGHCHPALVNALRQQGETLWHTSNIFTNEPALRLASKLIDATFADRVFFVNSGAEANEAAFKLARHYAVKRHSPYKTKIIAFYNAFHGRTLFTVSVGGQPKYADGFGPKPADIVHVPFNDLAAVKAVMDDHTCAVVLEPIQGEGGITPATPEFLQGVRDLCDQHKALLVFDEVQSGMGRTGKLFSYMHYGITPDILTTAKALGGGFPISAMLTTEEIASVMTVGVHGTTYGGNPLACAVAEAALDIINTPEVLSGVADRHDRFVSELDKINQQYGVFDQVRGMGLLLGAELKPQWHGRAGEFLAAAAAQGLMVLMAGPNVIRFVPSLIIDEDDIAQGMEKFAKAVAQVVNTAN

SEQ ID NO: 40911 - protein, 616 aa, Arabidopsis thaliana
  misc_feature (583)..(583): Xaa can be any naturally occurring amino acid
MAHSQVAYLIPLKADLKEDNSSPRITLSEGPNIIGRGNVSIVDKRLSRKHITIIVSTSGSASLSVDGTNPVVIRSSGDGERKKVKPSEEVSVCNDDLIELIPGHHFFKLVLLNGRAAKKARKAEDDVEAIRRFCPPNEKLPSTFRLLSVDALPDWANTSCVSINDVIEGDVVAAILSNYMVDIDWLMSACPKLANIPQVMVIHGEGDGRQEYIQRKKPANWILHKPRLPISFGTHHSKAIFLVYPRGVRVVVHTANLIHVDWNNKSQGLWMQDFPWKDDDKDPPKGCGFEGDLIDYLNVLKWPEFTANLPGRGNVKINAAFFKKFDYSDATVRLIASVPGYHTGFNLNKWGHMKLRTILQECIFDREFRRSPLIYQFSSLGSLDEKWLAEFGNSLSSGITEDKTPLGPGDSLIIWPTVEDVRCSLEGYAAGNAIPSPLKNVEKPFLKKYWARWKADHSARGRAMPHIKTFTRYNDQKIAWFLLTSSNLSKAAWGALQKNNSQLMIRSYELGVLFLPSPIKTQGCVFSCTESNPSVMKAKQETKDEVEKRSKLVTMTWQGDRDLPEIISLPVPYQLPPKPYSPXRCSMVMGPRLLEERCVWTSLAKIVDDSFSSSMT

SEQ ID NO: 40912 - protein, 276 aa, Oryza sativa
  misc_feature (126)..(126): Xaa can be any naturally occurring amino acid
MSSTNNSSGEPPPAVRVLGGWASPFTNRVVVALKLKGVEHEMLQETVGKKSELLLRSNPVHKKFPVLLHHSKPLPESLVIVEYIDEVWPASNGGAPAILPRDPHGRAVERFWARYVDDKVRACLAXFFFVSEHFLLVSWRIFALALMIFLQILPGLRVLRGSVAGDKDQTAGEMSTTLQRLEEAFVKCSQGKEYFGGDSIGYLDIALGSFLGWIKAVEKIAGVELLNETKLPILAVWADRFCAHPAVVDVVPDADKLVEFTVQYGSVLNTVNVLPK

SEQ ID NO: 40913 - protein, 175 aa, Ehrlichia chaffeensis str. Arkansas
MPNLLTIFRVFAIPAIVCSFYIGDSNSNYIAFVIFIFACITDFFDGYLARIWQAQSKFGKLFDPIADKLIVVATVIMLVYIRKITGLTIIPVVVIICREILISGLREFLISISVELPVIKLGKVKTFIQMAAIAMLMLNDSVILYIGETILYLAAVLTMYSAYVYICIALKYIYP

SEQ ID NO: 40914 - protein, 400 aa, Rhizobium leguminosarum bv. phaseoli
MAFLADALSRVKPSATIAVSQKARELKAKGRDVIGLGAGEPDFDTPDNIKKAAIDAINRGETKYTPVSGIPELRKAIAAKFKRENGLDYSWEQTIVGTGGKQILFNAFMATLNPGDEVSIPAPYWVSYPEMVALCGGTRFFVSATQEHNFKLQAADLEKAITPKTKWFIFNSPSNPTGAAYTHDELKALTDVLMKNPQVWVLTDDMYEHLTYGDFKFVTPVEVEPQLYDRTLTMNGVSKAYAMTGWRIGYAAGPIQLIKAMDMIQGQQTSGATSIAQWAAVEALNGTQDFIPENKKIFEGRRDLVVSMLNQAKGIVCPVPEGAFYVYPSCKGLIGKTAPSGKVIETDEDFVSELLESEGVAVVHGSAFGLGPNFRISYATSEEQLEEACRRIQRFCGACK

SEQ ID NO: 40915 - protein, 397 aa, Streptomyces virginiae
MSARIGAISESATLAVDAKAKALKAAGRPVIGFGAGEPDFPTPDYIVEAAVEACRNPKYHRYTPAGGLPELKAAIAAKTLRDSGYEVEASQVLVTNGGKQAIYEAFAAILDPGDEVIVPAPYWTTYPESIRLAGGVPVDVVADETTGYRVSVEQLEAARTERTKVVLFVSPSNPTGSVYSEADAKAIGEWAAEHGLWVLTDEIYEHLVYGEAKFTSLPVLVPALRDKCIIVNGVAKTYAMTGWRVGWVIAPQDVIKAATNLQSHATSNVSNVAQVAALAAVSGNLDAVAEMRKAFDRRRQTMVKMLNEIDGVFCPTPEGAFYAYPSVKELLGKEIRGKRPQSSVELAALILDEVEVAVVPGEAFGTPGYLRLSYALGDEDLVEGVSRIQKLLAEAKA

SEQ ID NO: 40916 - protein, 303 aa, Triticum aestivum
  misc_feature (19)..(19): Xaa can be any naturally occurring amino acid
  misc_feature (23)..(23): Xaa can be any naturally occurring amino acid
  misc_feature (83)..(83): Xaa can be any naturally occurring amino acid
WKITQPWVTAGTFLGQDEXGKFXAGKNYNQGRLYKTARKRRPVVSIDFRESPIKAIVGDPRCHICDTSALGQRHVNDRTDLAXYMRTGKLLGCYVGKCSGSIRSIVRHPELPLIASCGLDSYLRIWDTNTRQPLSAVYLKQHLMTVVIDSHFSAEESEETKSKQPDSSMVAEAAVRREKKKKKNVFVEEDEEGTQMVDPDDCDAEAVRKDKKKKKKKKKKKKKTVTEDDEETQMVDPDEGDAETVRKVKKKKKNKRVAEDEEGTQMAGLNDSDAEMYAPKRIKSESGERSKGTKKKSKKQQVA

SEQ ID NO: 40917 - protein, 320 aa, Ostreococcus tauri
MPDDAPPPRVHSKWPGNWTFACQGTIVAGPSPRAAFFTLALIVAPSIVFDVLVCWKTLRVKMGLWTVIVSVALQSCSCFWLLKTSFTDPGILPRLPRESGTSGMRGKTKRATVETTGRETTVKWNDTCGYFQPPRAHHCSVCNDCVERFDHHCPWTGTTIGRRNYRAFLSFTFGTAALCAWTCVGCGYAISYESRGGEATDGLKRSGAAIAVFLIAIIGFLFVGALSCFHAYLVSTNQTTYESFRDAHSWSTNPYNTGSVFKNCLEVWCARIGPPRVRFNVPVSEDQSAARFQAEIEAQTDVERGDVQLTDLTTGSTSKT

SEQ ID NO: 40918 - protein, 310 aa, Zea mays
MTAGQLLRTEPSAQPQRVRHSTPPAALQADIVPSYPPPESDGDESWVWSQIKAEARRDADAEPALASFLYATVLSHASLDRSLAFHLANKLCSSTLLSTLLYDLFVASLAEHPSVRAAAVADLIAARSRDPACAGFAHCLLNYKGFLAVQAHRVAHVLWAQGRRALALALQSRVAEVFAVDIHPAATVGRGILLDHATGVVVGETAVVGDNVSILHHVTLGGTGKAVGDRHPKIGDGVLIGAGATVLGNVRIGAGAKVGAGSVVLIDVPPRSTAVGNPARLIGGKKGEEVMPGESMDHPSFIQQWSDYII

SEQ ID NO: 40919 - protein, 438 aa, Pseudomonas fluorescens Pf-5
MRISIFGLGYVGAVCAGCLSARGHEVVGVDISKDKIDLINAGKSPIVEPGLGELLAQGIQTARLRGTTNFAEAIRDTDLSMICVGTPSKKNGDLELDYIESVCREIGFVLRDKATRHTIVVRSTVLPGTVKNVVIPILEDCSGKKAGVDFGVAVNPEFLRESTAIKDYDFPPMTVIGQFDQASGDVLQALYEELDAPIIRKDIEVAEMIKYTCNVWHATKVTFANEIGNIAKAVGVDGREVMDVVCQDKTLNLSQYYMRPGFAFGGSCLPKDVRALTYRAGSLDIEAPLLNSLMRSNESQVQNAFDIVSSHDKRKVALLGLSFKAGTDDLRESPLVELAEMLIGKGFDLSIYDSNVEYARVHGANKDYIESKIPHVSSLLNSDFDAVIGNSDVIILGNRDEKFRALAEDVPHGKQVIDLVGFMSKATCSKGRTEGICW

SEQ ID NO: 40920 - protein, 396 aa, Bacillus anthracis str. Ames
MIQTKDIIELTDTYGANNYHPLPIVISKAEGVWVEDPEGNRYMDLLSAYSAVNQGHRHPKIINALIDQANRVTLTSRAFHSDQLGPWYEKVAKLTNKEMVLPMNTGAEAVETAIKTARRWAYDVKKVEANRAEIIVCEDNFHGRTMGAVSMSSNEEYKRGFGPMLPGIIVIPYGDLEALKAAITPNTAAFILEPIQGEAGINIPPAGFLKEALEVCKKENVLFVADEIQTGLGRTGKVFACDWDNVTPDMYILGKALGGGVFPISCAAANRDILGVFEPGSHGSTFGGNPLACAVSIAALEVLEEEKLTERSLQLGEKLVGQLKEIDNPMITEVRGKGLFIGIELNEPARPYCEQLKAAGLLCKETHENVIRIAPPLVISEEDLEWAFQKIKAVLS

SEQ ID NO: 40921 - protein, 127 aa, Chlamydomonas reinhardtii
MRKIQTTYWLEPAGSHGVWGLDDYQFLPFIWGAAQLIGHPMIKPKSIHNPDILEAYAGPYLYLGCIKFVKQVKKGPLAETSPMLNDVSCVPTWAKVNSGMIKMYQVEVLSKFPIMQHFFFGSLLPFE

SEQ ID NO: 40922 - protein, 429 aa, Zea mays
MDAKRQGFFSALREEVARGLSPGRARRRSASNAAELQLTRAPALEAGAGAGSGAAAAAAAAGRRNDLRLLLGVMGAPLAPVHVCAAEPLPHLSIKDTPIETSSAQYILQQYLAASGGQRLLSSIRNSYAMGKVRMVATEFEAGGRVVRNRMAAQRAEPGRFVLWQMAPEMWYMELAVGGSKVHAGCNGKLVWRHTPWLGAHSAKGPVRPLRRALQGLDPLTAASMFAGARCIGERKVNGEDCFILKLSADPETLRARSEGLAEIIRHVLFGYFSHKSGLLVHLEDSHLTRIQSATGGDAVYWETTISSSVEDYRAVDGVVVAHAGRSAVTLFRFGEAAVGLGHTKTRMEEAWTIEEVAFDVPGLSADCFIPPTDVGPGSVSEAAELPRGERSKAAAGLVLPCHRARVAALEKADDGGVAWSGALQLGCK

SEQ ID NO: 40923 - protein, 358 aa, Candida albicans SC5314
MSYITPTKRIFTPEDLSKWVGSPTYNTVLDFIVELQSSVTGKSNDSSYETSSIIDKLSKLLSKVDNLITLHPAHDSVSRFGKIEFRDFYSDLSSKAEEYISEITATAIQETSAYFIESWGNSTRIDYGSGHELNFICFLLCLKELGQITSADYEGLVLKVFTQYMSIMRKLQKEYWLEPAGSHGVWGLDDYHFLPFLFGAAQLSTHPHMKPKSIHNDELVEMYSTKYMYFECINFINKIKTIPNHQGKLSLRWHSPMLDDISAAKNWDKIREGMVKMYKVEVLGKLPIMQHFMFGSLLKCPEGIPEHTDENGHGENPEDHCGHAHVNTWGDCCGIKIPSGIAASESLKHERKGNIPFD

SEQ ID NO: 40924 - protein, 354 aa, Bacillus cereus E33L
MEKRIVCLAGDGVGPEVMESAKEVLHMVERLYGHHFHLQDEHFGGVAIDLTGQPLPQRTLAACLASDAVLLGAVGGPRWDGAKERPEKGLLALRKGLGVFANVRPVTVESETAHLSPLKKADEIDFVVVRELTGGIYFSYPKERTDEVATDTLTYHRHEIERIVSYAFQLASKRKKKVTSIDKANVLESSKLWRTVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTEDIGGTETTTSFTKAVMQEMEEQALVGRGR

SEQ ID NO: 40925 - protein, 699 aa, Candida albicans SC5314
MEVTQRTQSQTQPTQQSPTTQTQTQSKEDQNRICQLICSTGQFGNYDLNINDKTIVQGKMTWYFGRDPNSDLQVASSSRISNKHFQIWLNFNDKSLWIKDTSTNGTHLNNSRLVKGSNYLLNQGDEIAVGVGRDEDVVRFVVVFGDKYNPAKLPDSTNTIKDEGIYKDFIVKNETIGQGAFATVKKAIERSTGESYAVKIINRRKALNTGGGSAMAGVDRELSILERLNHPNIVALKAFYEDMDNYYIVMELVPGGDLMDFVAANGAIGEDATQVITKQILEGIAYVHNLGISHRDLKPDNILIMQDDPILVKITDFGLAKFSDNSTFMKTFCGTLAYVAPEVITGKYGSSQMESQQKDNYSSLVDIWSLGCLVYVLLTSHLPFNGKNQQQMFAKIKRGEFHEAPLNSYDISEDGRDFLQCCLQVNPKLRMTAAEALKHKWLQDLYEEDSVKSLSLSQSQSQQSRKIDNGIHIESLSKIDEDVMLRPLDSERNRKSSKQQDFKVPKRVIPLSQHPATPLPMSQPKKRPYQIDPRTNKKVDLEEPSTSKKVKLSDSVVAEDYLKLEPLANSLFQETINISKSPFSFGRNDTCDCEIDDDRLSKLHCVITKENDSIWLLDKSTNSCLVNNTSVGKGNKVLLRGGEILHLFFDPLSSQHIGFKVVLVDQSSGEHKSQVEALKQTSEEMNIIPLISGLSSISS

SEQ ID NO: 40926 - protein, 96 aa, Zea mays
  misc_feature (24)..(24): Xaa can be any naturally occurring amino acid
MASSDGQTEAAAPSVPKNPAMASXRKKKTDDATFLEDLKDHIDEFIHASMDEHKTCFKKTIQKMFGMSKAVAERSAAEAKEAGVESALPLQTSVSQ

SEQ ID NO: 40927 - protein, 315 aa, Geobacillus kaustophilus HTA426
MSDCQHQLKLFALNSNMKLAKEIAEVMGIELGKCSVSRFSDGEIQINIEESIRGDDVFVIQSTSVPVNEHLMELLIMIDALKRASARTINIVMPYYGYARQDRKARSREPITAKLVANLLETAGASRVITLDLHAPQIQGFFDIPIDHLMGVPILADYFKSKQLEDIVVVSPDHGGVTRARKLADRLKAPIAIIDKRRPKPNVAEVMNIVGQVAGKTAILIDDIIDTAGTITLAANALAENGAKEVYACCTHPVLSGPAIERIQNSRIKELVVTNSIALPEEKKIDKIVELSVAPLIAEAISRVYEMKSVSVLFD

SEQ ID NO: 40928 - protein, 238 aa, Triticum aestivum
  misc_feature (233)..(233): Xaa can be any naturally occurring amino acid
RTRGRRRARPGDRVSPPGDWGEWRERGVVAQGDQPASLERVFADQRVPSWREQLTVRAFVASFFLAVMFNIIVMKLNLTIGVIPSLNVSAGLLGFFFVRLWTSAIERMGLLKQPFTRQENTVIQTCVVAAYGIPYSGGFGNYLLAMSGRIASQATEANNPQNIKNPHLGWIIGFLFLVSFIGLFGLVPLRKIMIIDYKLTYPSGTATAYLINGFHTPQGAKIAEKQVKKLGKXLGSQL

SEQ ID NO: 40929 - protein, 297 aa, Oryza sativa Japonica Group
MRRVQLRTHTHARNEIALIPRHTHTRTLGMRLHSYHDTRTHCTGNVQSTTHAHTCPVPLNVHACIPPGKRRKTPVRHSVTNWSSSSSSSSSSSPARSPTAAATPDRRRSPGSPARAGECRDKGGVVEYRVKEREISPRLVVSSAPRAAAKTSRGGGAAIEQSRGGEGILGGVTGGNARPKSQIKAEPELLRREVPLTSGKTKKAPKITFKNEPRHSAPQSDWGTPDSVPEFGPADEYRALRKKYLLLEDENGELDKQLSQAEEEASVLEDEKFALLDQLVVLEGLVDPSQMQPPRRL

SEQ ID NO: 40930 - protein, 378 aa, Zea mays
MGMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGEQLKAMMVDTTILGLDDVRAKEMPYIASMGIYVFSQDVMLQLLREQFPGANDFGSEVIPGATSIGKRVQAYLYDGYWEDIGTIEAFYNANLIILHTKCWTAQLSNLWMCFLWKPPWPGFICVQERVLLQFDALDISTPQASEINSSYVIIHLY

SEQ ID NO: 40931 - protein, 383 aa, Arabidopsis thaliana
MTTLKTSSFSSLPWDLVEDILARVPATSLKRLRSTCKQWNFLFNDQIFTKMHFDKAEKQFLVLILRLYTVCSMSLDLRGLHDNIDPSIEVKGELSLIDPHCSSRKTFVSKVFHCNGLLLCTTMTGLVVWNPCTDQTRWIKTEVPHNRNDKYALGYGNYKSCYNYKIMKFLDLESFDLEIYEVNSNSWRVLGTVTPDFTIPLDAEGVSLRGNSYWIASHKREEIEEEEEEENEYFINDFLISFDFTTERFGPRVSLPFKCESSWDTISLSCVREERLSLFFQDDGTLKMEIWMTNNITETKTTTMSWSPFLKIDLYTYGHRFGNEVSFLVDEENKVIVCCDEEEDDINDTVYIIGENEYWRKEDIVQRSYRPRMFSYVPSLVQI

SEQ ID NO: 40932 - protein, 159 aa, Mycobacterium tuberculosis H37Rv
MNQLPRVGLGTDVHPIEPGRPCWLVGLLFPSADGCAGHSDGDVAVHALCDAVLSAAGLGDIGEVFGVDDPRWQGVSGADMLRHVVVLITQHGYRVGNAVVQVIGNRPKIGWRRLEAQAVLSRLLNAPVSVSATTTDGLGLTGRGEGLAAIATALVVSLR

SEQ ID NO: 40933 - protein, 92 aa, Glycine max
RLPTFPVLAPLPFGFAVFMVHLATIPITGTGINPARSFGAAVIYNKSKPWDDHWIFWVGPFIGAAIAAFYHQFVLRASGSKSLGSFRSAANV

SEQ ID NO: 40934 - protein, 263 aa, Lentisphaera araneosa HTCC2155
MELEIGSFEHRFSGIQRLYGKAGAEAVRKAHVLVVGVGGVGCWAVEALARTGIGQLTLVDWDDVCFSNSNRQLQAMTGMAGKAKVDILKERIALINPECQVHAVRDFYTKDNADDIFTHDFDYVVDAIDSLSPKCHLIAECRKRKIGLVVSGSAGGRLDPSRIEVEDLSRTKYDPLLARVRKKLRNEYGFTRYEKKKFKVEAVYTQELPVLPEACEVGEVEEGESRNLDCRSGYGTATFITGVIGFMMSERAVAGILKKTKEK

SEQ ID NO: 40935 - protein, 377 aa, Neptuniibacter caesariensis
MKKIIAASVIAVAGIGITTWTSGTEPANANNATAPLSSNIAVATFAGGCFWCTEADFEKLDGVLQAVSGYTGGQKANPSYKEVASGQTTHTEAVQVFYNPDVISYEGLLEYLWRGMNPTDGDGQFVDRGKQYRPAVFYHNAAQKAAVEKSLAELSESNIFGKPMATEISPFKVFYDAEDYHQDYHVKNPLRYSYYRNGSGRDQLLNKVWGDQREHDYTQYKNQASIADVASDKFVKPSEYYLKKKLTPLQYKVTQEDGTERPFDNPYWDEKREGIYVDIISGEPLFSSTDKYKSGTGWPSFTQPIQGVSIIEKEDNSLFMKRVEVRSPVADSHLGHVFTDGPAPTGLRYCINSASLRFIPKEELTDKGYGQYLALFK

SEQ ID NO: 40936 - protein, 253 aa, Neptuniibacter caesariensis
MTQFRPCIDLHQGQVKQIVGGSLQDSGAKTNFISQYDAAHYANLYKDHNLQGGHVIALGPGNQEQALLALETWKGGLQFGGGVNADNASSYIEAGASHVIVTSYLFENDQFSWQRLEQIKAEVGADRLILDLSCRKTENGWNIATNRWQTVTETKVDKATLAELSEHCAEFLIHAADVEGLQGGIDKELVGLLGEHCSIPVTYAGGARSLEDLKLVDQLSNGKVDLTIGSALDIFGGSGVTLEECIRWNQGER

SEQ ID NO: 40937 - protein, 174 aa, Cryptococcus neoformans var. neoformans JEC21
MSGPSPTYVTFDTSVGSFTVELYTAHAPKTCNNFAKLAERGYYNGVIFHRIIPNFMIQGGDPTGTGRGGTSIYGDRFADEIHPELRFVGAGILAMANSGPNTNGSQFFITCAPTPYLDGKHTIFGRVSSGMKTIQRLEAVRTDKDDRPVEEIKIHRARLGDATQGGGLAVAMPA

SEQ ID NO: 40938 - protein, 536 aa, Xanthobacter autotrophicus Py2
MSSIPGPRAGDFIAGLCLAGLLLPEAVAYASIAGLPPQHGIFAAVAGCFVYGLAGRSRFAIVSPTSSSAAILAATLATLPDEGAVKLAATTVVVALVGGFLLLAAVARLGNFTGFVSRPVLRGFAFGLAVTIIARQLPHLVGVEAASTDIFHLVPQLVLELPRWNPFAVAAGGMALAVLLALRRFPAIPGAFVVLAGGVAASTVFGLEGHGVSVVGTIDIVPAWPSWPSLGWADYSQLARFALPLVLILFAESWGTIRALSLRHGEAVDADRELAAIGLANMASALAQGMPVGAGFSAGNASEAAGAATRATAFVTALGLAILVIFGGSFVARLPEPVLAAVVIAALVHALDPAPLARLWTLGRDQYVAVAAAVAVLALGVLNGMLVAIALSLTAVVQRLAAPQVAQLGRLGTTHDYVDLARHPDAVAPQGIAIWRPAQPLFFANADRIMGIIAASSRAEPGLHAVVVSLEESFDLDSTALDALVEFDAVMRQAGLRLQLARAHDRVRDLLAAAGARDLVARCSYSVDDAVAAVQP

SEQ ID NO: 40939 - protein, 506 aa, Bdellovibrio bacteriovorus HD100
MRGFVILDFGSQFTQLIARRLREMGFYSEIHSFEYPTEEIRKKNPYGIILSGGPNSVYEAGSPQRNVAELRNISPVMGVCYGMQLLTHQLGGKVTRAEHREYGLNYVTWSSPVQGVPERQKVWMSHGDVVEKAPEGFKIIANSDGHHPAAMQGPGVLAVQFHPEVAHTDHGMDLLKYFAQGMCKAPADWDAPHIKDILIKEAQDKVGPTDHVLVGLSGGVDSTVVATLLTKALGAERVHCVFVDNGLLRKNEYEAVLESYHRIGLNVRGVDASEEFLSALQGKSDPEDKRKTIGRVFIEVFDKSYDHKLPIKWLAQGTLYPDVIESVSSVGGSVTIKSHHNVGGLPEKMKLGLVEPVRELFKDEVRALGAQLGLPKEMLWRHPFPGPGLAIRVLGEVTKEKLQILKEADDVYISELRRRGLYEKIWQAFCVLLPVKTVGVQGDSRTYDHVLALRAVTSSDGMTADWYPFEFQFLREVSNLITNKVKGVNRVVYDVTSKPPGTIEWE

SEQ ID NO: 40940 - protein, 227 aa, Campylobacter jejuni
SGEMGIKSTTGKYDPNPLEPGLHFFLPFVQKITIIDTRVRQINYASIEGSNENLSSGSGVINKNSISVLDSRGLPVSIDVTVQYRLNPLQVPQTIATWSLNWENKIIDPVVRDVVRSVVGKYTAEELPTNRNTIATQIEEGIRKTIEAQPNEPVELRAVQLREIILPSKVKEQIERVQIAKQEAERTKYEVERANQEALKKAALAEGEANATIISAKGKAMAVKMKQ

SEQ ID NO: 40941 - protein, 615 aa, Chlamydomonas reinhardtii
MPGRFWLSDNTFNSSGAGAAALPAEPEKLVFGLPALTWQKAIPLGLMFFCILFNYTTLRNTKDVLVVTAPGAGAEVIPFLKTLDLPMAILFTMTYTALANRLTSDMLFYACLLPFIAFFGVFGFFVYPNKEVLHPTEFCNQLDITLGPRFHAPLALLRTWTYSAFYLVAEMWGSIAGGALTSRSAINLSPYRLPVRPTATTPTRILLPLPLPPPPTPPPRTPRHTPGAALAVVSLLFWGLANSVMTVDEAATFYPLFGMGANLSLIVAGGVTERLSKLRASLPPGVDGWGVALQGLMGLVVLNGIIISILHWGMQKWVVPKVQAQRAALAAAGKGEGGVKDSSRSAKKHKAKMNMMESFKFLASSPYIRDMATMVVSFGVALQLVEVTWKAKLKTAYPDPADYSAFMGKFSETTGIVTLTMMLLGRFVIKKFGWGVAALATPTVILATAIVFLALVMSKNLFAAPLAAMGTTPLMAAVVVGSLQNVFSRASKYSLFDPCKEMAYIPLDDEIKGKGKAAVDVVGNLVGKSGGAVLQQAAIFTFGSLAASTPYLGIGLAIIIINWIRAVLSLEKQFYALKDHKEAVLAKQQEEADAAAGSNDLSESGGAAALKPNPA

SEQ ID NO: 40942 - protein, 169 aa, Bdellovibrio bacteriovorus HD100
MSNRLVNARGMSPVIGEKVFVADNARIISNVEIGDGSSIWYNVVIRGDVMPIRIGKEVNVQDGSVIHGTYEKWGTTLHDRVTIGHLVMLHGCEIGRGTLVGMGSIIMDGCKVGEHCLIGAGTLITEGTEIPPRSLVVGRPGKVKRALTDEEVALLEKSADNYLLYKTWY

SEQ ID NO: 40943 - protein, 748 aa, Bacteroides thetaiotaomicron VPI-5482
MSEVAPLISDLAIILIIAGIVTVIFKWLKQPVILGYIVAGIMAGPSVSLVPTVSDPANIKIWADIGVIFLLFAMGLDFSFKKLINVGITAIVATVTIVCGMMFIGYTAGNAMGFSHMSSIFLGGMLSMSSTAIVFKAFNDMGLLQQKFTGIVLGILVIEDLMAVVMMVVLSTLAVGKHFEGKEMLESILKLAAFLIFWSALGIYLIPTLLKKIRRFTSNEILLITSLGLCLGMVMIATKAGFSAALGAFVMGSLLAETVEAEKIVHIVQPVKDLFASIFFVSVGMMIDPAMMWEYAVPILILTLLVLSGQVLFGSFGVLLSGQPLKIAIQSGFSLTQVGEFAFIIASLGVSLNVTDKYLYPVIVAVSVITTFLTPYMIWLSEPAYRFIDIHMPESLKDYLVHYTSGAMTVKHQGTWHKLIRSMLVSVTLYLVVCVFFITLYFSYVHPLIRKSLPGMEGNLLGFIIIFLVISPFLWAIIMKRNNSTEFRKLWTDNKFNRGPLVSIVLVKILICTIIMMSIITHLFNVALGAGLVVSSIIIAVIYFSKRIKKRSLTIERQFMANFQGTDGNGLSTESDTGSTFGSNIPFKELHLADFTVSPDSIYVGRTLKESSLRTLFQINVISITRGEKRLDIPQGEEHLYPYDKVTVVGTDRQLESFRTSMEQKKVERNGNGTSSQDEMEIGQFPVEGGSPLIGKTIREADISDSIIIGIERSTVNIMNPDPDTIFKENDTVWIVGKRKIIKGLNKD

SEQ ID NO: 40944 - protein, 300 aa, Rhodococcus sp. RHA1
MTESNDLAGRTMVVTGATSGLGLETCRQLARRGATVVLVGRDQDKIDAVIAELSENTDRDRLNSALADLSSLDRARRLSEELLHRFPRIDVLVNNAGIDVGHRQLTVDGVEEMFAVNYLAPFVLATSLAPAMAQASTADAAGYRHPARIVDVSSSGHRGGHLDFDDLDGTKDTFHGQRAYNNSKLALTLFTRELARRSDPARLVVNCADPGFVRGTSLGRGLFGYQVVGTLLTPFASDVAKAADTVVWTATATESGKFTGEYVKGCKVVQPSKDARDAELAARLWDATEALLADRGAARR

SEQ ID NO: 40945 - protein, 199 aa, Pseudomonas fluorescens Pf-5
MNTLSIRNQVDIPLNDSPTPGTFYSFSGLEAAHEHILIKLGPASEHSPLVRIHSECLTGDVFNSQRCDCGPQLSESISRMQEEGGYLIYLRQEGRGIGLYAKLDAYRLQDGGMDTFEANSHLNFPEDGRDFSMAARMLKALGVQHCRLITNNPDKVQALKDNGIIVDSTIPTGVFLTRHNSHYLQAKKDKKHHLIDLIK

SEQ ID NO: 40946 - protein, 180 aa, Arabidopsis thaliana
  misc_feature (35)..(35): Xaa can be any naturally occurring amino acid
  misc_feature (87)..(87): Xaa can be any naturally occurring amino acid
  misc_feature (96)..(96): Xaa can be any naturally occurring amino acid
  misc_feature (101)..(101): Xaa can be any naturally occurring amino acid
  misc_feature (144)..(144): Xaa can be any naturally occurring amino acid
MASSMLSSATMTASPDQATMNTPFDGLKSSDAFHXTRKANNDITSITSNDERVNCMQVWPPIGKKKFETLSYLPDLTDSELPKECDXLIRNKWIPXDEFEXEHGFVYRGHAKSPGYYEGRYWTMRKLHLFGSTDSARVLEEVQXCNNEYHNACIMIIGLDNTRQVQCIMIIAYKPPSFTG

SEQ ID NO: 40947 - protein, 512 aa, Salmonella enterica subsp. enterica serovar Paratyphi B str.
MTNNPPSTRIQPGEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEVIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEEALEIANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 40948 - protein, 249 aa, Bacteroides thetaiotaomicron VPI-5482
MKRIVLLRHGESLWNKENRFTGWTDVDLSEKGVEEACKAGDALREAGFSFEAAYTSYLKRAVKTLNCVLDRLDKDWIPVEKTWRLNEKHYGMLQGLNKSETAVQYGEEQVHIWRRSYDVAPAPVGKDDPRNPGMDIRYAGVPDSELPRTESLKDTIGRVMPYWKCIIFPALMYKDSLLVVAHGNSLRGIIKHLKGISDTDISNLNLPTAVPYVFEFDDRLVLVKDYYLGNPEEIRKRAEAVAKQGMAKK

SEQ ID NO: 40949 - protein, 536 aa, Oryza sativa Indica Group
MDRQEEEDDDAALREAGGGSSDPHDGGGGGECGGWLRRLSRELHWSFVLAVVAVYGACQGVGDAVGGVAAGYYWKDVQRVQPSAAQFYQGFVSAPWVVKPVWGLLTDVVPVAGYRRRPYFLLAGVIGASSMLTLALHRKLGIMPAILALTAQSAGAAVADVTVDALVAQNSITHQPLAADMQSLCGFSSSVGALLGFSISGLLVHSMGSQGALGLLSIPSALVFLAGVLLKERRVTDFDYKQVHRKFYKAIQSMGATLKCAEVWRPCVYMYVSLSLSLDIQAGMFYWYTDPIVGPGFSEEFIGLVYSIGSIGSLLGVLLYQISLKDYPFRGVLFWGQVLSSLAGMLDLIMVTRLNTRVGIPDYVFAVIDNSVSQMVGRLKWLPLLVLCSKLCPPGIEGTFYALLMSIQNAGLLMSGWWGGLMLHLLNVTRTEFSNLWVAVLIRNLSRLLPLMLLFLVPQSDQNSMLLPAEMLQDNESTEARKGGQDTAEFSVLVADDSSCHALSVAVEDERIKVVDAGTGTVELIPLMNELQDRGS

SEQ ID NO: 40950 - protein, 354 aa, Geobacillus stearothermophilus
MKAYLHVASGKTFSGELAAPLEEKVSGEIVFFTGMTGYQEVLTDPSYKNQIIVFTYPLIGNYGINENDFESKRPHVEAVVVYEASREGFHYGAKYSLAEYLQHWNIPLLTHVDTRALVKEIRTAGTMMAELSLSPISAVGGVEAVFPVRAVSTRTIETYGEGGPHLVLVDFGYKKSILQSLLARGCRVTVVPHDTAPEAIDALKPDGLVLSNGPGDPKQLRHQLPAIRQLIDRYPTLAICLGHQLVALATGRIRKKLRFGHRGANQPVWDAVKQNVMMTSQNHSYVVKEGSLVGKPFDIRFINVNDGSVEGIVHRHKPILSVQYHPEAHPGPHDTGYIFDEFLQTVFKGENVYA

SEQ ID NO: 40951 - protein, 147 aa, Zea mays
  misc_feature (18)..(18): Xaa can be any naturally occurring amino acid
  misc_feature (46)..(46): Xaa can be any naturally occurring amino acid
  misc_feature (95)..(95): Xaa can be any naturally occurring amino acid
  misc_feature (107)..(107): Xaa can be any naturally occurring amino acid
  misc_feature (121)..(121): Xaa can be any naturally occurring amino acid
  misc_feature (124)..(124): Xaa can be any naturally occurring amino acid
RSPYKEERSVGSQKICGXQLKGCVQMLCVDQYPIVLMEDPLDQTRXLHYPKMTNAIGEKAQIVGDDLVLTNPTRVTQAITEKSFNALLLKANQIXSATESIDGVKTXRRAPWGVMTSYRSXRLXDTFIADQADWLNTLQINTGAPCT

SEQ ID NO: 40952 - protein, 417 aa, Azospirillum brasilense
MERILGGMSLPDLGTFALVNERLERLSDYPFTRLAALLSGVTPRANAEPIMMSVGEPQHQPPAIIDETLRANAHLWGKYPPVGGTPEFREAVGAWLARRYALPDGLFDAEKSVLPVSGTREALFLLALLAVPPSKAGRQPAVLMPNPFYAPYEGAALLAGAEPVFLPSTRETGFLPDLDALTPELLERTALFYLCTPANPQGAAADAAYLERAIGLARRYGFILAVDECYAEIYLDKPPVGALQLASGLHHGGKPWTNILVFHSLSKRSSAAGLRSGFVAGDPELMSRFTRLRSYSNAGMPLPVLAASAALWRDEAHVEENRALYRAKFDAAEAALNGRYGYYRPDGGFFLWLEVGDGEEATRRLWAEGGIRVLPGAYLTRCNPGEANPGAPFIRIALVNDAETVAHACSTIARILG

SEQ ID NO: 40953 - protein, 328 aa, Oryza sativa Japonica Group
MAASLVHAAAASASPAPAARVGAFHPLASSSPFLRLACATASSPSTRRRRCLDAPLRALSAGSRLAAGWGAPRTRRVIATFAGEESVGSESGDDKEKGKGEMKPEEAQEVWKEMLKQFKDEAQRMHGLTLQAYGVYSQRAREVLLEASEKLKIHADKAQKDLSVIATEVGEEGQEYLKLAAQNSPDSIKDIIETFNSLGKLKISEYEDYHVGIPFGTFLTVGGFLNFMLTGRTSAIRFGIILGFALLAMGISSLRSQRAGGRRPRLLLKGQAAIASVIFFRELLIFFHYGWFPNIFVVLLSGAVTAFYTHRIMTGGHKGPSSESTAEN

SEQ ID NO: 40954 - protein, 155 aa, Oryza sativa Indica Group
MCKVITIQSLVWLRRTVRRWRSRAAARPAGSKMERDGDAVPAGHVAVRVGGGGEDARRFVVRVAHLNHPAFRELLRQAEEEYGFPSGASGPVALPCDEDHFRDVLRRVSSDERHHLAFCRPAATCGVTKRRAESSSSSSSRAPLLQGMAVDSLVW

SEQ ID NO: 40955 - protein, 316 aa, Physcomitrella patens subsp. patens
MSVAQKNGRAALFGYTVAASPGQAWFDVRVIYVRVTECPLDDAPESLTIRFPARSIGTALEVNGARISPSEEVCLVLKRDRVDTDSSEATYLSTDNLRTSGSLKFEVLHKEEVLLCGALEQSQPAADAEEYKGSEAISTPEKTTKLGWTMECACAVGQSGCVFLKGRHDYPSVALAHPVMEVCVVGRFAGTPVILTQTVQILARRRPNRQATLDAIPETEEVTCNQPRFMDVDQPVRGNQPDLFMDHADKAITSFGYALEGSPYGDQDNGQLTWFNAGVRVGVGIGLGMCLGVGIGVGLMIRTYQATTRTFRRGLL

SEQ ID NO: 40956 - protein, 391 aa, Clostridium perfringens ATCC 13124
MASKFYLHKGKNKKAEQGRPWIYIDEINEYDGDYENGDIVEVYNHKGYFLGKGYINDRSKITIRIMTKDIDEEIDEDFFKRRFKTAWEYRKKVIDTSSCRFIFGEADFLPGLTVDKFEDYYVIQISTLGMDKYRDLIVKILVEEYGAKGVYERSDIKTREIEGLEQRKGFLTEPFDTDIQIVENGVKYIVDLENGQKTGFFLDQKENRAAMHRICKGMDVLDCFTHTGSFALNAGIAGAKSVLGIDVSQHAVDCATRNAELNNLQDRVKFEKHNAFDVLGDWSREGKQFGVVILDPPAFTKSRNTVKQAIRGYKEINLRGIKMVKEGGYFATCSCSHYMDEEQLKKTVAEAAHDARRTLRQIEVRTQSADHPILWNSDESYYLKFFIFQVF

SEQ ID NO: 40957 - protein, 662 aa, Arabidopsis thaliana
MASSVFLSSFSSSSSLQLCSSFHGEYLAPSRCFLGAPVTSSSLSLSGKKNSYSPRQFHVSAKKVSGLEEAIRIRKMRELETKSKVRRNPPLRRGRVSPRLLVPDHIPRPPYVESGVLPDISSEFQIPGPEGIAKMRAACELAARVLNYAGTLVKPSVTTNEIDKAVHDMIIEAGAYPSPLGYGGFPKSVCTSVNECMCHGIPDSRQLQSGDIINIDVTVYLDTLSLCLISTYNLKHRQGYHGDTSRTFFCGEVDEGFKRLVKVTEECLERGIAVCKDGASFKKIGKRISEHAEKFGYNVVERFVGHGVGPVFHSEPLIYHYRNDEPGLMVEGQTFTIEPILTIGTTECVTWPDNWTTLTADGGVAAQFEHTILITRTVILDEARDPLSHIYAHGSSSFIITIKMHSKSMIMASSAAASISMITLRNLSRNHQSHQSTFLGFSRSFHNQRISSNSPGLSTRARSTTSSTGGFFRTICSSSSNDYSRPTKIQELNVYEFNEGDRNSPAVLKLGKKPDQLCLGDLVPFTNKLYTGDLTKRIGITAGLCVLIQHVPEKKGDRFEASYSFYFGDYGHISVQGPYLTYEDTFLAITGGSGVFEGAYGQVKLRQLVYPTKLFYTFYLKGVAADLPVELTGKHVEPSKEVKPAAEAQATQPGATIANFTN

SEQ ID NO: 40958 - protein, 199 aa, Glycine max
CENPEQGAEFAKILDDSGDVIVLGNAVFLRPEQVAKSIESLIYQSIANPNDPRRRELELMEKQKWMIDEKAKAQVRAELYFGLGFLTVQTLGFMRLTFWELSWDVMEPICFFVTSFGFALAYLFFLKTSTEPTFQGFFHHRFKAKQERLMKTHNFDMSRYNELFKACYTNYHGGAKFESSYPFHYLGETHLTDLRALHR

SEQ ID NO: 40959 - protein, 151 aa, Zea mays
MTEETKENQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDI

SEQ ID NO: 40960 - protein, 550 aa, Rhodococcus sp. RHA1
MSSDITGTAAWQKLRDHHAQIQSVHLRELFEKDPARGQELTVTAGDLYIDYSKHRIDRDTLGLLLELARSADLEARRDAMFAGEHINTSEDRAVLHTALRLPADASLVVDGQDVVADVHEVLDRMGDFTDRVRSGEWRGATGERIKTVVNIGIGGSDLGPVMVYRALRHYADAGISVRFISNVDPADLVRSLQGLDPATTLFIVASKTFSTLETLTNATAARRWLLGGLGLGNEAVAKHFVAVSTHADRVAEFGIDTANMFGFWDWVGGRYSVDSAIGLSVMAAIGKERFAEFLAGFHAVDEHFRTAPLEENAPVLLGLIGLWYSNFFGAESRAVLPYSNDLVRFAAYLQQLTMESNGKSVRADGTPVPTSTGEIFWGEPGTNGQHAFYQLLHQGTRLVPSDFIGFGEPTDDLPTADGTGSMHDLLMSNFFAQTKVLAFGKTAEEIAAEGTPEHLVPHKVMPGNRPSTTILAPKLTPSVIGQLIALYEHQVFVEGVVWGIDSFDQWGVELGKTQAVELQPVLTAAEEPAAQSDSSTDSLVRWYRRQRGRA

SEQ ID NO: 40961 - protein, 488 aa, Rhodococcus sp. RHA1
MMDVMDAVELMRTVPTTLFLGGEKRDAENGATFTVFDPATGDALTEVADASPADAMKALDAAVAVQREWAATPARERGELLRAVFEKITARADDFALLMTLEMGKALPESAAEVKYGAEFFRWFSEEAVRIAGRYTPAPAGNGRILVTKQPVGPCLAITPWNFPLAMGTRKIGPALAAGCTMIVKPASETPLTMLLLAEVMADAGLPKGVLSVLPTSKSGEVTGPLLDDPRLRKLTFTGSTGVGRMLVEKSAKGLLRTSMELGGNAPFVVFDDADVDKAVAGAVLAKMRNGGEACTAANRFHVANSVREEFTAKLVDKLSSYTLGPGTDPGTTLGPLINADQLEKVGELVQDAVGAGARVRLGGVAPEGPGYFYPATVLDEIPAQARILKEEVFGPVVAIAGFDTEEEGIAAANDTEFGLASYIFTRDLDRALRVADALESGMVGINRGVISDTAAPFGGVKASGFGREGGSEGIEEYLETKYVALEP

SEQ ID NO: 40962 - protein, 484 aa, Novosphingobium aromaticivorans DSM 12444
MAKLDPRGRKVKILATVGPASRDPEMLEKLFRAGADAFRVNMSHGEHAIHAETIANIRALEKKVNRPITILCDLQGPKLRVGKFKDGRAVIRHSGHFTLDRNPEPGDETRVCLPHPELFGVLHKGQRLLIDDGKLRLRVIRADENEILCSAEVGGVISDRKGVNVPDAVVPVPALTDKDRRDLSFAVEQGADWIALSFVQRPEDVAEARRLLGGHGSLMAKIEKPAAISRLEEIVELSDGIMVARGDLGVELNPEEVPPLQKRIVETARRQGKPVVVATQMLESMIEAPTPTRAEVSDVANAVYDGADAVMLSAETAAGAWPEEAVTIMHRIAAQVEADPGYGARVHFLETLPDPTTADALAQAAASITETLPISGIIVFTGSGSTARRVARERPGVPMLVLTPSHKTARKVGLLWGAHAVSTKDIGSFEEMIAKGKRMALRHGFGSAGSKLVALAGVPFGTPGATNLLHVVTLTGDELTRHGE

SEQ ID NO: 40963 - protein, 111 aa, Glycine max
MDPQLWHKVAAISGVAALGLGTYGAHVFKPQNPAYNDVWHTASLYHLVHTAALVAAPITKHPNVFGGLLTAGILAFSGTCYTVAFLEDRKYSTMAPFGGFAFIAAWGSLFF

SEQ ID NO: 40964 - protein, 191 aa, Novosphingobium aromaticivorans DSM 12444
MTLVAVSKTKPAEAILDLVAQGQRVFGENRVQEAQAKWPAIRAAHPDISLHLIGQLQSNKAEDAIALFDCIHSLDRPSLVAALAKAQDKLGKRVPCFVQVNIGAEEQKGGCAVADLPALLADAREKGIDVVGLMCVPPAGIEAAPFFALLDKLADDNGLSGLSMGMSDDLETAVQLGATHVRVGSALFGER

SEQ ID NO: 40965 - protein, 329 aa, Chlamydomonas reinhardtii
AAAGRGKISAMSAEVVDSNPYSRLMALQRMGIVKEYQRIRDKTVAVVGVGGVGSVAAEMLTRCGVGRLLIYDYDKVELANMNRLFFRPEHCGMTKTDAAKKTLQEINPDVEIESYTMNITTLQGFDAFKSSLLRADDPSGTSAPSSRVDLVLSCVDNYEARITINQVCLELQQTWMESGVSEDAVAGHIQLLVPGETACFQCVPPLVVASGIDERTLKREGVCAASLPTTMGIVAGMLVQAALKYMLDFGTVSKYLGYNSLKDFFPTMEIKPSAACVNGLCRQRQDEARRNSPEALAARAAEAAAAAAEAAAAAALPLHEENEWGIEVV

SEQ ID NO: 40966 - protein, 456 aa, Burkholderia thailandensis E264
MTAVDAYRREAHMQDIDDFLRQHRITEVEAIIPDMAGIARGKIIPRNKFETGESMRLPQAVMVQTVTGDYPEDGALTGVTDPDMVCVADASTICLIPWAVDPTAQVIHDCVHFDGSPVEISPRYVLRRVLDLYRAKGWKPVVAPELEFYLVDMNKDPDLPLRPPVGRTGRAETGRQSYSIEAVNEFDPLFEDIYEYCELQGLDIDTLIHEVGAAQMEINFLHGDALSLADQVFLFKRTVREAALRHNMYATFMAKPMENEPGSAMHIHQSVVDIETGRNLFIGASGDVTPMFRGYLAGLQKYTPALMPIFAPYINSYRRLSRFMAAPINVQWGYDNRTVGFRIPHSAAAARRIENRIPGVDCNPYLAIAATLAAGYLGVTQALEPTEPLASDGYSLPYQLPRNLEEGLTLMSACAPLAEMLGEKFVKAYLALKETEYEAFFRVISSWERKHLLLHV

SEQ ID NO: 40967 - protein, 389 aa, Rhodococcus sp. RHA1
MDLFEYQAKELFAKHEVPTSAGRVTDTVAGAREIAEEIGKPVMVKAQVKVGGRGKAGGVKYSADADAAQANAEAILGLDIKGHVVKKLLVAEASDIAEEYYISFLLDRTNRTYLAMCSVEGGVEIEVTAEENPDALAKIPVDAVKGVDLAFARSIAEAGKLPAEVLDAAAVTIQKLWEVFINEDALLVEVNPLVRTPDDQILALDGKVTLDENAAFRQPGHEAFEDKDATDPLELKAKENDLNYVKLDGEVGIIGNGAGLVMSTLDVVAYAGEKHGGVKPANFLDIGGGASAEVMANGLDVILNDAQVKSVFVNVFGGITACDAVANGIVGALKTLGDEANKPLVVRLDGNNVEEGRRILAEAAHPLVTVVGTMDEAADKAAELAFAAK

SEQ ID NO: 40968 - protein, 495 aa, Bdellovibrio bacteriovorus HD100
MLADRRAKIVATIGPATRDEKNLEKAIKAGMNVARLNFSHGSHEDHLKVVHSLRKLSKELQAPVAILQDLQGPKIRVGKFENGSIEIKPGEKLVVTTAKVLGKPGLVPSDFQELPLACVPGTRILLDDGLMEVKVLQVRGEEIDVEVVYGGILKDRKGMNLPGVNLPVDCMTPKDLEDLQFGIANKVDYIALSFVRHARDIRKLRELIEAGNSNAKIVAKIEMVEAIENLEEICRLSDAVMVARGDLAVEVGQSRLPGYQKRIISVCNQLGKPVITATQMLDSMVENPRPTRAEITDVANAVLDGTDALMLSAESASGKYPFKCIRTMHEIITEVERNEEEYYKISLENEFLSTPASIAASASLSALKLNATAIICLTTSGKTANIISAFRPKARIISVTQHLDVLNGMELGWGIQTHAIKPYKTMEDILREVDLLLVSHGLGKTGDRVILTLGQPIACGAKTNSIYVHTVGGENVAKLPNDKLPLRCQEEPVVE

SEQ ID NO: 40969 - protein, 279 aa, Glycine max
MGSNQAAISFLTNVARAAFGLGAAATALSSSLYTVDGGQRAVLFDRFRGILDSTVGEGTHFLVPWVQKPYIFDIRTRPHTFSSVSGTKDLQMVNLTLRVLSRPDTEKLPTIVQNLGLEYDEKVLPSIGNEVLKAVVAQFNADQLLTDRSQVSALVRESLIRRARDFNIVLDDVAITHLSYGGEFSRAVEQKQVAQQEAERSKFVVMKAEQERRAAIIRAEGESDAAKLISDATASAGMGLIELRRIEASREVAATLAKSPNVSYLPGGQNLLMALGPSR

SEQ ID NO: 40970 - protein, 171 aa, Geobacter metallireducens GS-15
MDELKNIIRDIPDFPKKGIVFKDITTLLADAKSFQRMVDLLAHRYVGEKIDKVVGVEARGFILGAALAYKLGAGVVLVRKPGKLPSETFSKTYQLEYGTDSLEIHTDAIRKGEKVLIADDVLATGGTMSAVVEMVRDLGGEIVECCFLAELDFLGGRKKLPDGKVFSLLTF

SEQ ID NO: 40971 - protein, 178 aa, Yarrowia lipolytica CLIB122
TTTIMSYQRRIMKELERLKTAPPNCEYHYGRSPTLLRLSYCTCTNPAHITLVEANDLETWQIDLEVNNDNPLYTGKTFRLQFIIGPNYPVESPQVQFMPLPARPIPIHPHIYSNGHICLDILGDEWTPVQTVASVCISLQSMLGSNDRDERPPDDERYIKHAPKNPKQTRFVYHDDTV

SEQ ID NO: 40972 - protein, 570 aa, Marinobacter sp. ELB17
MPGDPSAGHFAKDAIMQGHASTPAATKAWQALLHHQQRLTTKPMAQLFAEDSQRASRYLLEAAGLTLDFSKNRLDDGALADLMALAEECQLASRRQALYAGEPVNNTENRPALHTALRASAGQTIQVNGKNVIEEVHATLEQMQQFVNAVTGGERRGCTGERFTDVVSIGIGGSFLGPKLATEALTPYHHGGIRCHYAANIDGTEICEILRQISPHTTLFLVQSKSFKTPETLENAKVAREWLVQHCPQTDAVARHFAAVSANVDAAQAFGIEADSLFPMWEWVGGRYSLWSAIGLPVALSIGMDNFRQLLAGAEAMDEHFMQAPLAQNMPVVMAMLGVWYNNLWGACSHAILPYDQYLRSLPDHLQQLDMESNGKRVTRAGVAVTYHTGPIIWGGLGANGQHAYHQLIHQGTRLIPADFIIPLVSHNPIANHHADLFANCLSQSQAMMAGKTLEQARRELIAEGRSAQDVDRLASHKVVPGNQPSNTLVMQQLTPCTLGAMMALYEHRTFVQGVIWDLDSFDQWGVELGKQLGQNILPRLLGQPAPANEGNSDSSTDALIARFRAANGA

SEQ ID NO: 40973 - protein, 687 aa, Glycine max
MTTSFGPATTSAPLKDHKVQIPSFHGLRSSSASALPRNALSLPSSTRSLSLIRAVSTPAQSETATVKRSKVEIFKEQSNFIRYPLNEDILTDAPNISEAATQLIKFHGSYQQYNREERGSRSYSFMIRTKNPCGKVSNQLYLTMDDLADQFGIGTLRLTTRQTFQLHGVLKKDLKTVMGTIIRNMGSTLGACGDLNRNVLAPAAPLARKDYLFAQQTAENIAALLAPQSGFYYDIWVDGEKILTSEPPEVVQARNDNSHGTNFPDSPEPIYGTQFLPRKFKIAVTVPTDNSVDILTNDIGVVVVTDDDGEPQGFNIYVGGGMGRTHRLETTFPRLAEPIGYVPKEDILYAVKAIVVTQRENGRRDDRKYSRLKYLISSWGIEKFRSVVEQYYGKKFEPFRALPEWEFKSYLGWHEQGDGKLFYGLHVDNGRIGGNMKKTLREVIEKYNLNVRITPNQNIILTDVRAAWKRPITTTLAQAGLLQPRFVDPLNITAMACPAFPLCPLAITEAERGIPNILKRIRDVFDKVGLKYSESVVVRITGCPNGCARPYMAELGLVGDGPNSYQIWLGGNHKQTSLARSFMDRVKILDLEKVLEPLFYYWKQKRQSKESFGDFTNRMGFEKLKEYIEKWEGPVVAPSRHNLKLFADKETYESMDALAKLQNKTAHQLAMEVIRNYVASNQNGKGE

SEQ ID NO: 40974 - protein, 600 aa, Saccharomyces cerevisiae
MINDKLVHFLIQNYDDILRAPLSGQLKDVYSLYISGGYDDEMQKLRNDKDEVLQFEQFWNDLQDIIFATPQSIQFDQNLLVADRPEKIVYLDVFSLKILYNKFHAFYYTLKSSSSSCEEKVSSLTTKPEADSEKDQLLGRLLGVLNWDVNVSNQGLPREQLSNRLQNLLREKPSSFQLAKERAKYTTEVIEYIPICSDYSHASLLSTSVYIVNNKIVSLQWSKISACQENHPGLIECIQSKIHFIPNIKPQTDISLGDCSYLDTCHKLNTCRYIHYLQYIPSCLQERADRETASENKRIRSNVSIPFYTLGNCSAHCIKKALPAQWIRCDVRKFDFRVLGKFSVVIADPAWNIHMNLPYGTCNDIELLGLPLHELQDEGIIFLWVTGRAIELGKESLNNWGYNVINEVSWIKTNQLGRTIVTGRTGHWLNHSKEHLLVGLKGNPKWINKHIDVDLIVSMTRETSRKPDELYGIAERLAGTHARKLEIFGRDHNTRPGWFTIGNQLTGNCIYEMDVERKYQEFMKSKTGTSHTGTKKIDKKQPSKLQQQHQQQYWNNMDMGSGKYYAEAKQNPMNQKHTPFESKQQQKQQFQTLNNLYFAQ

SEQ ID NO: 40975 - protein, 561 aa, Plasmid pSB102
MTTLKITGMTCDSCATHVKEALEKVPGVQSAVVSYAKGAAQLDLDPGTASDALTAAVAGLGYKATFADTLSTDNRAGLLDKVRGWMGTADKGSDGERQLQVAVIGSGGAAMAAALKAVEQGAKVTLIERGTIGGTCVNIGCVPSKIMIRAAHIAHLRRESPFDDGIAATVPAINRSKLLAQQQARVDELRHAKYEGILDGNPAITVLHGEARFKDDQSLTVRLNDGGERVVVFDRCLVATGASPAIPPITGLKGTPYWTSTEALVSDTIPERLAVIGSSVVALELAQAFARLGSQVTILARSTLFFREDPAIGEAVTAAFRAEGIKVLEHTQASQVAYADGEFVLTTGHGEVRADKLLVATGRTPNTRSLALEAAGVAVNAQGAIVIDKGMRTSTPHIYAAGDCTDQPQFVYVAAAAGTRAAINMTGGDATLNLTAMPAVVFTDPQVATVGYSEAEAHHDGIETDSRLLTLDNVPRALANFDTRGFIKLVIEEGSGRLIGVQAVAPEAGELIQTAVLAIRNRMTVQELADQLFPYLTMVEGLKLAAQTFTKDVKQLSCCAG

SEQ ID NO: 40976 - protein, 520 aa, Chlamydomonas reinhardtii
MADLEGALSFKPSPSVPLYKDLGAVYKGVPGVEERYKQITEAFKKAYGAAPDFYARAPGRVNLIGEHIDYEGYGVLPMAIRQDTVVAVRRVPGSTELVIGNRHRPALNCTAPRCPRYCYRHGTQTVDVANHSWANYFVSAYKGAFELLRATRPDDVPAPCGLEVVVHGQVPTGSGLSSSAAIVCSSMLAILSAKGVAPEQLDKAAVAEAACKAERYVGVTSGGMDQAISMMGQQGVAMHVEFNPVRGVCVVLPPGATFVIANSLAVSNKAETAPKRYNLRVVECRLAAVLLAMSLGMSREDALAKVRTLRDVEPLIAEQHSGAHDGATCAAAVAQHLKESYSLAELEEALGGKLADILFAAEPGSVRALQVTYAFPLRKRAVHVYTEAQRVLDFRAVCEDASLPPGERLAKLGRLMSDSHASCAELYGCSCTELDELVGIAKEAGALGARLTGAGWGGCMVSLVRDEQVDAFVAAMSEKYYKPRVESGSLSAAELPEVLFATQAANGAALLVPQVELVPA

SEQ ID NO: 40977 - protein, 476 aa, Desulfovibrio desulfuricans G20
MKASKKPVRPRVPMPVQPPEERIRNFDEVATGYTLEMAAEEAARCLQCKKPKCVKGCPVEVPIPQFIAHLAAGDIDAAYRTLKSTNSLPAVCGRVCPQEVQCEGECILTAKGQPVAIGRLERFVADEYMHRDACGLISGKPECPLIDPHKKVACIGSGPASLTAAGYLAARGCKVTVFEALHELGGVLVYGIPEFRLPKEKIVAKEVNALRELEVDFVRNRVGGKTFSIGELFAQGYRAVFIGVGAGLPRFLGIPGENLNGVFSANEYLTRVNLGRAYSFPDYDTPIIRGRRVTVFGGGNVAMDAARTALRLGADSVHIVYRRTVAEMPARHEEVEHAMEEGVKMQELCAPIAFVPDAEGCLSGVRLQQMQLGEPDQSGRRRPVPVEGSELLLPTDLAVIAVGTRSNPVLLEAEPELDLNRWGYISINSDTGETSIPDVFAGGDIVTGAATVILAMGAGRTAAKEIARRLGCQPDD

SEQ ID NO: 40978 - protein, 498 aa, Acinetobacter sp. SE19
MGGIPHIPFCLTSVICQGCLIMNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 40979 - protein, 579 aa, Shewanella oneidensis MR-1
MRPVRQLRPLILAIAMALPLLSSPALYADEPSIFSQMATAQPVWAKHGMVASQEMLASRTGVEILKQGGNAIDAAVAVAFSLAVTLPRAGNIGGGGFMLVHLAKENKTIAIDYREMAPSKAKKDIFLDEKGDAVAKLSREHGLAVGVPGTVMGMSLALEKYGTMTMAQVTAPAIKMAQEGISVSPDLAVSLAGLKRRMSQWPSTAAIFYKADGSDYQVNDMLKQPELAHSLQLIAQKGTKGFYEGETAAKLVEAVQKAGGIMTLEDLKHYKAVEREPVRGQYRGYEVVSMPPPSSGGVHIIEMLNVLQQFPIDKFGHNTAQTIHVMAETMKHAYADRSEYLGDPDYYNVPLKQLTDKDYAQKIASQIALNKTTPSEEIKPGNLAPYESDQTTHFSVVDRWGNAVSNTYTLNFSYGSGLVAKGTGILLNNEMDDFSAKPGSPNGYGLVGGEANSVEGNKRPLSSMSPTIVMKDGKPFLVTGSPGGSRIITTTLQIIMNVIDHGLNIAEASNAARVHHQWLPDELRVETSLNRDTISLLEAKGHKVNVQSAMGSTQSIMVTEQGIFGASDLRHSGSEAVGY

SEQ ID NO: 40980 - protein, 395 aa, Gossypium arboreum
MASASLLKTSPVLDKSEWVKGHTLRQPSTSVVRCHPVAPSGLTVRASSYADELVKTAKAIASPGRGILAMDESNATCGKRLASIGLENTEANRQAYRTLLVSAPGLGQYISGAILFEETLYQTTIDGKKMVDVLVEQNIVPGIKVDKGLVPLAGSNNESWCQGLDGLAPRSAAYYQQGARFAKWRTVVSIPNGPTELAVKEAAWGLARYAAISQDNGLVPIVEPEILLDGDHGIDRTFEVAKKVWAEVFFYLAQNNVMFQGILLKPSMVTPGAECKDRATPQQVADYTPQLSQRIPQLSLESCFLSGGQSEVEATLNLNAMNQAPNPWHVSFSYARALQNTCLKKWGGRPENVKDAQEALLIRAKANSLAQLGKYTGEGESEEAKQGMFVKGYVY

SEQ ID NO: 40981 - protein, 439 aa, Glycine max
MRVLQLGLFLALASGFAAISIYITGLSDPFIPVITSQMKTPKHCFPCTTLSRSTANGLGLKATRGTDYCQTTINFPSDTIPKWKDPKTGELEALSFDFNLCEAVATWEQVRNSTTILTKEFIDSLPNGWEEYAWRRINKGIQLNRCENKTLCMEKLSLVLPETPPYFPRQFGRCAVIGNSGDLLKTKFGNEIDGYEVVIRENGAPTQNYTDYVGRKSTFRLLNRGSAKALDKVVELDEQRKEVLIIKTTIHDIMNKMIREVPIKNPVYLMLGASFGSAAKGTGLKALEFALSMCDSVDMYGFTVDPGYKEWTRYFSESRQGHTPLHGRAYYQMMECLGLIKIHSPMRADLNRVVKWVPSRHIIRSARIASEKLLRRVGAGSEDPLAACSIIKKQVKRNLNAVSKLRKAALDHLRYVKRTTMYPLEHSPGHGSLCTVPTD

SEQ ID NO: 40982 - protein, 450 aa, Geobacter metallireducens GS-15
MKICVIGSGYVGLVAGTCFAESGNTVICVDVNQEKIEGLKQGILPIYEPGLKELVLRNSAEGRLSFTTDLASAVKESLICFIAVGTPPGEDGSADLQHVLAVAREIGRNMEGFKIIVDKSTVPVGTADKVRRAAQEELDRRGAAYEFDVVSNPEFLKEGAAIDDFMKPDRVVIGADNVRTAEIMKELYSPFMRKTNRLIVMDVHSAEMTKYAANAMLATRISFMNQIANLCERMGADVSAVREGIGSDSRIGYDFLFPGVGYGGSCFPKDVKALIKTAEECEYDFVLLKSVEEVNERQKAILIDKMIAHFSRDNGASPLAGKTIAIWGLSFKPRTDDMREAPSIVIISKLLEMGATVLAHDPEAVKEAKKIFGDRITYTSTNQYEILKGADALAIITEWNEYRNPDFERISASLTAPVIFDGRNLYNPRRMKEIGFTYHSIGRNGSAFTG

SEQ ID NO: 40983 - protein, 532 aa, Oryza sativa Japonica Group
MASSASTLEIEARDVVKIVLQFCKENSLQQTFQTLQNECQVSLNTVDSIDTFIADINAGRWDAVLPQVAQLKLPRKKLEDLYEQIVLEMAELRELDTARAILRQTQVMGVMKQEQPERYLRLEHLLVRTYFDPNEAYQESTKEKRRAQISQAIASEVSVVPPSRLMALIGQALKWQQHQGLLPPGTQFDLFRGTAAMKQDEEETYPTTLSHQTKFGKKTHPECARFSPDGQYLVSCSVDGIIEVWDYISGKLKKDLQYQADESFMMHDDAVLSVDFSRDSEMLASGSQDGKIKVWRIRTGQCLRRLERAHAKGVTSVTFSRDGTQILSSSFDTTARVHGLKSGKMLKEFRGHNSYVNCAIFSTDGSRVITASSDCTVKVWDTKTTDCLQTFKPPPPLRALNHASYLMVVLHFQGGDATVNSVHLSPKNSDHIIVCNKTSSIYIMTLQGQVVKSFSSGKREGGDFLAASVSPKGEWIYCVGEDMNMYCFSYQSGKLEHLMKVHDKDVIGITHHPHRNLIATYAEDCTMKTWKP

SEQ ID NO: 40984 - protein, 301 aa, Staphylococcus aureus subsp. aureus MRSA252
MITYDLIGNTPLVLLEHYSDDKVKIYAKLEQWNPGGSVKDRLGKYLVEMAIQEGRVRAGQTIVEATAGNTGIGLAIAANRHHLKCKIFAPYGFSEEKINIMIALGADVSRTSQSEGMHGAQLAARSYAEKYGAVYMNQFESEHNPDTYFHTLGPELTSALQHIDYFVAGIGSGGTYTGTARYLKQHHVQCYAVEPEGSVLNGGPAHAHDTEGIGSEKWPIFLERSLVDGIFTIKDQDAFRNVKSLAKHEGLLVGSSSGAALQGALNLKAQLSEGTIVVVFPDGSDRYMSKEIFNYEENDYE

SEQ ID NO: 40985 - protein, 589 aa, Candida albicans SC5314
MLELNSITIPRNFTEFQLTALKIYYQLKILFLATYCTQGSLGLNGSVCLARDIFVGYVVYTQLLKLYRVLRGYGIIDSIRRLYLYVSSIVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGMYGSPTLAGSRPGALVVGCWATLINIGKQGYTKFCYDIVSASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 40986 - protein, 583 aa, Synechococcus sp. WH 8102
MMETQCSRPVLRLENVSKIYPTGEVLRNVTWEVKPGDRIGLVGVNGAGKSTQMRLIAGQEEPSSGQVVRQGDPRIAFLQQEFDVNPERSVREELFQAFGEAAVVLNRQREVEEAMASDKAAEDPDHLDQLIHELGRLQTRFEALHGYELDARIDKLLPTIGFTPEGAEQLVSDYSGGWQMRIALGKILLQDPDLLLLDEPTNHLDVETIQWLEGYLVEQTAALVVISHDRTFLDRVCNQIVSTERGISRSYLGNYTAHLEQKQLEQEATQAAFERQQKEIATQQAYIDRFRASATRSTQAKSREKQLDKVELVEAPIESVSGPSFRFPPAPRSGAQVAVIDNLCHSYGEKILFLGAELEVERGDRIAFVGPNGAGKSTLLRLVMGTETPDEGSARLGEHNVVARYFEQNQAEALDLSKTVIDTMFEAVPDWTQTQVRSLLGNFCFSNDSVFKEVGKLSGGEKARLALALMLLSPCNLLVLDEPTNHLDIPAKQMLEDALREFEGAVLVVSHDRYFISRVANRIVELRDGELVLYRGDYAYYLEKKEEERVEEREKHLAAEQEVKRKANRDKQKARQERRKKAA

SEQ ID NO: 40987 - protein, 687 aa, Oryza sativa Indica Group
MDPAPATPRWNLERPYLTGRFHQEAKVAAAAQGAGSKPYSLDSFSRGGGGGGAESVIGSYAVSVQELLVIDDLLSALVGIEGRYISIKRVRGKEGYVVFQIDSSMDLALQELTRRIFPLCEDFVLVYHFVESRSHFKSGLVNHALAAALRAFLLDYQAMVAQLEHQFRLGRLSVQGLWFFCQRMMSSLNALAVLVEKAISNNTSGSATLNLLQSQAKAMAGDSAVRSLLEKMTECASAAYLRMLERWVYEGVIDDPYGEFFIAENKSLQKVPNDLEFLAYLNSIVLCIFIRLEYWESLTQDYDAKYWQQRYSLKDGIPSFLTNVAATILTTGKYLNVMRECEYTVQVPLSESSKLMGFGSNHQYLECIKSAYDFASGELLTLMKDKYDLIGKLRSLKRYLLLDQGDFLVHFMDIAREELTKKPEEISVEKLQSLVDIALRSTAAASDPSHEDLTCCVERSSLLKKLSTLKDLDCAYPSDKLVAADVDHPMPLSVTGLETFCLSYKGFRSVKILGTPVLRSSILCRSMLKFVNSLLHYLTFEVIQIHDFFLQKCLKECLLLLPELLVVRLLALLYTEVFVAAKIEKLKALCLQYATSIQLLIPSIDVAKPENTSKSRMPRSKIKETKNRGQQLKLASENVVMSESILKFEAEFNSELQSLIPTLSNSSQAEPYLTHLGQCIIGVGVDQ

SEQ ID NO: 40988 - protein, 251 aa, Acinetobacter sp. SE19
MEKIMSNKFNNKVALITGAGSGIGKSTALLLAQQGVSVVVSDINLEAAQKVVDEIVALGGKAAANKANTAEPEDMKAAVEFAVSTFGALHLAFNNAGILGEVNSTEELSIEGWRRVIDVNLNAVFYSMHYEVPAILAAGGGAIVNTASIAGLIGIQNISGYVAAKHGVTGLTKAAALEYADKGIRINSVHPGYIKTPLIAEFEEAEMVKLHPIGRLGQPEEVAQVVAFLLSDDASFVTGSQYVVDGAYTSK

SEQ ID NO: 40989 - protein, 292 aa, Marinobacter sp. ELB17
MAIAESLKNQRILLAGCGNLGGAIATLLLQSGANVFGLRRRTDQLPQGVTPVAADLTLPATLKNTLPPRLDQVIYCLTPSDYTAQGYHAAYVEGLENLLYELQGQTPNRLFFISSTGVYGQDDNGWVDEESATQPGGFSGRQVLLGEQTALASRIPATVVRFSGIYGPSRQSFLQAVMDGRLNPPDHSNYSNRIHEQDAIRAIVHLSTMAAAGETLQSCYLASDCEPVRLDQVVRWVRQHTDCEEPAGDARSGGRVGSKLCSNRRLLKTGFEFRYPDFRAGYRELIDQRKGA

SEQ ID NO: 40990 - protein, 352 aa, Acinetobacter sp. SE19
MHCYCVTHHGQPLEDVEKEIPQPKGTEVLLHVKAAGLCHTDLHLWEGYYDLGGGKRLSLADRGLKPPLTLSHEITGQVVAVGPDAESVKVGMVSLVHPWIGCGECNYCKRGEENLCAKPQQLGIAKPGGFAEYIIVPHPRYLVDIAGLDLAEAAPLACAGVTTYSALKKFGDLIQSEPVVIIGAGGLGLMALELLKAMQAKGAIVVDIDDSKLEAARAAGALSVINSRSEDAAQQLIQATDGGARLILDLVGSNPTLSLALASAARGGHIVICGLMGGEIKLSIPVIPMRPLTIQGSYVGTVEELRELVELVKETHMSAIPVKKLPISQINSAFGDLKDGNVIGRIVLMHEN

SEQ ID NO: 40991 - protein, 802 aa, Arabidopsis thaliana
MPFWWPLIVLAFAYAICKFLLMLIPPNVPSIDVDASDVLAHGKDTEENSFIYIPPRGRSQQSDKKVQCYEPATMKYLGYFPALSPTEVEERVTLSRKAQKTWAQSSFKLRRQFLRILLKYIIEHQELICEVSSRDTGKTMVDASLGEIMTTCEKITWLLSEGERWLKPESRSSGRAMLHKVSRVEFHPLGVIGAIVPWNYPFHNIFNPMLAAVFSGNGIVIKVSEHASWSGCFYFRIIQAALAAVGAPENLVDVITGFAETGEALVSSVDKMIFVGSTAVGKMIMRNAAETLTPVTLELGGKDAFIICEDADVSHVAQVAVRGTLQSSGQNCAGAERFYVHKDIYTAFIGQVTKIVKSVSAGPPLTGRYDMGAICLQEHSEHLQSLVNDALDKGAEIAVRGSFGHLGEDAVDQYFPPTVLINVNHNMKIMKEEAFGPIMPIMQFSTDEEVIKLANDSRYALGCAVFSGSKHRAKQIASQIQCGVAAINDFASNYMCQSLPFGGVKDSGFGRFAGIEGLRACCLVKSVYPVAENAFEFQEALVETLYGLNIWDRLRSLIDVLKFLTDQSSNETVVWSQIVLEFICVDQLVMKLDNFGNKDNESEIKRHETEIKRRNVLSTLISLSHMPTVIQTCKKKSVEGVQIAPHLVLLIQCSLWVLYGLPVVHKDSILVTTSNSIGFVNEVIFVVVFWICCEDESRKRNVNLCLLAVFDFVTSFYVITIWAIQSLFAKYTLIGIVCNIFNICIYVSFAKKKMLESKTFKYMPFWLSLVSFINAGLWTAYSLIYIIDIYLLISSGCSVLFN

SEQ ID NO: 40992 - protein, 277 aa, Oryza sativa Indica Group
MPQVQVQAQLQQMQQQLAVLQPQLIFQSMPQLPACVPGGAAGAVSPQPPVPAMAFYPPPPLAFRVTSGLAGVATGGTVSFQQPARGTGGTASPTVRSTGPRATIKEQTIVGETVMSRTQIVKQLWQYIRQNNLQDPDDKRKIICNDELRVVFGTDTTDMFKMNKLLAKHITPLDPKDQIREAKKFKPSNVATQPMPLINQPSVVISDALAKFIGMEGTVPQDDALRYLWDYIKANQLEDAITGSILCDSKLQELFGCESIPSSGLSELLAHHFIKET

SEQ ID NO: 40993 - protein, 449 aa, Zea mays
MPTITHYVLDPFLETGSPAQAEKATPKPPPSPPDKATPVPVAPIRAQTSPASLYATPESTTLPDSPSSFPGTWSPYIINHKRRGASLAKTVPQGDVGSQGSQPKLPVILPALPKGGEPTAVEEPEFAFQQSGNDQAEGDSGVDEAPINGKNEMLLKGKGSVTAKNEHEQPEFEFHRGNLEALVRPVNVGRPLIGGAPKNDESDTFLELQDSMSVASNTETDDAGTQEWWWKPSSPLGISVGTPCAEFYDAFEEISSDGGTRSSRAMDDDLRELRLSLLTEIERREQAEEALEIWQKEWKKLSHHLSHVALSLPSPSIAEDTDDSSIDPGAELCQQITVSQLVAAAISQDFARAEVESEMETVIAAKNFEIARLSDRVQYYEAANREMSQRNQEAIETSRQQRKERKKRQKWFWGSVGLAVTLGATAIAWSYLPSSQPRASADSNSTVSD

SEQ ID NO: 40994 - protein, 389 aa, Novosphingobium aromaticivorans DSM 12444
MNQLSRALARIAPSRTTAITDRAIQLRAEGRDVISLSVGEPDFATPAHVVQATKDALDAGDTKYTAVVGTAALRSAAALHFSRDLGLEVPPSQVIVSAGGKQAIFHALLATLDPGDEVLIPSPWWVSYPEIVRFAGAEVVDLPTDAAGGFRITAAQLEAAITPATRWLLLNSPGNPTGATYPAQELRALGEVLRRHPRVLVMSDDIYAPLRYGEGRHATLAVECPDLADRILTVSGVSKSHAMTGFRIGVAAGPAWLISAMGRLQSHSSGNPASISQAAAVAAFEGPQDFLLDWRERFRARRDMVCARVNAIPGLSTPVPDGAFYCMVDAAPLMARFGDDEALCLHLLESGVAVVPASAFGGRDGFRISFAADEAKLEEALRRIEKAVA

SEQ ID NO: 40995 - protein, 265 aa, Legionella pneumophila str. Paris
MLKQIVLTGLVIIGIVITLMYLFQRHLIYFPNRHTPKLEDYNASDMKVVSLRTKDNLHLKSWYKPASKHRPTILYLHGNAGHIGYRMPLVREFIDAGLGVFLLEYRGYGGNPGKPSEKGLYADGETAIEFLIQHGVPSKRVILYGESIGTGVATHLATKYPVCAVMLQSPFTSLTRLAQYHYPLNFLKPWDQYNSLARMKKINAPILVLHGKLDQIVPYQEGLNVFNEANEPKKMISFDDKEHNDLWSADNFSREIIQFALNQCS

SEQ ID NO: 40996 - protein, 149 aa, Glycine max
MAEQTFIMIKPDGVQRGLIGEIISRFEKKGFYLKGLKLVTVDRPFAEKHYADLSAKPFFSGLVDYIISGPVVAMIWEGKNVVTTGRKIIGATNPAQSEPGTIRGDFAIDIGRNVIHGSDAVESANKEIALWFPEGPANWQSSQHSWIYE

SEQ ID NO: 40997 - protein, 312 aa, Novosphingobium aromaticivorans DSM 12444
MHQEYETTFGYRGGMTLKEQRKPIRKAVFPVAGLGTRFLPATKAIPKEMLPIIDRPLIQYAVDEAREAGIEQLIFVTGRGKTAIVEHFDTAYELEHTMRDRGKVLDILAPTRIQPGNLVTVRQQVPMGLGHAIWCARAVVGDEPFAIFLPDEMMIGTPGCMKQMVDAYEDVGGNLISVLEVPAAEVSSYGVIAPGARVSDTLTEVKGLVEKPKREDAPSNLIISGRYILQPEVMRTLECQESGAGGEVQLTDAMARMIGRQPFHAVTFAGRRYDCGSKAGFVEATLALALEREDMAEDVRAIMRRLLAQSGG

SEQ ID NO: 40998 - protein, 72 aa, Zea mays
TAEPEVTVLDLTILSPGRPDLVLPIPFQADDKGYAFALKDGSPYSFRFSFVVSNNIVSGLKYTNTVWKTGVK

SEQ ID NO: 40999 - protein, 514 aa, Salmonella enterica subsp. enterica serovar Paratyphi B str.
MSVSKKPMVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVILAEGQADAAMEDGDTLIFMNFRADRAREITRAFVNADFDGFARKKVVNLNFVMLTEYAADIKTAVAYPPASLVNTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQAHTAHTNLPVPLIYVGEKNVKAVEGGKLSDIAPTMLSLMGMEIPQEMTGKPLFIVE

SEQ ID NO: 41000 - protein, 340 aa, Rhodococcus sp. RHA1
MTWRMPAEGELHERTWMAYPSEGYSLGDTPEEHHEARTTWAEVAHAVARFEPVTVVVDPGQVSAAKEYLSADIDIVEAPLNDAWMRDIGPTFVLSEDGRLGGVDWIFNGWGGQDWAQWDKDSKIGALVVERSGAELVDSPIVNEGGGIQVDGLGTVLVTETVQLDPGRNPELSKADIEAELARTIGATKVIWLPRGLTRDQDTYGTRGHVDIVAAIPSPGVVLVHDQRNPEHPDFEVSKAVIDLLKQTTDARGESWEIITVPAPTVLRDEEGFVDYSYINHFVVNGGVIACSFDDPADEEAVAILSAAYPGRTVVSVDARPLFARGGGIHCITQHQPAVR

SEQ ID NO: 41001 - protein, 541 aa, Vibrio cholerae O1 biovar eltor str. N16961
MKFQYDFVFLNQFSCKKLISFYRIIFPSKKVAVFYMIYPIPNSETSTVHFKDVYDNYIGGQWMKPHSGEYFSNTSPVNGLVFCRVARSSSQDVELALDAAHNALESWSTTSAVERSNILLRIADRIESNLETLAIVESWDNGKPIRETLAADLPLTIDHFRYFAACIRSQEGAASELDSRTLTYHLPEPIGVVGQIIPWNFPLLMAAWKLAPALAAGCTVVLKPAEQTPVSILFLMEIIGDLIPAGVINVVNGFGSEAGNALATSQRIDKLAFTGSTEIGNHILKCAADNLIPSTIELGGKSPNIYFPDIFSHEDQYLDKCIEGALLAFFNQGEVCTCPSRILVHESIYEKFIAKIIERVALIKQGNPLDTETQIGAQVSKEQYDKILGYIQIGKDEGAELIFGGHPNNQENYLSGGYYIKPTLFFGHNQMHIFQEEIFGPVIAITKFKDEIEALHLANDTVYGLGAGVWTRDINIAHRMAKNIKAGRVWVNCYHAYPAHAAFGGYKKSGIGRETHKLTLSHYQNIKNVLISHEIHPLGLF

SEQ ID NO: 41002 - protein, 303 aa, Mycobacterium tuberculosis CDC1551
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTELVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 41003 - protein, 437 aa, Bacteroides fragilis YCH46
MKIAIVGTGYVGLVTGTCFSEMGVDVICVDIQDRKIENLKKGIIPIYEPGLEDMVSRNYKAGRLKFSVDLKTCLEDVEVVFCAVGTPPEEDGSADLQYVLEVARTIGRNMNKYILVVTKSTVPVGTAQKVKDTIQRELDRRKVQIEFDVASNPEFLKEGDAVNDFMKPDRVVVGVESERAKEIMERLYKPFMMNNYRLIFTDIPSAEMIKYAANSMLATRISFMNDIANLCELVGADVNMVRKGIGADTRIGSKFLYPGCGYGGSCFPKDVKALIKTAEKNGYSMRVLKAVEEVNEFQKCILYEKLLKYFSGDIAGKQVAVWGLSFKPETDDLREAPALVLINMLIKADAMVKVYDPIAMDGCKLIIGNKVKYATDMYDAILDADALLLVTEWKEFRVPSWGVLKKTMKQAVVIDGRNIYDEKELVALGITYYCIGK

SEQ ID NO: 41004 - protein, 350 aa, Bacteroides fragilis YCH46
MRVLVTGAAGFIGSFVCRELLLRGDEVVGLDNINTYYEVDLKYDRLATLTINRESVDWYKFVQSDTYQNFRFIRMNLEDRQAMQMLFANEHFDRVVNLAAQAGVRYSIENPYAYVESNVNGFLNVLEGCRHNGVKHLVYASSSSVYGLNGKVPFSEKDGIAHPVSLYAATKKSDELMAHTYSYLYGIPTTGLRFFTVYGPWGRPDMSPFLFADAMLHNRSIKVFNNGDMLRDFTYIDDIVEGVLRVIDHIPMPDPRWCAEYPNPSSSTAPYKIYNIGNSYPVKLTDFIQAIEDMIGYSAEKIYLPMQSGDIYQTNADTTSLQEELGFKPNKSIKEGVKETIEWYRSYYKL

SEQ ID NO: 41005 - protein, 400 aa, Oryza sativa Indica Group
MSDLFGDGIFAVDGDKWKQQRKIASYDFTTRALRDFSGDVFKRNAAKLAGVVSSHAASNQSMDFQGFLMRATMDSIFTIAFGQDLNTLDGSGEGRRFAAAFDDASEFTMLRYLNPFWKLSRLLNVGAEAMLKERIKVVDGFVYKLIRDRSDELSNTKAHDTDSRQDILTRFIQATTSDSGTVDYKYLRDIILNIVIAGKDTTAGSLAWFLYMMCKHPEVQEKICHEAMEATNAGEAASIDEFSQSLTDEALNKMHYLHAALTETLRLYPAVPLDNKQCFSDDVLPNGFNVSKGDIVFYIPYAMGRMESLWGKDAESFRPERWLDENGVFQQESPFKFTAFQAGPRICLGKDFAYRQMKIFAAVLLRFFVLKLRDEKEIISYRTMITLSVDQGLHLTAMAR

SEQ ID NO: 41006 - protein, 456 aa, Gibberella zeae PH-1
MLSAALRRRVLAPTHSALRTGFAAHVVRHYASFPEHQVIKMPALSPTMQAGNIGAWQKKIGDSIAPGDVLVEIETDKAQMDFEFQEEGVIAKILKDAGEKDIPVGSPIAVLVEEGTDVAAFEKFSVEDAGGAAKPAAPKEEKSESKSESASTPEPSSEPQQYESQGRLQTALDREPNIAAPAKRLAREKGISIDGIKGTGKNGQITEADVKKAVSSPAASAASSAASYEDIPISGMRKTIANRLVESTQTNPHFYVTSSLSVSKLLKLRQALNASADGKYKLSVNDFLIKAIAVASRKVPQVNSSWRDGNIRQFNTVDVSVAVSTPTGLITPIVTGVEGRGLEAISAQVKSLAKKARDGKLKPEEYQGGTISISNMGMNPAVDHFTAVINPPQAAILAVGTTKKVAIPSDNEAGVEFDDQITLTASFDHKVVDGAVGAEWLKEVKKVIENPLELLL

SEQ ID NO: 41007 - protein, 168 aa, Aspergillus nidulans FGSC A4
MSGLKAGDSFPADVVFSYIPWTEEKGEITSCGIPINYYASKEWADKKVILFALPGAFTPVCSARHVPEYIERLPEIRAKGVDVVAVLAYNDAFVMSAWGKANGVKNDDILFLSDPEAKFSKSIGWADEEGRTKRYAIVLDHGKVTYAALEPAKNHLEFSSAETVIKHL

SEQ ID NO: 41008 - protein, 487 aa, Staphylococcus aureus subsp. aureus MRSA252
MGEFKGFMKYDKQYLGELSLVDRLKHHKAYQQRFTKEDASIQGARCMDCGTPFCQTGQQYGRETIGCPIGNYIPEWNDFVYHQDFKTAYERLSETNNFPDFTGRVCPAPCESACVMKINRESIAIKGIERTIIDEAFENGWVAPKVPSRRRDEKVAIVGSGPAGLTAAEELNLLGYQVTIYERARESGGLLMYGIPNMKLDKDVVRRRIKLMEEAGITFVNGVEVGVDIDKATLESEYDAIILCTGAQKGRDLPLEGRMGDGIHFAMDYLTEQTQLLNGEIDDITITAKDKNVIIIGAGDTGADCVATALRENCKSIVQFNKYTKLPEAITFTENASWPLAMPVFKMDYAHQEYEAKFGKEPRAYGVQTMRYDVDDKGHIRGLYTQILEQGENGMVMKEGPERFWPADLVLLSIGFEGTEPTVPNAFNIKTDRNRIVADDTNYQTNNEKVFAAGDARRGQSLVVWAIKEGRGVAKAVDQYLASKVCV

SEQ ID NO: 41009 - protein, 1413 aa, Aspergillus nidulans FGSC A4
MADLKPPFTEEAARAKVKIAQNLWNAQDPVRVSQAYTPGCIWRNRTSFFSGTEAIVDFLTAKWKRERNYRLRKELFSFTDNRIAVQFWYEFQDANDSMRWKRCYGLEDWTFDRESGKMCKRMMSGNDILLGPDGNGEGRCDYRLLTQRWDHPTYHPYNRNRRLQQLDLNHFCRARISLAMEETSPFPDSKTMRSPLTDASNRINNCHTPTTERRLMREEHALTSPVPMSIVDSPLSPRNNAENNGPPPVGDSRACSKRNSAVSAASIVSAKGKRKTHVGPWQLGRTLGSGATGRVRLAKHAVTGQTAAVKIVSKKCAAISQSDSIAAMDRNAGTFIGAGGRQMPSGIEREVVIMKLIEHPNVISLYDVWENRGELYLVLEYVEGGELFDYVSNHGPLPEEEAVRLFRQIIAGLGYCHRFNICHRDLKPENILLDGEHNIKLADFGMAALQPAGHWLNTSCGSPHYAAPEIIYGRKYRGDKADLWSCGIILFALLTGFLPFDGEDLHATLQLVRKGDYMIPPHVSAEAADLIQRILQKKPDDRISMKDIWKHPLLKKYEKFHQAICNHYLGPPPPLSPQDCGPPVVRQDIDVDLLRNLQTLWHDVKPERLIEKLISLEPTQERLFYHALVKFRNEQLENYEGQPLRYSTSDYHHISRGQARLSKHLRSRSQNGSQRRSRAPSVKETGKRRPSTRELKPSASVETYDPYRSPFNRVPDKSPQYAHVTIHREAPETSPKPAEVEVDSSNPFLDDEQEIECQQSPPFTLVRKRKQNFNSVKSFQSKTSLISSRRALNSASTPRSVSYKRNVTFHHNRNRSQSSASAKAKRAHCNRQPSEASLISGFDDDPFSDSRSSSLLPAQPAVVRGAGIAVKNSVQRRVQHSDFVWRDEARKVSHELSQICEEAFNGSSLSTGCTDTTCVSPETPATSVSLASPGVSNHQMDSSSSTVCLAATPPADSPKTSHVRRELEETRRRLIEHSMKDGSKEIPQCLAPVIDHLDRLIEQEKTRRPGKVSTKEDYSSMSDLFCGSPVEPTQLSVLSEELNTGRRSDDTPSSKKDRQVSGSTAASSQISRGKRSIRMVPHSSYQSISNTEPRAVHRPAAALIDRPENDRGNALASRVGSNHRHNRTPCELDPIDEHPASPRRSAVRSTDHKKWSWFRKSQNIEEDFVKAPTVVKPLHPSSATVIVHEVHPARNTAENQPKLGKPPSDSQKVSFWSFIKRKKGKNADPESTATNPVLESRRDDERQRAHPGPKLSENKTATKPRRSIRSSGISNNWFARVFQFKPATRVVALNASKIKGRKEIYKMLRDWKQYGMEDIYLDKPNSIIYGRVGESNFLHLRPVDFSADFYTVIEDGRQANLSVVRFRQERGAASSFNRVVDTLCMVMKQRGLLVEDPARAKRMAQVLDAFPNA

SEQ ID NO: 41010 - protein, 377 aa, Shewanella sp. ANA-3
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGQRQAARGSDLRYNLELSLEEAVKGLTKELRIPTLASCDVCDGSGAKKGSSATTCGTCHGQGQVQMRQGFFTVQQPCPTCHGRGKIIKDPCSKCHGDGRVEKTKTLSVKIPAGVDTGDRIRLAGEGEAGEFGAPPGDLYVQVTVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 41011 - protein, 501 aa, Glycine max
MEMFPLLPYFLLSSLVFLLTFKLLFSQRRKHKNLPPGPPPLPIIGNLNLLERPLHRFLTRTSKTYGDIFSLWFGSRLAVVVSSPSAFQECFTRNDVALANRPRSLSGKHIFYNYTTVGSCSYGEHWRNLRRITSLDVLSTQRIHSFSGIRKDETERFIRMLAKDSCMDYAHVELSSMFHDMTYNNMMRMLSGKRYYGDESQIKDVEEAKEFRETVEELLQVAGVSNKADYLPFLRWFDFHNLEKRLKSINKRFDTFLDKLIHEQRSKKERENTMIDHLLHLQESQPEYYTDQIIKGLVLAMLFAGTDSSAVTLEWSLSNLLNHPEVLKKARDELDTYVGQDRLVNESDLPNLFYLKKIILETLRLHPPAPLAIPHVSSEDINIGEFNVPRDTIVMINIWAMQRDPLVWNEATCFKPERFDEEGLEKKVIAFGMGRRACPGEGLALQNVGLTLGLLIQCFDWKRVNEEEIDMREANWFTLSRLTPLNAMCKARPLVNKINLK

SEQ ID NO: 41012 - protein, 474 aa, Glycine max
MEPRVGNKFRLGRKIGSGSFGEIYLGTNIQTNEEVAVKLESVKTKHPQLLYESKLYKILQGGNGIPNVKWYGVEGEYNVLVMDLLGPSLEDLFNFCSRKLSLKTVLMLADQMLNRVEFVHSKSFLHRDIKPDNFLMGLGRRANQVYIIDFGLAKKYRDTTTHQHIPYRENKNLTGTARYASMHTHLGIEQSRRDDLESLGYVLMYFLRGSLPWQGLKAGTKKQKYEKISEKKVSTSIESLCRGYPSEFASYFHYCRSLRFDDKPDYAYLKRLLRDLFIREGFQFDYVFDWTILKYQQSSSATAPARAIGPAAGPSSGVPPLVANGDGQLGGEDGRPNNWSSSDPTRRRNSGPIVNDGILSRQKGPVTYDSNGSKDAMLSSSNFFRPSGSARRGAVSGNRDVVGSETEASRSLTLDSSQGAFRKIPFPGALRSSAIMTSEHNRTSSGRNTSNIKNLETTLRGIESLHFNDERVHY

SEQ ID NO: 41013 - protein, 434 aa, Pyrococcus furiosus DSM 3638
MRILKFCVLFDKLGVRMKIAVIGLGYIGLPTAIMFAEAGYEVIGFDVKKDVVDRINSGKAHIVEPGIEEKLNKVVKEERLKATTKVEKLRGANAFIICVQTPLEGNKPNLIYLENAIRSVAEVIDRGALVIIESTVPPGTTIKMAKLLESLTGFREGVDFYMAHAPERVMPGRIFYELVYNSRVIGGVSEKATELAVKLYKSFVKGEIYATDATTAEMIKLMENTYRDVNIALANEFALLAHQYGVNIFEAIRIANTHPRVNIHFPGIGVGGHCLPKDPYLLLSNAKKEFGLIRLARKINESMPKFVATLLFEALEEGGVEEREAVVTVLGLAYKGGTDDIRNSPALTFVKLIRDRVLEVRTYDPYVGGTHKSLEDAIVEADAVVIATDHPEFKELNWEEIGRLMRHKILIDGRGIVSNPPKGFIFKGVGRGDV

SEQ ID NO: 41014 - protein, 146 aa, Physcomitrella patens subsp. patens
SNTEYHILAVDDSRIDQKVIERLLKSASYKGTELTTVNSALRALKYLGLSESCASPVMPDVNRILCDLQRNAVHLIMTDYCMPEMTGYELLKIVKAETSAFKDVPVILMSSENDSSRIERCLAEGAEEFIIKPVQMKDVQRLQGHI

SEQ ID NO: 41015 - protein, 522 aa, Candida tropicalis
MSIQDIVETYSTKWYVVVLVALIVYKVFDFFYARYLMYKLGAKPFLQSQTDGYLGFRVPFELMGKKSEGTLIDFTYQRTLELDNPDIPTFTFPIFSVLIISTLEPDNIKAILATQFNDFSLGTRHSHFAPLLGDGIFTLDGAGWKHSRSMLRPQFAREQVSHVKLLEPHMQVFFKHIRKHHGQTFDIQELFFRLTVDSATEFLFGESVESLRDESIGMLNDALDFDGKAGFADAFNYSQNYLASRALMQQMYWILNGKKFKECNAKVHKFADYYVEKALELTPDQLEKQDGYVFLYELVKQTRDRQVLRDQLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 41016 - protein, 524 aa, Candida tropicalis
MATQEIIDSALPYLTKWYTVITLAALVFLISSNIKNYVKAKKLKCRDPPYFKGAGWTGISPLIEIIKVKGNGRLARFWPIKTFDDYPNHTFYMSIIGALKIVLTVIQENIKAVLATQFTDFSLGTRHAHFYPLLGDGIFTLDGEGWKHSRAMLRPQFARDQIGHVKALEPHIQILAKQIKLNKGKTFDIQELFFRFTVDTATEFLFGESVHSLYDEKLGIPTPNEIPGRDNFATAFNTSQHYLATRTYSQTFYFLTNPKEFRDCNAKVHYLAKYFVNKALNFTPEEIEEKSKSGYVFLYELVKQTRDPKVLQDQLLNIMVAGRDTTAGLLSFAMFELARHPEIWSKLREEIEVNFGVGEESRVEEITFESLKRCEYLKAILNETLRMYPSVPVNSRTATRDTTLPRGGGPNGTDPIFIPKGSTVAYIVYKTHRLEEYYGKDADDFRPERWFEPSTKKLGWAYVPFNGGPRICLGQQFALTEASYVITRLVQMFETVSSPPDVEYPPPKCIHLTMSHDDGVFVKM

SEQ ID NO: 41017 - protein, 484 aa, Rhodococcus sp. RHA1
MTDFERLRATLPTGLWIDGAQTDPIDGGTFPVYDPATGTLIADVADAGGKDAMRALDSAAAVQEEWAATAPRQRSIILRSAWEKVIERTDDLALLMTMEMGKALPESRGEVNYGAEFLRWFSEEAVRIQGRYTTSPSGSGRIMVTKVPVGPTLAVTPWNFPLAMGTRKIGPALAAGCTIIVKPAEDTPLTMLLLAEIFAEAGLPAGVLSVLPASNAAAVTEPLLADPRLRKVTFTGSTRVGKILIEQSAQQVLRTSMELGGNAPFVVFDDADIDAAVEGAMAAKMRNGGEACTAANRLIVANSVREEFTTKLTDRIAALTVGPGSEEGTNVGPLVNEKQRRNVASLVDDAVAAGARVRTGGKSVDGPGYFFQPTVLDEVPANARIVREEIFGPVAAITGFDTEAEGVAAANDTEYGLAAYIYTQNVDRAFRVADKLESGMVGVNRGVISDVAAPFGGVKQSGLGSEGGTEGIEEYLETKYVGFA

SEQ ID NO: 41018 - protein, 507 aa, Candida tropicalis
MIEQVLHYWYYVLPAFIIFHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 41019 - protein, 630 aa, Sulfolobus solfataricus P2
MKIPIEPNFRTDPKDYSEEERAKLKTKGLTEDTIGIYSSFHDLSREDLEKEVSLIAKSFGIYIEFNRDKMKLNGVKDWIYMVRLPIPGGGPISSKQWRILDDISNKYTISDAYTGYPSPSLKLTTRQAIQFHHVKKRDLPNLIREVAESGFLTVNGCGDNVRNTIACPLSKYWVFDANSLARKIANYFRLPLDLYLQVFEIPLIENRQFDRESFKYGENLLPRKFKIAIAGVLRTINGKYIIDNCVEVQSNDIGIVPLIEDEKVIGYQIYVGGSMGENNSYPTFSALGLPIGTVVNDSELIKVLDAIVTIQEEWGDRKNRHWARFKYVVYKMGLEWLREKVREHSGIQLGKIVKVDLTHKDLHLGWINLGDNKWAYGIFVENGRLIDGKNGRTKSMIRYIADNFDNLMFYITPNQHLLITEIDQPQKEKIDGILREFNYGFRDGKPYSSLRINSTACVGFPTCKLSFTDSERFLPSLIDELERRGWKDIPVSIGLSGCVAQCSRPALHPISWVGSGYELYMLKIGGGNGSLGEPLIDWDENSIYLYQVPSNRLADVTEALFELYEKNKDISEDPSLVFRLLGNKKIIEWLKGHEKTKDLMKPHKFDRKIEGYREYHDLLRKRLEEVSRYG

SEQ ID NO: 41020 - protein, 517 aa, Candida tropicalis
MYEQVVEYWYVVLPLVFILHKVFDMWHTRRLMKQLGAAPVTNQLHDNFFGIINGWKHLSSRKKVELKNIMIINLPIRKFQVWVHMLVPSLEQSSSSQKIRRNIKALLATQFSDFSLGKRHTLFKPLLGDGIFTLDGQGWKHSRAMLRPQFAREQVAHVTSLEPHFQLLKKHMVKNKGGFFDIQELFFRFTVDSATEFLFGESVHSLKDETIGSYQDDIDFVGRKDFAESFNKAQEYLAIRTLVQDFYYLVNNQEFRDCNKLVHKFTNYYVQRALDATPEELEKQSGYVFLYELVKQTRGPNVLRDQSLNILLAGRDTSAGLLSFAVFELARNPHIWAKLREDVESQFGLGEQSRIEEITFESLKRCGYLKAFLNETLRVYPSVPRNFRIATKNTTLPRGGGSDGNSPVLVKKGEAVSYGINSTHLDPVYYGDDAAEFRPERWNEPSTRKLGWAYLPFNGGPRICLGQQFALTEAGYVLVRLAQSFDTLELKPPVVYPPKRLTNLTMSLQDGTIVKID

SEQ ID NO: 41021 - protein, 446 aa, Rhodococcus sp. RHA1
MNDIQYRLPQKRALVTELPGPKSAALTARRRATVAAGVGSSVPVYAADADGGVVVDVDGNSLIDLGSGIAVTSVGASDPAVAEAVREQVGHFTHTCFMVTPYEGYVRVAEELAALTPGDHEKRTVLFNSGAEAVENAIKVARLATGRDAVVAFDHAYHGRTNLTMALTAKSMPYKAHFGPFAPEVYRLPMSYPYRDQDGLTGEQAAQRAISQMEKQIGADSLAAIIIEPIQGEGGFIVPAEGFLPTLVNWARANGVVFIADEVQTGFSRTGAWFACEHEEIVPDIITMAKGMAGGMPLSAITGRAELLDKVHPGGLGGTYGGNPVACAAALAAIDSMRKFDLPARAQHIGDLALPRLKALAADVGVIGDVRGRGAMLAMEFVKPGTDEPDAELTKAIAAHALEQGVILLTCGTYGNVIRLLPPLVISDDLLDDALTVIEQIVRSLV

SEQ ID NO: 41022 - protein, 476 aa, Rhodococcus sp. RHA1
MSIDVLENYINGEFVASSATETLDLINPVDESVVGRAPVSTKADVDAAVEAAERAFVSWGKTTPSVRQTALLKLADAIEAHSDELVEAECRNTGQPKQVIADEEIKVGADQLRFFAGAARMLEGKAAGEYMDGFTSYVRREPIGVVGQVTPWNYPFMMALWKIGPALAAGNTIVLKPSDTTPNSTLVLARLTKGILPDGVFNVVLGNGETGATLVENPALGLVSITGSVRAGIAVAVSAARQLKRAHLELGGKAPAIVFGDVDIEKTASGIAEAAFFNGGQDCTAATRVLVHESIHDQLVDALVRKAETLKPGLPDDPDTFYGPLNNVNHFNAVSSKIAALPTSAKIVTGGKRSGEQGFFFEPTVITGVDQRDDIVQEETFGPILTVQSFSDEKEAVTLANDVRYGLASSVWTNDHGVTQRLSAALDFGAVWINCHIPLVAEMPHGGFKYSGYGKDLSGYGVEDYTRIKHVMSSND

SEQ ID NO: 41023 - protein, 141 aa, Glycine max
MASASATATLLKPTPLPPHKPIITASVSPPLPPPRRHNLLRRDLLSLSAASTLLLTQSLPFLAPSPASAAEDEEYVKDTSAVISKVRTTLSMERTDPNVADAVAELREVSNSWVAKYRKEKALLGKASFRDIYSALNAVSG

SEQ ID NO: 41024 - protein, 560 aa, Xanthomonas campestris
MTTLQISGMTCASCADHVKDALEKIPGVHQADVSYASGKAELTVDKRVNHEQMQAAVEALGYRAAFEDATLQPRPGLLDQAPGWLSGGIGAGKEDVRLHVAVIGSGGAAMAAALKAVEGGARVTLIERGIIGGTCVNVGCVPSKIMIRAAHVAHLRRESPFDGGLSATTPTVLRERLLAQQQGRVDELRHAKYESILESTPAISVLRGTARFQDGHTLSVELAEGGERIVAFDRCLVATGASAAVPSIPGLKDTPYWTSDEALVSDSIPQRLAVIGASVVAVELAQAFARLGSRVTILARSSMFFREDPAIGAAVTEVFRMEGIEVLEQTQASQVSQPNGEFVLSTNHGELRADQLLIATGRLPNTQGMNLDGAGVTLDERGGIQIDRGMRTSARDIYAAGDCTDQPQFVYVAAAAGTRAAINMTGGEATLNLDVMPSVVFTDPQVATVGYSEAEAHNAGLETDSRTLTLDNVPRALANFDTRGSSSWCAEAGSGRLLGVQAVTPEAGELIQSAVIAIRARMTVQELADQLFPYLTMVEGLKLAAQTFTKDVKQLSCCAG

SEQ ID NO: 41025 - protein, 162 aa, Zea mays
  misc_feature (72)..(72): Xaa can be any naturally occurring amino acid
MDEEAMRAFFPLSFGKAAPRPSSATSSAHSNTLRKPQNPSNPKPSASTAADDDGAAMIGPPRPPPAPAGGGXDDEDGGGIMIGPPRPPPPSARGEGDDGDGMIGPPRPPPADDEDVDDDEDDDEEEMEDDGEGGFNRIPLSNEIVLRGPIMVVFCPLSVRSS

SEQ ID NO: 41026 - protein, 212 aa, Oryza sativa Indica Group
MGEEDISNDSKSSCGCEDGTVEAPAAAAPKENGRAADPRLQAISDAIRVVPHFPKPGIMFNDITALLLRPAVFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPVYILVESRK

SEQ ID NO: 41027 - protein, 393 aa, Campylobacter upsaliensis RM3195
MKVYLDNNATTMLDHSALELMLPYLKESYGNPNSLHQWGSLTHPALRAAMDKLYEGLGASDLDDIVITSCATESINWVLKSAYFDYILDKERDEIIISSVEHPAVSGAAHFLKSLGVKVIELPVNSEGVSSVEHLREVISDKTALVSVMWANNETGMIFPIKEMAELSHEFGALFHTDATQAVGKIKVDLRQSGVDFASFSAHKFHGPKGVGGLFIKKGLKLTPLLHGGEHMGGRRSGTLNVPYIVAMAEALRIANSMLNFEDSHIRRLRDKLEDAVLSIEDTSVVGDRKNRVPNTILASIKGVEGEAMLWDLNKNGIAASTGSACASEDLESNPIMEAIGAENDLAHTALRLSLSRFNTEEEIDYAATQIKAAAKRLRAISSTYAYNPNNYK

SEQ ID NO: 41028 - protein, 1097 aa, Oryza sativa Japonica Group
MDNPEAEPDDAVLFVGVSLVLGIASRHLLRGTRVPYTVALLVLGVALGSLGANINPDLLLAVFLPALLFESSFSMEIHQIKKCMAQMVLLAGPGVLISTFFLGSALKLTFPYNWNWKTSLLLGGLLSATDPVAVVALLKELGASKKLSTIIEGESLMNDGTAIVVYQLFYRMVLGRTFDAGSIIKFLSEVSLGAVALGLAFGIASVLWLGFIFNDTIIEIALTLAVSYIAFFTAQDALEVSGVLTVMTLGMFYAAFAKTAFKGDSQQSLHHFCLFEGSLMWSYLDGQCPEVSHLAGASWGFLLLLYVFVQISRILVVVILYPLLRHFGYGLDLKEATILVWAGLRGAVALSLSLSVKRASDAVQTHLKPVDGTMFVFFTGGIVFLTLIFNGSTTQFLLHLLGMDRLAATKLRILNYTKYEMLNKALEAFGDLRDDEELGPPADWVTVKKYITCLNDLDDEPVHPHAVSDRNDRMHTMNLRDIRVRLLNGVQAAYWGMLEEGRITQTTANILMRSVDEAMDLVPTQELCDWKGDSEVARIVIDESNAEGEEARKFLEDVRVTFPQVLRVLKTRQVTYSVLTHLSEYIQNLQKTGLLEEKEMAHLDDALQVAGIFCLSFNYYYADFVVSVTNHNGNTNSSQFTWQTDLKKFKRNPPLVKMPRVSDLLNTHPLVGALPAAMRDPLLSSTKETVKGHGTILYREGSRPTGIWLVSIGVVKWTSQRLSSRHSLDPILSHGSTLGLYEVLIGKPYICDMITDSVVHCFFIEAEKIEQLRQSDPSIEIFLWQESALVVARLLLPMMFEKMATHELRVLITERSTMNIYIKGEEIELEQNFIGILLEGFLKTKNQTLITPPGLLLPPNADLNLFGLESSAINRIDYCYTAPSYQVEARARILFVEIGRPEIEADLQRSASLISQTLELPRTQSKEHSGLLSWPESFRKSRGAQNGASLTEIRDHPASFSARALQLSMYGSMINDMKSGQGQGQRRQRHRHTKASSNKAHSSSYPRVPSRSSNTQRPLLSVQSEGANMTTARQAAAAGASLPPEPEEAGRRRRRQRKAIEEDEDNSSDESAGEEVIVRVDSPSMLTFRQPSSAADR

SEQ ID NO: 41029 - protein, 386 aa, Shewanella sp. ANA-3
MEVALTKSALLVLEDGTVFTGTAIGADGLSVGEVVFNTSMTGYQEILTDPSYSRQIVTLTYPHIGNTGTNNEDVESNGVHACGLIIRDLPLVASSFRNQQTLSDYLKANNVVGIADIDTRKLTRILREKGAQAGCIMAGADLDEAKALAAAKAFPGLKGMDLAKEVTTDKAYPWRKGSWRLVGGLPEDTPAEALKYKVVAYDYGVKQNILRMLVDRGCDVTVVPAKTSAADVLAMNPDGVFLSNGPGDPEPCDYAIEAIQQILKTDTPIFGICLGHQLLALASGAKTLKMKFGHHGANHPVSNIEKGNVMITSQNHGFAADEATLPANIKVTHKSLFDGSLQGIHLTDKPAFSFQGHPEASPGPNDAAPLFDHFIELIEQYRQNAK

SEQ ID NO: 41030 - protein, 274 aa, Campylobacter upsaliensis RM3195
MLQTCIFPAAGYGTRFLPATKALPKEMLPILTKPLIHYGVDEALEAGMDNMGFVTGRGKRALEDYFDISYELEHQISGTKKEYLLSEIRSLISRCTFTFTRQNEMRGLGDAVLKGRPLASDEAFGVILADDLCVNENGQNVMAQMVKIYEKYRCTIIAVMEVEKDQVGNYGVIAGNAVEDNLIMVHSMIEKPSVEEAPSNLAIIGRYILTPDIFGILENTKAGKNGEIQLTDALLTQATNGMVLAYKFEGKRFDCGSVDGYVEATNYFYKKSLC

SEQ ID NO: 41031 - protein, 348 aa, Physcomitrella patens subsp. patens
MLKLRGEGGLGTPCFSDSACASGLYCFACPAAGASGFQPKCTRCRITPTSAFPKNTSLPFNKYAWLTTHNSFAIFGSPSESGVPIITFFNQEDSVLEQLNNGVRGLMLDMYDFRNDIWLCHSFRGVCYDFTAFRPASKTLAEIKTFLDSNPTEVITIFIEDYVTSPNGLTSLFSKAGLMKYWMPVAAMPSYGRLWPTLQTMIQRNHRLLVFTQNSTKEATEGVAFQWRYTTENQYGDDGMNNSSCLKRGGSPAMSDMSRSLIVQNYFPSNPNPINACKHNSDGLFKMLSTCYAASGNRWSNYIAVDFYKRSTGGGAFRALDRLNGQMECGCEDVTKTCTVSHVWRTFV

SEQ ID NO: 41032 - protein, 162 aa, Mycobacterium tuberculosis H37Rv
MQFDVTIEIPKGQRNKYEVDHETGRVRLDRYLYTPMAYPTDYGFIEDTLGDDGDPLDALVLLPQPVFPGVLVAARPVGMFRMVDEHGGDDKVLCVPAGDPRWDHVQDIGDVPAFELDAIKHFFVHYKDLEPGKFVKAADWVDRAEAEAEVQRSVERFKAGTH

SEQ ID NO: 41033 - protein, 460 aa, Glycine max
MLLELETWTALVFLFLLVLILKESIMGGKSSKRSERRHVSSYGSAGSSSSRDSYGYPQSPNAYPQQNPYNTPLHHRAPAPFHDYSLPKRRLDRRYSRIADDYHSLDEVTTALSHAGLESSNLIVGIDFTKSNEWTGKRSFNRKSLHHIGSGQNPYEQAISIIGKTLSVFDEDNLIPCFGFGDASTHDQDVFSFHSDERFCHGFEEVLSRYRDIVPRLRLAGPTSFAPIIEMAMTIVEQSGGQYHVLLIIADGQVTRSVDTQHGQLSPQEEKTIDAIVKASEYPLSIVLVGVGDGPWDMMREFDDNIPARAFDNFQFVNFTEIMSESIDSSRKEREFALSALMEIPSQYKATIDLGILGARRGHSPDRVPLPPPHYERASSSSTTSFRSNSFQHSTPTYYDNVNAESSSRSSYDNKVCPICLTNGKDMAFGCGHQTCCDCGENLECCPICRSTITTRIKLY

SEQ ID NO: 41034 - protein, 345 aa, Pyrococcus furiosus DSM 3638
MLRCTKCNRVYEEDLRIQCECEGTLLVERKYSSFAPQRRYFDMRRYLPYLPVNERFLPYLHPPVTPVSKVKNVIFKLEYLHPTGSFKDRGTYVTVAKLKELKIKEIVIDSSGNAAISMAVYSAFSNIRTHIFVSSNTRKEKLSLLSSFGAELHIVEGDRMKVHEEAVKYSRENNIPYLSHWLNPYFLEGTKTVAYEIYEQVGVPEYVVVPTGSGTLFIGIWKGFKELFEMGEISRLPKMIAVQAKGFESLCKRSNSEANVLADGIAIPNPPRKEEMFRIIKESNGSCISIGERVTRQALTELYRMGFIVEPTSAVAYAALKFFEDEGKSFVVPLTGSGLKLHSSF

SEQ ID NO: 41035 - protein, 339 aa, Pyrococcus furiosus DSM 3638
MSIIQDIIGRIVVLRGGQYSVEVDVVTDESFGRFAAPIDENPALYIAEARRAVSEVDEIIGPELIGFDAIDQELIDSYLWEIDGTDNFSHIGANTALAVSVAVAKAAANSRNISLYSYIGGTFTTELPVPVVTFGADENFEYHVIVRDLLEVTDIIDAVVRLLDFSLSLEELSKASEQVGLELGLEVSLGITMRKELETEKVLEIVEDYNIAYIKPIGTPELFLELIAGTHGVFIDGEYLYRKYNILDRKYYNALSIKPINLGTLTDLYNFVNDVKAEKITPILSESKYEPADETLPHLALGLRCPAMLIHMNSVEKINELNRIAEELGERGRIITFEE

SEQ ID NO: 41036 - protein, 506 aa, Candida tropicalis
MSLTETTATFIYNYWYIIFHLYFYTTSKIIKYHHTTYLMIKFKASPPLNYINKGFFGIQATFTELKHLICHTSIDYAIDQFNNVPFPHVHTFVTKVLGNELIMTKDPENIKVLLRFPVFDKFDYGTRSSAVQPSLGMGIFTLEGENWKATRSVLRNMFDRKSIDKVHDFEPHFKTLQKRIDGKVGYFDIQQEFLKLGLELSIEFIFGQVVSEDVPHYDDFTQAWDRCQDYMMLRLLLGDFYWMANDWRYKQSNQIVQAFCDYLVQKSLENTCNDKFVFVHQLAKHTTNKTFIRDQALSLIMASRDTTAELMAFTILELSRKSHHLGKLREEIDANFGLESPDLLTFDSLRKFKYVQAILNETLRMYPGVPRNMKTAKCTTTLPKGGGPDGQDPILVKKGQSVGFISIATHLDPVLNFGSDAHVFRPDRWFDSSMKNLGCKYLPFNAGPRTCLGQQYTLIEASYLLVRLAQTYETVESHPDSVYPPRKKALINMCAADGVDVKFHRL

SEQ ID NO: 41037 - protein, 505 aa, Candida tropicalis
MYQLFCFLAGIIVVYKAAQYYKRRTLVTKFHCKPARISPNKSWLEYLGIASVVHADEMIRKGGLYSEIDGRFKSLDVSTFKSITLGKTTYVTKDIENIRHILSATEMNSWNLGARPIALRPFIGDGIFASEGQSWKHSRIMLRPVFAKEHVKQITSMEPYVQLLIKIIKNHEGEPLEFQTLAHLFTIDYSTDFLLGESCDSLKDFLGEESNSTLDTSLRLAFASQFNKTQQQMTIRFMLGKLAFLMYPKSFQYSIQMQKDFVDVYIDRVVGMSEEELNNHPKSYVLLYQLARQTKNRDILQDELMSILLAGRDTTASLLTFLFFELSHHPEVFNKLKEEIERHFPDVESVTFGTIQRCDYLQWCINETMRLHPSVPFNFRTAANDTVIPRGGGKSCTDPILVHKGEQVLFSFYSVNREEKYFGTNTDKFAPERWSESLRRTEFIPFSAGPRACLGQQLPRVEASYVTIRLLQTFHGLHNASKQYPPNRVVAATMRLTDGCNVCFI

SEQ ID NO: 41038 - protein, 70 aa, Pyrococcus furiosus DSM 3638
MGASPVIVPVRCFTCGKVIGDKYYEFKRRVEAGEDPEKVLDDLGLERYCCRRMLLSHVELIDDIMHYRVY

SEQ ID NO: 41039 - protein, 296 aa, Novosphingobium aromaticivorans DSM 12444
MQSYPAPALALVEEMAAAAAKDPARAVSFQGAPGANSHRAALEALPDCLPLPCFSFEDALDAVKEGRAGQAIIPIENSQHGRVADIHFLLPESGLSIIGEHFLEIHASLMALGDGPFSAAYSHPQALGQSRFYLRERGIVPMSYADTAGAAAYVAELGDPTVAAIAPKIAAELYGLKLIAENVEDAHDNTTRFVILSKTPLDPATIPGPAMTTFVFEVRNIPAALYKALGGFATNGVNMTKLESYQRGASFAATEFYADIVGAPGERPVDLAFEELGFFAKRVRMLGTYPMERIRG

SEQ ID NO: 41040 - protein, 399 aa, Triticum aestivum
MAATAAASPSSLLLSRRHGASLSSSSASRAGASRLRAPRCVLGTAEQLRVVEAWKRTGGADPWAAAWTPKTPAQEARLAALPQEARDSRLKIFSGTANRPLAQEIASYLGVDLGKILIKRFADGEIYVQLQESVRGCDVFLVQPTCSPVNENLMELFIMIDACRRASARSITVVIPYFGYARADRKAQGREAITAKLAANLLTEAGSDRVIVCDMHSAQALGYFDIPVDHIYGQPVILDYLASKTISKDLVVVSPDVGGVVRARAFAKKLSDAPLAIVDKRRQGHNLSEVMHLIGDVKGKVAIMVDDMIDTAGTITSGAALLKQEGAEAVYACCTHAVLSPPAIERLSGGIFEEVIVTNSILLPEDKCFPQLTVLSMANLVAETIWHVHRDGSVSSIFQ

SEQ ID NO: 41041 - protein, 839 aa, Pseudomonas fluorescens Pf-5
MHNNNELTLGAPLSGPVLALRSVPDPVFASGAMGDGIAIDPLNDTLHAPCAGQVIQVARTGHAITLRAANGAELLLHLGLDTVELQGEGFALLVKEGQQVRAGQPLLRVDLDHVAQHCRSLISLLILTNGEGFDLRPLTLSTVQVGEPLLHISRRANAGPQPLTQEQSGQQASARIKVAHRGGLHARPAALVRQTALSFNSHSQLTFKDKSAPCTSLIALMSLGIGEQEEVLVSCQGDDCQDALQAMLQTLGTAMAADAHGETPVPAPAAQGPVEDGVLPGVCAAPGLVYGPLVRLNAMVLAEDHGQHAPEPQRQALSTALDQVRGEIRHTLEQARQRRDQQEQDIFSAHLALLEDPTLLDAAEASIAQGRAATHAWSAAITEQCQILQQLGSTLLAERANDLRDLQQRVLRALLGEAWHYDLPAGAIVAAEELTPSDLLQLSAQGVAGLCMAAGGATSHVAILARGKGLPCLVALGPQVLRIDSGRQVVLDANGGRLELEPDPQRIAQVQQAGETQRQRHALQQQKAHEPALTQDGQQIEVAANVASSDEARDAHQGGADGVGLLRTEFLFVDRQTAPDQEEQRQAYQAVLNAMGDKPVIIRTIDVGGDKQLDYLPLPVEANPVLGLRGIRLAQARPELLDQQLRALLQVSPVQRCRVMLPMVTEVAELLHIRQRLDLFAAELGLSQRPELGVMIEVPAAALMAEQLAEHADFLSIGTNDLSQYTLAMDRDHAGLAARVDALHPALLRLIAQTCAGAQRHGRWVGVCGALASDPLATPVLIGLGVSELSVSPPQVGEIKDRVRQLDASQCRQLSQPLLNLPGAAAVRQACERLWPLHS

SEQ ID NO: 41042 - protein, 301 aa, Shewanella oneidensis MR-1
MSQRIQVSQQIQTSQDVSKAQCLQADFYQLPAASDEANYRLFQFGAGENHVQLLVPPAKRVTLFFGYRGDHSIMQLLLLTDALRRNGAEQIDLLLPYMPGARQDRVCNVGEALSVKVYASLINQQQYASVSVFDPHSDVTAALLDRVQVIDNHSFVAAIAAQLTGELVLVSPDAGANKKVFGLAKALQGMPVIRADKHRDVVNGHIIATEVFCDDLSGKTCLIVDDICAGGRTFIELAIKLKQKRAQSVILIVSHYEDKASESALREAGIDRLFCTDSLGVPTHISSEFCDCHAVLSYMNH

SEQ ID NO: 41043 - protein, 1932 aa, Nostoc sp. PCC 7120
MATEQLTRESDELDLKQLLKTLTAVKKGDFSARMPIDQTGVAGKIADTLNDIIDQNERMAAELKRISNVVGKEGKITERASLGNVRGSWSDSVNSVNTLITDLVQPTAETTRVIRAVANGDLSQTIATEIDGRPLKGEFRQTANIVNTMVTRLSSFAGEVTRVAREVGTEGKLGVQAEVQGVAGTWKDLTDNVNLMAGNLTGQVRNIAEVATAIANGDLSKKITVDVKGEILELKNTVNTMVDQLNSFASEVTRVAREVGTEGKLGVQAEVRGVAGTWKDLTDNVNLMAGNLTAQVRNIAEVTTAVANGDLSKKITVNVKGEILELKNTVNIMVDQLNSFASEVTRVAREVGAEGKLGGQAEVRGVAGTWKDLTDSVNFMAGSLTAQVRNIAEVTTAVATGDLSKKITVDVKGEILELKNTINTMVDQLNSFASEVTRVAREVGTEGKLGVQAEVRGVAGTWKDLTDNVNLMAGNLTGQVRNIAEVATAIANGDLSKKITVDVRGEIFELKNTINIMVDQLSSFASEVTRVAREVGSEGKLGVQADVRGVAGTWKDLTDSVNFMAGSLTAQVRNIAEVTTAVATGDLSKKITVDVKGEILELKNTVNTMVDQLNSFASEVTRVAREVGTEGKLGVQAEVKGVAGTWKDLTDSVNFMAGSLTAQVRNIAEVTTAVANGDLSKKITVDVKGEILELKNTINTMVDQLNSFASEVTRVAREVGSEGKLGVQAYVRGVGGTWKDLTDNVNSMAGNLTAQVRNIAEVTKAVANGDLSKKITVDVKGEILDLKNTINTMVDQLSSFASEVTRVAREVGTEGKLGGQALVQGVAGTWKDLTDNVNSMAGNLTAQVRGIARVVTAVANGDLKRKLMLDAKGEIETLAETINEMIDTLATFANQVTTVAREVGIEGKLGGQAKVPGAAGTWKDLTDNVNELAATLTTQLRAIAEVATAVTKGDLTRSIAVEAQGEVAILKDNINQMIANLRETTQKNTEQDWLKTNLAKFTRMLQGQRDLETVSKLILSELAPLVGAQHGVFYLMEGAENQSYLQLLSTYAYRERKHLANRFQLGEGLVGQCALEKERILLTEVPSDYVKISSGLGEANPLNAVVLPVLFEGQVTAVIELASFRRFSEIHLTFFDQLTESIAIVLNTIAASMRTEELLKQSQSLAEELQTQQSELRETNQRLEQQAQSLKASEDLLRGQQEELQQTNAELEEKAELLALQKKEVERKNREIEQARRSLEEKAEQLALSSRYKSEFLANMSHELRTPLNSLLILAKLLTDNVDSNLTAKQVEYSQTIYSAGNELLALINDILDLAKIESGTMSIHATPIPLSELAEQIERGFGQIAQNKGLTFAVELAPELPTTVNTDIKRLQQVLKNLLSNAFKFTERGEVRLRIEVAKPGWNPNQQPLNPAQNVIAFAVSDTGIGIAADKQKIIFEAFQQADGTTSRKYGGTGLGLSISREIAHLLGGEIKLTSHPGQGSTFTFYLPQFSPESTLNHADAINRFGAESTLTQIDAINRVSTGYDSIVFDDRTTITNPSADNNILLIIEDDVNFARILVDMARQHGFQVLTAQSGTAGLKLAKDFQPMAILLDIRLPEMDGWTVLDRLKHDPTTRHIPVHIMTVEEGRQRGLQLGAIAYLQKPVTSEAISEALDKIRGFVERRVKNLLVVEDDELQRQSIVELIGNSDVATVAVGTGAAALEAIRTQQFDCLVLDLGLPDMTGFELMEQIKREANGATLPIIVYTGREISKNQETELRRIAETIIVKDVRSPERLLDETALFLHRVQANLPTPKREILEQLHSQDYSLVGKKVLIVDDDVRNIFALTSMLERYQMQVIYAENGREGISLLENTSDIDVVLMDVMMPEMDGYETMQLIRKKEQFKALPIIALTAKAMQGDRDQCIAAGASDYIAKPVDTEQLLSLLRVWLYR

SEQ ID NO: 41044 - protein, 174 aa, Pseudomonas fluorescens Pf-5
MKYRLGDARVETHPQSWVAPNATLVGKVKLEEGASVWFNAVLRGDNELILIGKHSNVQDGTVMHTDMGFPLTIGTGVTIGHNAMLHGCTVGDYSLIGINAVILNGAKIGKNCIIGANSLIGEGKEIPDGSLVMGSPGKVVRELTEPQKKMLEASAAHYVHNAQRYARDLVEQEQ

SEQ ID NO: 41045 - protein, 536 aa, Oryza sativa Japonica Group
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTEGMIVLFVMEMLEFHENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQLDTFCELQHEKSFSYKFSILLLCQLGSGPWDQLFGGGNAPAFAVAAAASFIGGLVAILGLPRARIASRRRGHR

SEQ ID NO: 41046 - protein, 771 aa, Ostreococcus tauri
MRRYQEILTDPSYAGQFVLFTCPHIGNVGINEGDMESSKVHMGAMIVRNLSLNVSNYRSVKDLSTYLEEQGVMGIADIDTREITRRLRETGCLNGCLSNDDSKSDAELLDMAKGYNIVGKDLISEVTCKEPYEWKDTTGEWEFSDKAKASKDQFNVVVYDFGVKHNILRRLASFGCKLTVVPASYPADKVMAMNPDGVMFSNGPGDPSAVPYAVENAKNILGQLPVFGICMGHQVLGQAFGGKTFKLKFGHHGGNHPVRAADGAVEISSQNHNFAVDPKSLPAGITVSHVNLNDGTCAGMVWPEKRAMTIQYHPEASPGPHDSDRCFADFVQMMRDSKNMFLIHTRRHTQDRSPNFTQRVALHTERIMPVDDADAGARRSSGDQSARTPQPSESINRFAFDSFGEGDIEREQVERVTPGIELERQAERTRSTHEREEVLPRLLDCSGVLQDACAAIVDDSFNRCFQEAVEEPWNFNFYLFPLWWLGWLIRHGILFPLRLAFILSASAAFTVSFFFSHYVTPREWGWERKCVELYAAAFVVSWTGVIRYHGPKPSRGGQRGGVVYVSNHTSMIDYLVLTQVSPFAVIQQKHRGWVGLLQRTAMNAIDCIEFNRTDIQDRHKVTERLKQHVADKSRLPLLIFPEGTCVNNKYCVMFKRGAFDLGVDVVPVAIKYNSLFVDAFWNSRRQSFSRHLCKLMSSWAVVADVWYMEPQRQREDETSIEFAERVRTMICKRAGLKAVPWDGMLKYYRPSPRECESRRKAFASTLMNGLK

SEQ ID NO: 41047 - protein, 222 aa, Zea mays
MDSVMAAPDSPPQTVVLVSAGASHSVALLTGNVLCSWGRGEDGQLGHGDAEDRLVPTVLSGFDAPAITSVICGADHTTAYSEDELQVYSWGWGDFGRLGHGNSSDVFTPQPVKALQGLKIKQIACGDSHCLAVTMAGEVQSWGRNQNGQLGLGTTEDSLLPQKIQAFESVCVKMIAAGAEHTAAVTEDGDLYGWGWGRYGNLGLGDRNDRLLPEKVSSVEGE

SEQ ID NO: 41048 - protein, 281 aa, Bacteroides fragilis YCH46
MKRIAIQGTLGSYHDIAAHKYFEGEEIELICCANFEDVFAAIRKDSQTIGMLAIENTIAGSLLHNNELLRQSGTQIIGEYKLRISHSFVCLPEEDWNDITEVNSHPIALMQCREFLNQHPRIKVVEAEDTALSAEIIKRENLKGHAAICSRAAAERYGMKVLQEGIETNKHNFTRFLVVADPWQVDEIRKQNTVLNKANIVFTLPHSEGSLSQVLSILSFYNINLTKIQSLPIIGREWEYQFYVDVAFNDYLRYKQSITAITPLTKELKILGEYAEGKSNV

SEQ ID NO: 41049 - protein, 394 aa, Bacteroides fragilis YCH46
MQKENQTYKVAPADRLAGVSEYYFSKKLKEVARMNAEGKDVISLGIGSPDMPPSEQTIETLCNNAHDPNGHGYQPYVGIPELRKGFADWYKRWYGVELNPATEIQPLIGSKEGILHVTLAFVNPGEQVLVPNPGYPTYTSLSKILGAEVVNYNLKEEDGWMPDFDELEKMDLSRVKLMWTNYPNMPTGANATPELYKRLVEFARRKNIVIVNDNPYSFILNDKPISILSVPGAKEYCIEFNSMSKSHNMPGWRIGMLASNAEFVQWILKVKSNIDSGMFRAMQLAAAKALEADSTWYEVNNVNYRNRRHLAGEIMKTLGCTYEEKQVGMFLWGKIPASCADVEELTEKVLQEARVFITPGFIFGSNGARYIRISLCCKDAKLAEALERIKLIMK

SEQ ID NO: 41050 - protein, 681 aa, Oryza sativa
  misc_feature (165)..(165): Xaa can be any naturally occurring amino acid
MAIPGSFCHPTALQVFVSVQFVFAVLVPHAAGRHHRHGCAPFSCGHLSDVSPPFRRRGDPPECGVASYELTCTDDKPATIQIDNGTYLVMDIKYKDSTFWVIDANISDSRNNCPLPRWNRDFGYYDQMLYERHGEDSRRRSIQAELMPPYQSTTATFVTCSQEIXRANGKYRPVACMSTNSSFVYVLTGMNSDSIGSLEPSCGYLAMTPLGAGDRPLVLENASYADVVKLMRGGFAIRFPYTSRFYVYSSKIKQCIAQSFQNIVQEERPTSFRIFYTVIFDYHFWGCLLPHPVVQLIVGVIPLAMWTLKWIAVFCRFILVPLVILTFLARNYWKIRITTDAVEKFLRMQLMNGPTRYAYTDLIAITGHFREKLGQGGYGSVYKGVLLPGNAHVAVKVLGNSNCNGEEFISEVSTIGRIHHINVVHLVGFCSEEIRRALVYEYMPRGSLDKYIFSSERSFSWDKLNEIALGIARGINYLHQGCDMQILHFDIKPHNILLDVNFVPKVADFGLAKLCPRDQSFVPLSALRGTIGYIAPEMISRSFGIISSKSDVYSFGMLLLEMAGGRRNSDMYAENSNQTYFPSWVYDQLTEQQVGVGEIPAGTVANMHELERKLCIIGLHCIQMKSHDRPTMSEVIEMLEGGVVGLQMPPRPFFCDDEPVSLAVNSHQFSSELSEILEEDE

SEQ ID NO: 41051 - protein, 469 aa, Streptomyces filamentosus
MFQNADEVQKYVADNDVKFIDVRFCDLPGVMQHFTIPAATFDPAEELAFDGSSIRGFQAIHESDMALRADLSTARVDPFRRDKTININFFIHDPITGEQYSRDPRNIAKKAEAYLASTGIADTAYFGPEAEFYVFDNVRFQTSANESFYHIDSEAGAWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWQGGSPLFYDEQGYAGLSDTARYYIGGILKHAPSLLAFTNPTVNSYHRLVPGFEAPVNMVYSQRNRSAAMRIPITGSNPKAKRVEFRAPDPSSNPYLAFSALLMAGLDGVKNKIEPAEPIDKDLYELAPEEHANVQQVPTSLPAVLDALEADNEYLQAGGVFTSDLIETWIDYKRTNEIAPIQLRPHPHEFELYFDI

SEQ ID NO: 41052 - protein, 298 aa, Mesorhizobium sp. BNC1
MKKVRKAVIPVAGLGTRFLPATKALPKEMLTIVDKPVVQYAVDEALEAGIEHIIFVTGRNKAVIEDYFDLQPELAGTLEKAGKTKELRLLEEMMPVAGSVSFTRQQAPLGLGHAVWCARDIVGNEPFAVLLPDMVSFGKKGCLAEAMELYGRTGGNVLAVEQCHPRETRKYGIVGRGAEVVPGFQITSMVEKPAPENAPSNFYINGRYILQPEIFEFLSRHERGAGNEIQITDAMAHLLREQPFYARPFTGRMFDCGSKSGFIEANVAFALKRDDIRESVIEPIRAMVGMDRETGQAA

SEQ ID NO: 41053 - protein, 326 aa, Magnetospirillum magnetotacticum MS-1
MTVLVTGAAGFIGYHASLRLLARGQRVLGVDCLSPYYDVRLKHTRLEHLRKHEGFSFVQADIADRSAMEEVARSHPEVTAYINLAAQAGVRHSLTAPFDYTHSNIEGHLVMLEMARANPKCRHFVYASSSSVYGANTKLPFSVEDRVDTPISLYAASKRSGELMSHSYSHLFRVPTTGLRFFTVYGPWGRPDMAAYLFADAIVAGKPIKVFNNGDMRRDFTYIDDIVSGVVGVLDNPPADDGQAPPYRLYNIGNNNSEKLMDFIGLVESSLGRKASYDFHPMQPGDVKETYADISAIQRDVGFAPTTPISVGVPRFIEWYKQYHGL

SEQ ID NO: 41054 - protein, 219 aa, Shewanella sp. ANA-3
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGKFPLPVEVIPMARSYVARELVKLGGDPVYREGVVTDNGNVILDVYNLKIINPKELEEKINAIVGVVTNGLFAKRGADVLLVGTPEGVKTFTA

SEQ ID NO: 41055 - protein, 187 aa, Oryza sativa Indica Group
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNELQNWKKDELRDAVLLVFANKQDLPNAMNAAEITDKLGLHSLRQRHWYIQSTCATSGEGLYEGLDWLSNNIASKA

SEQ ID NO: 41056 - protein, 497 aa, Oryza sativa Indica Group
MFAAPPPERDHTQDLPDEILSLVFASLTPTDRNACSLTCARWKEVDASTRHRLSLDARAALGYAAQGIFARFTAVSKLALRCARGSGTDSLSDDGARQVAAALPSARLARLKLRGLRQLSDDGLASLAGATPVIRKLSVASCSFGPKAFVAVLRSCPLLEDLSVKRLRGLPDTAGATTAITEEILFPPASSLRSVCLKDLYSALCFVPLVASSPNLRSLKILRCSGSWDLPLEVIAARVPGLVELHLEKLQVGDRGLSAVSACANLEVLFLVKTPECTDAGIISVAEKCHKLRKLHIDGWRTNRIGDHGLMAVARGCPDLQELVLIGVNPTVQSLRMLGEHCRSLERLALCGCETVGDPEIICLAERCAALKKLCIKGCPVSDRGMWALNGGCPSLVKVKLKRCRGVSYECIENLKVVRGGSFSISLDIVLERDAGGAIENGGQEAGQVQITELTDQMAAMDLPTNASNAQSSAQASSRMRSVMSALRRRFGNPPAL

SEQ ID NO: 41057 - protein, 53 aa, Triticum aestivum
AVFKNTVLSGSTFDEANMKDVDFEDTLIGYIDLQKLCRNPSINEDTRLELGCR

SEQ ID NO: 41058 - protein, 477 aa, uncultured archaeon GZfos11A10
MKIVGVGAGRNLLTAEAMNTIKNAAVIYGSKRAIELVKEHVRSDRCECHEIKDYSRISELPDHAVVLSTGDPMLSGLGRFAKSGDTIMPGVSSMQIACARLGVEETRVAAVTAHARDIDYAKATIVRELKLGKTVFVIPDPRFNLRDIAKFLLDRGFSVPVAVCEQLAYPDERIAIGTTEKPPDVKSGNFSLMIGDAIRGVDGGASLPVIGVLGPEGTFSEHAAKRWAEKRPKLKYYDDISEIVSSVGKTVDFGVVPIENSLEGSIGITLDALLKCHVTIIDEITLPIRHCLLARSEDAGSIKTIVSHPQPIAQCRRFLREHFSDVDIQVAASTAHAAKLASTQDGVAAIAHAETALKYGLNILFEDIQETNGNRTRFVVLGTMASRSTGHDKTSIVVDLRKDRPGALYELLGEFASRGINLTKIESHPTRKALGEYLFYIDFQGHIQDAGVRELMEVIERTTAMVKVLGSYPESET

SEQ ID NO: 41059 - protein, 273 aa, Triticum aestivum
LVPNSARAAPAPIGKGHVSLNLTLRRTFNLFANVRPCRSIAGYKTPYDGVETVIIRENTEGEYSGIEHVVVDGVVQSIKLITREASERVLRFAFLYAQNIGKPKVRVVHKATIMKMSDGLFLATAERVSKDFPDIEFDAELLDNTCLKIVTDPVPYNDKVLVMPNLYGDILSDMCSGLIGGLGLTPSGNIGDSCSIFEAVHGSAPDIAGKGLANPTALLLSSVMMLRHMQLNEHALKIENAIFDTLKEGKSLTGDLGGKAKTHEFAEAIMKRL

SEQ ID NO: 41060 - protein, 567 aa, Prochlorococcus marinus str. MIT 9301
MSTKSNSLKEKLTENFSEFSQLSDYSFMNSLNADPQSTKDGNDHKPRSVYSGHYVPVVPTAIPEPEYISHSKKLFKELRLSSNLTKDQNFCRFFSGDISVANYPMSPVGWATGYALSIYGTEYTQQCPFGTGNGYGDGRAISVFEGLFNGKRMEMQLKGGGPTPYCRGADGRAVLRSSVREFLAQELMDALGIPTSRSLTLYVSRSEIVRRPWYSKGSRYFEPDIMIDNQAAITTRVAPSFLRVGQIELFARRVRNNAHDEALNELKMIVKHLIHRNYKDEIDNEISIESKVIKLASLYRSRLISLIANWMRVGYCQGNFNSDNCAAGGYTLDYGPFGFCELFDPRFQPWTGGGEHFSFFNQPFAAAINFKTFCSSLSPLLSGNKQDQGKLDQIEKDFSELMNKELKKMWANKLGLEHYNETLINEFFNLMVISKADYTILFRKLSEIPDNSYSLKDSFYFPIDDELNNRWEVWLKNWQSILKKEGNIKAKSALMKSLNPVYTWREWMVVPAYEEAEKGNYKKIKELQDIFSNPYIEQPSEIDQKYNRLKPSQYFNYGGVSHYSCSS

SEQ ID NO: 41061 - protein, 117 aa, Zea mays
  misc_feature (25)..(25): Xaa can be any naturally occurring amino acid
  misc_feature (66)..(66): Xaa can be any naturally occurring amino acid
  misc_feature (73)..(73): Xaa can be any naturally occurring amino acid
  misc_feature (85)..(85): Xaa can be any naturally occurring amino acid
  misc_feature (98)..(98): Xaa can be any naturally occurring amino acid
MSRSGDWVYENNGGTCVAIAGVDNXVVAAYTRLSVVYSILTRDHSEICDLADRCVLASSGCHADIXALHMNLXSRELLYPHQINXRMSCPAMEKSPSXTLNYKRFLPNNPFNGVQGL

SEQ ID NO: 41062 - protein, 325 aa, Nostoc sp. PCC 7120
MTSEQIIRRSDILNTQVITRDNGKRLGIVSQVWVDIDQREVVALGLRDSLISISGLPRYMYLSSIHQYGDVILVDNEDVIEDIEVEALSNLINWEVITETGEVLGRVRGFRFEAETGKLNTIVIASLGVPQIPDQFLSTYEISIEEVVSTGPNRLIVFEGAEERVNQLTVGVLERLGIGKAPWERDTEEEYGYSAPRAVAPSNQLPSGVPLQPPKPKVRTPEPVAEEEWTEDYIEEERPQRQVMKARQYESIQYEEDEEDNWSEATGRDRYQPPSQPYSKPYTEDYDDYDDDVESDAWEDVPPQPVNIPKKVKERQPEYEEEGGY

SEQ ID NO: 41063 - protein, 590 aa, Parvularcula bermudensis HTCC2503
MHRFVSLLALSTTLLAACGDNGVNDDQALDSVATDAAQVEASSLAAPSEQWVVVTANPLATSAGAAILREGGTAIDAAIAVQAMLGLVEPQSSGLGGGAFLLYYDAQADKLQAYDGREVAPLSARPDMFLTEDGERLNFYDAVTSGLSVGVPGVVAMLDLVHREHGKLEWSSLFADAEEKARDGFEVSPRLHSLLGRTTRLIDTPAAAALYYTEEGEPVAEGTLLQNPAYAETLSAIAGSGAGAFYTGDIAEQIVAAVNEKAGEGTMTTEDLAAYEVQIREPVCAEIFSAEICTMPPPSSGLTMLQILALSEAAGLPESPSASIWPTYAEASRLAYADRGLYIGDPSAMGTDTIGTAGLVEGLLSAPYIDHRAGLIGAMAAESVEAGDPTTDGLADQLGQDSSADLPGTSHFSIRDRYGNIASMTTTVETAFGSHLMAGGFILNNQLTDFSFSPTDEDGNPVVNAVAAGKRPRSSMSPTVVFDETGAPRIAIGSPGGPAIIGYVAKSLMLHLAYDMPLQASVEAANVVVPGSSVFVEDSLDEAAVAALDSYGLEVIERELTSGLYGFALGRDGIEVAVDPRREGTAEVSN

SEQ ID NO: 41064 - protein, 202 aa, Oryza sativa
MEVEASYSYGFLPSGRHQPYAPPPPHPAEEGELWGYFPCPFCYIEVEVPFICNHLQEEHCFDTRNAVCPLCADNIGRDMGAHFRVQHSHLLKRRKPSRPSSSWPTPSNNSDPYFEGPPQYMMNNRTYQDPAPDPLLSQFICSMAQTDTNSDNTNTEIAVSAVSHDQRLSQRVTLTDDASKLELKERLQRIEFVKEIIMSTIL

SEQ ID NO: 41065 - protein, 229 aa, Pseudomonas fluorescens
PRVVPKAQRLDKITFEEMLEMASLGSKVLQIRAVEFAGKYNVPLRVLHSFQEGPGTLITIDEEESMEQPIISGIAFNRDEAKLTIRGVPDNPGVAFKILGPISAANIEVDMIVQNVSHDNTTDFTFTVHRNDYLAAQTVLENTAREIGAREVVGDTDIAKVSIVGVGMRSHAGVASRMFEALAKESINIQMISTSEIKVSVVIEEKYLELAVRALHTAFELDAPARQGE

SEQ ID NO: 41066 - protein, 754 aa, Haloarcula marismortui ATCC 43049
MSDDELAKDLGLVSAMTIGIGTMIGAGIFVLPGVAANAAGPVVVVSFVVGGLIAMVNALSVSELGTAMPKAGGGYYYINKSLGPLFGSIAGMGDWMGLAFASAFYCIGFGQYLAVFVPLPEVAFLNPIQIGALIAGAIFVAVNYIGAKETGGVQTVIVFILLSILTVFAVAGFFAFDYATLAGADGLAPFGTGAILPATALVFVSFLGYAKIATVAEELKNPGRNLPIAIIGSVGIVTVIYAILVSMMLGVVPWPELSQDAPVAQAAQLAFPESIGPIGGVAAGAAAVMTVGALLATASSANASILASARINFAMGRDKIVTNWLNEIHPNYATPYRSILVTGGLIIVFIAFLGRDIEVLAKAASVLHLIVYALLNVGLIVFRETDAPEYDPDFTVPLYPITPILGAVLSLGLVAFMDSIEIALSAGFVLVAVVWYFVYARGKTTQKGVLSDYISDREEQLPDQVVNAADAVAPNGAGGPTIMVALANPRTESALITLASALAQHEDGRVLATHIATVPDQTALETAAANRDRIDATSESLLDTAKADAEAFDVPIETKTILSHRGIEEVFDAARTNHADTVVMGYGGTQFAGGRAEGTLDELAHDLPCDFLVLDGQDLDLSDVLVPTAGGLSSDLSAAVAKALEETFGVAVSLLHVVDPGEEESGRQFMYEWAAEHGLSDAELRIETGDIEATIERLGRDYSLVIVGATERGLLSRIVRGSLVFDVIETLDTPVLLAERPSSRSLRERLFGRE

SEQ ID NO: 41067 - protein, 427 aa, Torulaspora delbrueckii
MATHEEFIRTQVFGTVFEITNRYTDLNPVGMGAFGLVCSATDTLAQQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMTEGKPLFPGKDHVHQFSIITDLLGSPPEDVINTICSENTLKFVTSLPHRDPVPFRERFKTVEPEAVDLLEKMLVFDPKKRITAADALVHPYLAPYHDPTDEPVADAKFDWNFNDADLPVDTWRVMMYSEILDFHKIGGGDGQIDTSATFDDQVAAATAAAAHAAAVAQAQAQAHSNSSNSNSSSNVNSKSKAARDSANDAITNYGNQAVHYANEFQQ

SEQ ID NO: 41068 - protein, 433 aa, Xylella fastidiosa Dixon
MIQMNFHSTRTTAPVTTLSQAIAAGLAPDGGLYVPECLPPLGDLDHSADLINTATALLTPFFAGDPLEVHVPSICAEALDLPAPLLPLATPEDYVLELFHGPTAAFKDFGARFLAACLTRLRRDAERPLTILVATSGDTGAAVAAAFHRQPGLRVVVLYPDGRVSPRQAHQLGCFGDNVHTLRVAGVFDDCQAMVKQALNDTSLQTAVPLSSANSISLGRLLPQMSYYAHAALTHRASTGRPLNLIVPTGNLGNALAAILARALGVPLGQIVLATNANRVLSDYFSGAHYRPQPSVATLANAMDVGAPSNFERLRWLYRGDDAALRAAFTAYSVDDIAIRQTITARHRRYDEIFCPHTATAVFVLEHLRAQGVAGDWAVVATAHPAKFEQVVEPLIGTTVPVPAALDSLLQRPASDEPLAPEYPALRHMMLAT

SEQ ID NO: 41069 - protein, 835 aa, Xylella fastidiosa Dixon
MSSSAVRLSTVETPVYVPRTVVHKFGGTSVADADCYRHVACLLLAREETVQVTIVSAMKGVTDTLIALAEQAANHSPDWQVLWQQTRTRHCDAAQALLGEHAATLQDWLNTRFNELHEMLVALSVIGMLPSEVLDRLQGLGEVYSAQLLGQYLQAQGEDCVVLDARQVLVVSPGEFGAEVDWATSAQHLAHWRMQHPQRRVVVTGFVASDRTGRAITLGRNGSDYSGAIFAALFEADELHIWTDVDGVMSADPRVVPDAVQLDALSYDEACELAYFGAKVVHPQTMSPVMKRGVPIIIRNTFQPGHPGTRITADSVVSGSVKGLTLSPGLAVLNLEGTGLIGVPGTAERVFAALRNARLSVVMISQGSSEHSICCLVHQTEAERARDALLYTFAHELAIGHVQRVQLTNNISVLAAVGDGMAGHLGVAARLFESLRRAHVNILAIAQGSSERNISVAIDSQQATKALRAAHAAFWLSPQTFSIGVIGPGHVGEALLDQLCTAQQQLLSKANLDLRLRAIVSRRRMLLDERGLGSDWRHAFAAAPEAVDLDAFTAHLQVAHLPHAVIIDCSGSAEVADRYADWLAAGIHVVTPNKQAGSGPLHRYHAIRAAADASGARFRYEATVGAGLPVITTLRDLMDTGDSVTSIEGIFSGTLAWLFNKYDGSVPFSQLIAQARAMGYTEPDPRDDLSGVDVARKLVILARDAGRDISLEDVAVESLVPETLCQLSVADFMERLNEIDATFAERLAAAKQRGCVLRYVAQLSPGHVPSVSLIELPSDHAFVNLRLTDNVVQFTTRRYSENPLIVQGPGAGPEVTAAGVFADLLRVAAGEGARL

SEQ ID NO: 41070 - protein, 415 aa, Vitis vinifera
MKESKPWRPFTANCCSAEDHTVLGNFSRCRPSRSEFSKNIAPLPSFRRLSFSDLSRSSSTRVNEDLAQSFGPELHDFQLSELRAITQNFSSNFFLGEGGFGTVHKGYIDENLRQGLKAQAVAVKLLDIEGLQGHREWLAEVIFLGQLRHPNLVKLIGYCCEDDERLLVYEFMPRGSLENHLFKMSLPWGTRLKIAVGAAKGLAFLHGAEQPVIYRDFKTSNVLLDSDFTAKLSDFGLAKMGPEGSKSHVTTRVMGTFGYAAPEYVSTGHLTTKSDVYSFGVVLLEMLTGRRSMDKSRPKNEQNLVDWAKPYLTSSRRLRYIMDPRLAGQYSVKGAKEIALLALQCISSNPKDRPRMPGVVETLEGLQHLRDMAVTCGQWPATPKSTRNGAAVKGRRENNRVGTQWEQHNPSLKQF

SEQ ID NO: 41071 - protein, 416 aa, Aspergillus nidulans FGSC A4
MTVLNVSPVPPDEIFALNRAYIDDDFPQKVNLGVGVYRTNEGQPWPLPVVEEAEKQLAAENSVFRHEYTAIEGDRAFLPLARDLMFGFDGQATSDAKQEAAKARIGTVQTVAGTGANHLGALFLATHMKPRNVWLSNPSWANHLTIWELAGVPRKTYPYYSAATRSFDFDGMISTLESEAQEGDVILLHACAHNPTGLDPNKEQWKAIIDLCERKRIFPFFDSAYQGFASGSVDEDAWAVRYVLNEKPQMEMCVAQSFSKNFGLYGQRVGAFHYVLNEGAEDLRDTVVNNLCHLIRGEYSMGPTAGCNIVKKVLTSPELTAKWHQDLKVMSSRIISMREALYNELVRLKTPGTWKHIVEQNGMFSYTGLTPSQVYALKDKFHIYLLKSGRASISGLSPKNVNYVARAIDEVVRNVN

SEQ ID NO: 41072 - protein, 234 aa, Marinobacter sp. ELB17
MSSIADNINSVTQRIEKATLQAGRKPHSVRLLAVSKTRQADELREAVAAGQQDFGENYLQEALDKIANLQDIPELRWHFIGPIQSNKTAQIASAFCWVHGVERLKIARRLNDQRDTALPPLNICLQVNIDNEPSKSGCSLNELPALAAAIAELPQLTLRGLMAIPNPERGEAALRESFRAMNNALIQLRQDQPGTGPLDTLSMGMSDDLELAIGEGSTWVRVGTAVFGPRQQKS

SEQ ID NO: 41073 - protein, 276 aa, Marinobacter sp. ELB17
MSKSPTISFIGAGNMASAIIGGMLDNGYQAGEIWVSAPDDEHLQGLRKRFGISVTTDNRYCAQQSDIVVLAVKPQVMASVCEDIAAVVRNTRPLMVSIAAGLTSDTIDGWLGGGVPMVRVMPNTPSLVGKGAAGLFANSRVSEQQKNDVMAIFDSVGSANWVQQEEQLHAVTALSGSGPAYFFLMLEALEEAATNAGMAAETARELAIQTMAGAAEMAARSDLEPAQLKRNVMSPGGTTEQAVNTFEQGGLRELVQKAYSAAYTRSQEMAKELVGK

SEQ ID NO: 41074 - protein, 226 aa, Wolbachia endosymbiont of Drosophila ananassae
MSIKIAPSILSADFAKLGEEVRKISDLGVDYIHIDVMDGNFVPNITIGPSVVSAIRKYSNLPFDVHLMVTSPGNHIESFINAGADIITVHAEAEIHLERLIRKIKSYKNVNDEKKPIQVGVSIVPSTSPSVLEYIIHELDIVLIMTVNPGFGGQEFIHSQLNKISTIKKMIQERNLKTQISVDGGINFSNAADIIKAGADILVAGSAIFKAEDIKKAVNDLKNLLL

SEQ ID NO: 41075 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAIVLPLELTVCGFTVGYWNQDITVWITIFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEAKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 41076 - protein, 282 aa, Oryza eichingeri
GDHVLPVFTGECKECPHCKSAESNMCDLLRINTDRGVMIGDGKSRFSVNGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGE

SEQ ID NO: 41077 - protein, 431 aa, Arabidopsis thaliana
  misc_feature (420)..(420): Xaa can be any naturally occurring amino acid
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSSYYRDARVMWDQKTGRSRGFGFVSFRNQQDAQTAINEMNGKWVSSRQIRCNWATKGATFGEDKHSSDGKSVVELTNGSSEDGRELSNEDAPENNPQFTTVYVGNLSPEVTQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVXAAAHQQLMYYQ

SEQ ID NO: 41078 - protein, 282 aa, Oryza eichingeri
GDHVLPVFTGECKECPHCKSAESNMCDLLRINTDRGVMIGDGKSRFSINGKPIYHFVGTSTFSEYTVMHVGCAAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGE

SEQ ID NO: 41079 - protein, 282 aa, Oryza eichingeri
GDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGE

SEQ ID NO: 41080 - protein, 282 aa, Oryza eichingeri
GDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVDPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGE

SEQ ID NO: 41081 - protein, 352 aa, Hordeum vulgare
MANEEALMFALQLASSVVLPMTLRTCIELGLLETLVGAGGKTLTPEEVAAKLPSKAESNPDAASMVDRLLRVLATYKVVSRLVDECADGSLSRRYGAEPVCKWLTPNEDGVSMAPFCLLAQNKLFMEAWCHMKDAVLEGGSAFTKAFRASWFDYAGTDDHFNHLFNEAMKDHSVIITKKPLELYTGFDGIDTLVDLAGGVGAVIHAITKKYPSIKGINFDLPHVISDAQPYPGVEHVGGDMFEMVPSGDAIPMKWILPCFSDDECAVLLKNCYDALPAHGKVINVECILPVNPDATNNAQGLICVDASLLAYSPGGKERNLRDFEKLAKAAGFTGVKASYIFANFWAMEYTK

SEQ ID NO: 41082 - protein, 586 aa, Pseudomonas fluorescens Pf-5
MAALGCQWLAWRLKLPAILFLLLSGILAGPILGWLDPQEMFGPLLMPLVSLAVALILFEGSLTLHLSEWREIGSVVHRLVTIGALSTWAVITLATHWLLGFDWMLALLFGTLTLVTGPTVIVPMLRVVRPKASIANILRWEGIVIDPIGALLAVVVYSFIIASAEGAGLSQSLLTFGGVILCGSLFGIAGGWVLGSIMRRQWLPEYLHNLATLAAVLGIFIASNQVMHESGLLAVTLMGMWMANMKGVDVRHILHFKENLSVLLISGLFILLAARLDLKALIALGPLVLILLLVIQFIARPLNVLLSTAGSSLNWRERALLAWIAPRGIVAAAVSAIFAIRLDEAGHEGALLLVPLTFAVIIGTVVLQSATARPLARLLKVAEPAPSGFLIVGANGPARTLGKALQQLGSRVLLTDSSWENIRAARMEGLPTYFGNPASQHADAHLDLVGLGHLLALSPSGELNTLAAMRFRHDFGHQRLFALANSQESRRTDKHRASHEHRGQLLGSEALTYTKLASLLGQGAELYSTNLTDAFGWDDYQALHGERATLLFARDSSGWVHVVTPDSSLKPAAGWTLLALIQPESL

SEQ ID NO: 41083 - protein, 381 aa, Vibrio cholerae O1 biovar eltor str. N16961
MSKRDFYEVLGVGRDASERDIKKAYKRLAMKYHPDRNSGDAGAAEKFKEVKEAYEILTDAQKKAAYDQYGHAAFEQGAGGFGGGGFGGGGADFGDIFGDVFGDIFGGGRRGGGPRAQRGSDLRYNMELSLEEAVRGCSKEIEVPTLVHCDACDGSGAKKGTSAQTCGTCHGHGQVQMRQGFFAVQQTCPTCHGKGKIIKDPCNVCHGQGRKQKTKTLNVKIPAGVDTGDRIRLSGEGEAGEMGAPAGDLYVQVHVKEHHIFERDGNNLYCEVPVSFAMAALGGEVEVPTLDGRVSLKVPAETQTGRMFRMRGKGVKGVRSAALGDLIVKLVVETPVNLSARQKELLKEFEESCGGEAATKHKPKAEGFFNGVKKFFDDLTS

SEQ ID NO: 41084 - protein, 251 aa, Bacteroides fragilis YCH46
MRKNIVAGNWKMNKTLQEGIALAKELNEALANEKPNCDVIICTPFIHLASVTPLVDAAKIGVGAENCADKESGAYTGEVSAAMVASTGAKYVILGHSERRAYYGETVEILKDKVKLALANGLTPIFCIGEVLEEREANKQNEVVAAQLASVFDLSAEDFSKIVLAYEPVWAIGTGKTASPAQAQEIHAFIRSAVAEKYGKEIADNTSILYGGSCKPSNAKELFANPDVDGGLIGGAALKVADFKGIIDAFN

SEQ ID NO: 41085 - protein, 351 aa, Oryza sativa Japonica Group
MSAPAGLRQHCALGRAIAVVAICLLVIVGTYLLSSPAAGDGDTEEEFFSVRRRRRSSVDAGDDDLEAAVRGAAYANGTLIVSVLNRAYADEDGGLLDLFLRSMREGEGTEQLIAHVLLVAMDRPAFLRCRRLGGVRCYQLPAAQDGADDLSSEQLYMSDGFIRMMWRRIRLLGDVLKLGYSFIFTDLDVMWLRNPLSRLEYRAEEEDLLISSDQFNGRPGDIAGNELNTGFFFVASNNRTAALFDEWHAARDRSAGMKEQDVLNDMKRRGALRRLGVRARVLDTARFSGFCQDSRDAREVATVHANCCRTMRAKVADLAAVLAAARRRLDGDGASPVLRWPPHSQCVKSWE

SEQ ID NO: 41086 - protein, 306 aa, Rhodococcus sp. RHA1
MTDAAPHTASAFRTAVVPAAGMGTRFLPATKTVPKELLPVVDTPGIELVAGEAADSGAGRLVIVTSPGKDGVVAHFVEDLVLESKLEASGKYHLLEKVRKAPGLLEVESVVQDEPLGLGHAVGCAESVLDDDEDAIAVLLPDDLVMPRGVLETMSRVRRKRGGTVLCAIDVPKDQVSSYGVFEVETVPDATNPDVLKVTGMVEKPAIEDAPSTFAAAGRYLLDRAIFDALRRIEPGAGGELQLTDAIALLIKEGHPVHVVVHRGTRHDLGNPGGYLRAAVDFALDMDEYGPSLREWLIDRLKRTDS

SEQ ID NO: 41087 - protein, 291 aa, Zea mays
  misc_feature (164)..(164): Xaa can be any naturally occurring amino acid
  misc_feature (199)..(199): Xaa can be any naturally occurring amino acid
MGPARHLRGLTALLISAALLLSAAIPAARGQEETEDEEEFNYIPGDANGPENWGSIKPEWANCSAGRMQSPIDLARERVSLVPALGFLNHSYRPAQASIVNRGHDIMVRFNGDAGSLVINGTAYDLRQMHWHSPSEHTVDGRRYAMELHMVHESAAGKAAVIGXLYEIGLVPDPFLLRLEPFIRRIADRKDREEPIGRXTPGSARGTASAYYRYMGSLTTPPCSEGVVWTIIKKVRSVSKRQLELLREAVHDGNENNARPVQDLNDRDISLFRPKLHKQELLSFKDKLVGA

SEQ ID NO: 41088 - protein, 154 aa, Bacteroides fragilis YCH46
MMEKTLVILKPCTLQRGLVGEITRRFERKGLRLAGMKMVQLTDEVLSEHYSHLSSKPFFQRVKDSMMTAPVIVCCFEGVDAIQAVRALAGPTNGRLAAPGTIRGDYSMSFQENIVHTSDSPETAAVELNRFFKPEEIFDYKQATFDYLYANDEY

SEQ ID NO: 41089 - protein, 271 aa, Ostreococcus tauri
MSDRGGFSRGFGRGGERGRGDRGRGDRGRGRGRGRGPRGRGGEDKDAWVPCTKLGRLVQQGKIKSLEHIFLFSIPIKEHQIVEHFIGAELKDEVMKICPVQKQTTAGQRMRFKAFVVVGDCNGHIGLGVKACKEVAHSIQGSMILAKLNVVPVRRGYWGSKLGAPHTIPTKVHGKCGSVHVRLIPAPRGAGIVASGTVKKVLAMAGLHDVYTCSRGHTRTLGNSVKATYAALKSTYGFLTPDLWATTRFTKPPAQEFTDLLAKPAKAARDI

SEQ ID NO: 41090 - protein, 149 aa, Glycine max
REQAQEFTDIKFREAYLDTVCLNMVQDPGHYDVLVMPNLYGDILSDLCAGLIGGLGVTPSGNIGEGAAVFESVHGTAPDIAGQDKANPTALLLSGVMMLRYMGLESYANKIEKACFDAISHGDHKTRDLGGTGTCSSFTADICARIKSM

SEQ ID NO: 41091 - protein, 322 aa, Synechococcus sp. WH 8102
MAIASDITSLIGGTPLVRLNRLPLQSGCGADVIAKLESFNPSASVKDRIASAMVLAAEQEGTIQPGRTVLVEPTSGNTGIALAMVAAARGYRLILTMPDTMSTERRSMLRAYGAELQLTDGAQGMAGAIALANELVEEIPEAYLLQQFDNPANPAVHERTTAEEIWHDCDGHLDALVAGVGTGGTITGCARLLKQRNPQLQVVAVEPAGSAVLSGRPPGAHRIQGIGAGFVPAVLERDLIDEVMTVSDEEAMDVGRRLARQEGLLCGVSSGAAVAAALRLGQRSEWQGRRVLVMLASYGERYLSTPMFSGVASSPARQDPML

SEQ ID NO: 41092 - protein, 294 aa, Debaryomyces hansenii CBS767
MAVTLKNNTDTVTLNNGDKIPAVGLGTWQATEKDAAYKSVKAALQNGYRHIDTAAIYGNEEEVGRGIKDSGVPREEIYVTTKLWNADHKKAEEALNTSLKKLGLDYIDLYLIHWPYSVQPDTKQPYSDWDYLDTYKELQKLKATGNVKAIGVSNFTVKQLERLLADKDITIKPAVNQIEAHPLLTQPELTEYLKKNDIVIEAYSPLGSSNSPLFKNETVVAIAEKYQVEPAQVLVSWAIQRDTVVLPKSVTESRIISNLKTFKLSDEDFNTLNNLSQKDGVVRTCNPEFNDFDD

SEQ ID NO: 41093 - protein, 291 aa, Haloarcula marismortui ATCC 43049
MSKSLDISTTEAEQTVTEVIDTIVATTPDVRRAVADYRGQSNSVNPTGDDQLAADLRADELFEQRVLGIDGVASYASEERADVKTTDGRLHVAMDPLDGSSNLEPNSGMGTIFGIYSEQPPTVGTNLLAAGFVIYGPITSMVVARDGSVREYILEDGDKRVVDDDVTVPEDPTVFGFGGGVDSWTDEFESYAEAVRHELKLRYGGAMVADINQVLTYGGIFSYPALESRPEGKLRVQFEGHPMAYILESAGGRSSDGDQSLLEIEPDELHERTPLYLGNDDLIDRLEANID

SEQ ID NO: 41094 - protein, 649 aa, Saccharomyces cerevisiae
MFSVTRRRAAGAAAAMATATGTLYWMTSQGDRPLVHNDPSYMVQFPTAAPPQVSRRDLLDRLAKTHQFDVLIIGGGATGTGCALDAATRGLNVALVEKGDFASGTSSKSTKMIHGGVRYLEKAFWEFSKAQLDLVIEALNERKHLINTAPHLCTVLPILIPIYSTWQVPYIYMGCKFYDFFAGSQNLKKSYLLSKSATVEKAPMLTTDNLKASLVYHDGSFNDSRLNATLAITAVENGATVLNYVEVQRLIKDPTSGKVIGAEARDVETNELVRINAKCVVNATGPYSDAILQMDRNPSGLPDSPLNDNSKIKSTFNQIAVMDPKMVIPSIGVHIVLPSFYCPKDMGLLDVRTSDGRVMFFLPWQGKVLAGTTDIPLKQVPENPMPTEADIQDILKELQHYIEFPVKREDVLSAWAGVRPLVRDPRTIPADGKKGSATQGVVRSHFLFTSDNGLITIAGGKWTTYRQMAEETVDKVVEVGGFHNLKPCHTRDIKLAGAEEWTQNYVALLAQNYHLSSKMSNYLVQNYGTRSSIICEFFKESMENKLPLSLADKENNVIYSSEENNLVNFDTFRYPFTIGELKYSMQYEYCRTPLDFLLRRTRFAFLDAKEALNAVHATVKVMGDEFNWSEKKRQWELEKTVNFIKTFGV

SEQ ID NO: 41095 - protein, 295 aa, Debaryomyces hansenii CBS767
MTTRTANNTDYYTLNNGEKIPAVGFGTWKATKKEGAHTAVKIALQTGYRHVDTAVMYDNEEEVGRGIKESGIPREEIFVTTKLWNTDHKQVSKAFDSSLQRLGLDYVDLYIMHWPLPLDPKTEKPYEDWNYIDTYKEMQKLVESKKVKSIGISNCNIEQTKKILDDKDITIKPVVNQVEAHPLLPQLELFDFLKQNDIALEAYSPLGSDNSPLFKDDTIIGISQKYNVHLAQVLVSWAVQRGSIVLPKSVTESRIISNLKTFKLREDDFATLNNLSKEVGPVRTNDPDWFDFGKD

SEQ ID NO: 41096 - protein, 374 aa, Mesorhizobium sp. BNC1
MKADFYETLCVSRNADEKELKSAFRKLAMQYHPDRNPGDMEAEKKFKEINEAYETLRDPQKRAAYDRFGHAAFEQGMGARGGFNGGGFADIFEDIFGDIMGGARQRRSGGRERGADLRYNMEITLEESFTGKTAQIRVPTAVTCDECAGSGARPGSSPVQCPMCHGAGRVRASTGGFFSIERTCPQCQGRGQIIDDPCRKCSGQGRLTEERSLSVNIPAGIEDGTRIRLAGEGEAGLRGGPPGDLYIFLSIKPHEFFQRDGADLYCKVPISMTTAALGGSFEVTTLDGTQTRVKVPEGTQSGRQFRLRGKGMPVLRQPQVGDLYIQVAVETPQNLTRRQRELLEEFEKISSGENSPQSTGFFARMKDFFETFGE

SEQ ID NO: 41097 - protein, 330 aa, Geobacter metallireducens GS-15
MKILVTGGAGYIGSHVVKALGLEGHELLVYDNLSTGHEWAVMYGTLVKGDLEDRALLEKVFREFRPDAVMHFAASIQVEESVRRPLLYYGNNTAGTLNLLDVMVRTGVRCLVHSSTAAVYGIPDVVPVAETAPLAPINPYGSSKAMVEKILADLALAEDFRYVAIRYFNVAGADVACRLGQAYREATHLITRALKTAHGQYERLQIFGTDYQTPDGTCIRDYIHVDDLAAAHVLALDYLTEGGASEIVNCGYGHGFSVREVIEAVAHVTGTPFPVEETGRRPGDPPALVADSSKLRSLMKWEPQYDNLDFIIRTAWEWELALKRRESCAA

SEQ ID NO: 41098 - protein, 294 aa, Vigna unguiculata
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSSMLSLDPSKRITARIAVEHEYFKDIKFVP

SEQ ID NO: 41099 - protein, 561 aa, Oryza sativa Japonica Group
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKISWLSLHNYYSLTDMIMLQNCTKMFKQVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 41100 - protein, 422 aa, Chlamydomonas reinhardtii
MKQAQKLVTPVLEAFAQNAKRGFASQRFAARASEEVVAVDNAARKGCDGVLEVPSRLLMGPGPANAYPRILTAQALPLLGHMHPPFLKIMDELSEGLRYTFQTKSKYTLMVSGTGHAGMEAAIANLVEPGDKVLVGNAGIWGERVGILSRRYNADVIELKTPAGTTFSYETLKAALTQHKPKVLFLCQGESSTGTHQSLAGLGEVCRQTGTLLLVDTVCSLGGVPLFADQWGVDCIYSGSQKCLSGPPGASPFFMSERAMEALQKRKSPPATYNLDMNLIGDYWGWFGKRSYHHTGPVSTFYAMREALAIVSEEGLEKLWQRHQDMHHRLWDGLRSMGLKPFVEKDEDRLITVNTIKVPEGVDWAAVVKHAMDTYSLEIAGGLGPTAGKVWRVGIMGFNAKPQNVDLVLTAFQDGLKRQGKL

SEQ ID NO: 41101 - protein, 1186 aa, Aspergillus nidulans FGSC A4
MPSILSDADKETVKRSVPKPANKIHAVAVARLFVAYPDPHKWTYTGLQGAVVLANDLVGRTFWLKLVDVSPAGRGVIWDQEIYENFQYNQDRTFFHTFELDDCPAGLSFADEKEAKTFIKKMSEREKNASKETRQTPFASTRGQGPTPVANGKSHGVGRSIFGSLLGRSSAPTHITPAELPPAPTIQVAPPPPAPAATPPRKELPFDTSDPSWKGLLNELEAMGFTEDQIADNADFIKSYIEQKKASEGESATPPADDRKGKAPPPPPPSVPPPKTSAVSPQHTGSSSGSKRGAPPPPPPSRKTPAKTEDDQAPTPPRDPSPPRPRFRAPPPIADAGKYAHTAGQAPPARPRAASGATPGPPPPPRPPKAPVDDAPPRFGVPPPFQGERKVSAPPAPPSRSPAGPPPPPPRTASPATPPQLPPKVPAFSSGPPPPPPRSPASQPPPPPPVPGASRPVPPPTASVPPPPPPPARPTPTVTGPPPPPPPPPASSGPPMPPPPPPPAPGSSAPPPPPPPPPGAGAPPPPPPPPGAGAPPPPPPPPGAGAPPPPPPPGAGAPPPPPGGAAPPLPQPSGGRNDLMAAIRASGGGGLRKVKDSEKKDRSAAMVPGAASESAAATPSTGGGPQGGLAGALQDALAKRKQKVSGSVFCCSLSHIVRGLIAEAMRNIVDPALSVLENLKSGKRLSRSPQSRNFSSTRSRPILRRFWDFRRKKQAAEPRRGPSLLDDTENLSLARALAAKASNELRLRCTEFDINGNVTLMNGEFKKSELIAKYGLLPRDLRKIDSSTLPHIFVRPSTILINLLHLRVLIKADRVLVFDAYGSTDSYMQSLFVYDLEGKLRQKQAQSTGAGSLPYEFRALEAVLISVTTGLEEEFNGVREPVVRVLRALEEDIDRDKLRHLLIYSKKLGTFEQKARLVRDAIDDLLEADDDLASMYLTERANGFQREEHDHQEVEMLLESYHKVCDEIVQASGNLVTSIRNTEEVVKAILDANRNSLMLLDLKFSIGTLGLATGTLFSALYGMNLKNFIEESDLGFGAVSVTCFAISALVCVYGLAKLRKLQRVRMWGEAGVGGTPIIPLHSSRASAVPGHRANWRADSIEPVWGSLPGEGRAERMKRLKDSSAAAAARSAASNAASTRAASLRRAIRFPSDSAVKGKENQKDAAAAVGADADTGVQTQSGGSTAA

SEQ ID NO: 41102 - protein, 113 aa, Populus tremula
AEEGQVIACHTVDTWKEHFEKGKGSQKLIVVDFTASWCPPCKMIAPIFAELAKKFPNVTFLKVDVDELKAVAEEWNVEAMPTFIFLKDGKLVDKTVGADKDGLPTLVAKHATA

SEQ ID NO: 41103 - protein, 134 aa, Triticum aestivum
MAGRGKTIGSGVAKKATSRSSKAGLQFPVGRIARFLKNGKYAERVGAGAPVYLAAVLEYLAAEVLELAGNAARDNKKTRIVPRHIQLAVRNDEELSKLLGDVTIANGGVMPNIHNLLLPKKAGGASKPSGDDHE

SEQ ID NO: 41104 - protein, 355 aa, Oryza sativa
  misc_feature (33)..(33): Xaa can be any naturally occurring amino acid
  misc_feature (46)..(46): Xaa can be any naturally occurring amino acid
NKDYSKELIETAHRICTAGKGILAADESPGSVXKKFKGIGLENNAXNRRRYREMLLTSPGLEHYISGVIFQEETAKQATKDGVNFLQYVTNLGIVPGIKVDKGLGILDNGKEENFTKGLEALPAMAAEFYALGCRFAKWRAVLKIGDGCPTDLSISENATGLAKYALICQQNGLVPIVEPEILSDGPHSAEESQKITEKVLSAVFRALADHKILLEGCLLKPNMVTYGSEHPNKKNNNIVEEAVRTVRALSRTVPPALTGITFPFRRTNPIVASLHLNSMNQLTHQKTFGSSAPPSGGPLQNSSIKAGGRHHAHRTAGQEAFIGRGKGNLEAHLGKTKAPGPNNHGIIFQGPFLF

SEQ ID NO: 41105 - protein, 101 aa, Triticum aestivum
  misc_feature (3)..(5): Xaa can be any naturally occurring amino acid
  misc_feature (9)..(9): Xaa can be any naturally occurring amino acid
  misc_feature (13)..(13): Xaa can be any naturally occurring amino acid
  misc_feature (17)..(17): Xaa can be any naturally occurring amino acid
  misc_feature (29)..(29): Xaa can be any naturally occurring amino acid
FFXXXQYSXGRGXEYMXIMIMACTLPVTXVHFPQWGSMFFPASADATEEEYYGSEWSEEEKRNGLHIAGQKFAENSRSERGRRNVILATSATPPNNTPQHV

SEQ ID NO: 41106 - protein, 355 aa, Coccidioides immitis RS
MAESNGNGASAVGHESINTDIITLTRFLTEEQTKHPEATGDFTLLCHALQFSFKSIAYYIRRASLINLTGLAGSSNTTGDDQKKLDVIGNDLFVASMRGSGKCRILVSEEEDEAILFNECKGARYAVVCDPIDGSSNLDAGVSVGTIFGIFQLPEEVLSENYTVSAKDILLPGTELVASGFTMYGASAQLVITMKGGTVNGFTLENSLGEFILTHPNMRLPAKRAIYSVNEGNSMYWEEWVKAYFHELKFPANGGKPYSSRYIGSMVADAYRTLLYGGIFAYPADSKSPKGKLRILYECAPMAMVFENAGGQAVNSSMQRLLEVVPESIHDRSGIFLGSFDEVQKVIDTHKKFVN

SEQ ID NO: 41107 - protein, 187 aa, Oryza sativa
MAAGALLLANPAAPTARHQHRLLQQRRQPRLLASSRPPRWRLSAVQETKEGEAQTAEEITEKYGLEFGLWKVFSSKDGEEEEGKTRKSRTEQAKELLAKYGGAYLATSITLSLISFTLCYLLVSAGVDVQDLLGKVGIATGETGGKVGTFALAYAAHKAASPIRFPPTVALTPVVASWIGRIKKGGD

SEQ ID NO: 41108 - protein, 498 aa, Verbascum thapsus
  misc_feature (1)..(10): Xaa can be any naturally occurring amino acid
  misc_feature (317)..(317): Xaa can be any naturally occurring amino acid
XXXXXXXXXXGVSTLEKKNLGRIVQIIGPVLDVAFPPGKMPNIYNALVVKGRDTAGQPINVTCEVQQLLGNNRVRAVAMSATDGLTRGMEVIDTGAPLSVPVGGATLGRIFNVLGEPVDNLGPVDTSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINQENIAESKVALVYGQMNEPPGARMRVGLTALTMAEYFRDVNEQDVLLFIDNIFRFVQAGSEVSALLGRMPSAVGYQPTLSTEMGSLQERITSTXEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 41109 - protein, 211 aa, Ostreococcus tauri
MGGAVSAARSLFDKYFGNVDMRVVMLGLDAAGKTTILYKLHIGEVLSTVPTLGFNVEKVQYKNVVFTVWDVGGQEKLRPLWRHYFNNTDGLIFVVDCLDRDRMERAKEEFYSIVNDAFMRNSAILIFANKQDLRGALTTAELVEAFDLPSLKGRRWHVQASCATQGLGLYEGLDWLSSTLVKMRRNGLITSVGSSGEKHGQGRQGRDARFM

SEQ ID NO: 41110 - protein, 363 aa, Prochlorococcus marinus str. MIT 9301
MLKAGIIGLPNVGKSTLFNALVENAKAQAANFPFCTIEPNKGIVSVPDQRLQELGNLSCSQNIIPTKIEFVDIAGLVKGASKGEGLGNKFLSNIREVDAIVHVVRCFEDSDVIHVSGKVDPLDDIEIINLELNLADLSQLQKRRERIKKQVRTSKEAAKEDTLLEKIEEELEKGLSVRSISLNEEENLIIKQLGFLTAKPIIYATNLNENDLAEGNDFSSTVQSFASNENTECIKISAQVESELIELEPEDKKDYLIGLGVEEGGLSSLIRSTYKLLGLKTYFTTGEKETKAWTIKDGMTAPQAAGVIHTDFEKGFIRAQTISYQNLIDSGSIANAKTKGLLRSEGKEYIVNEGDVMEFLFNV

SEQ ID NO: 41111 - protein, 233 aa, Vitis vinifera
MSFTSNTEGEDFNGAEHSLKLTTPMGEFYDAWEELSSEGAQQPSHREIEDEMREIRLSLLTEIEKRKQAEEALKNMRNVWQTISQQLSLVGLTLPADLADGQPDVDIAQELSQQVSIARFVSDSIGRGIAKAQVEMEMEAQIDSKNFEIARLWDRLHYYDAVNREMSQRNQEGLELARRERQLRKRRQRWVWGSIAAVITVGTAALAWSYLPTGQGSSGEDHFEASEHDHETK

SEQ ID NO: 41112 - protein, 254 aa, Oryza sativa Japonica Group
MSQGQPRRPPPDGSGARPVMYGDVFDVSGELAGQPVAPRDAAKLQSAEEAVLGEAQKGGPAAAMQSAAAINARAGHVGRAQVTGAIADEGVAVAVAETELPGRRVVTESVAGQVVARLATPPRVVATQPSGSLDKDAVTIGRALEWRPRPPRRRVSRWTRATRRQSRPPRCSPRGAPSPSPEASPPRRRLRRTTTPRPRHATRTGSSSGTSSRGRGASCRRTRRRRGRTRRGCRRPRCGTGRTWRRRRAAWRTR

SEQ ID NO: 41113 - protein, 379 aa, Glycine max
MASSLGFEFLTKKPYSPPSWASHLHPLPSHFFSLAHLPTPIHRWNLPNLPTNTELWIKRDDLSGMQLSGNKVRKLEFLMADAIAQGADSIITIGGIQSNHCRATAVAAKYLNLDCFLILRTSDLLVDQDPGLTGNLLVERMVGAHVHLISKQEYAKIGSVTLTNVLKEKLIKEGRRPYVIPVGGSNSLGTWGYIEAVREIEQQIQKGTGNVKFDDIVVACGSGGTIAGLSLGSSLSALKARVHAFSVCDDPDYFHNFAQGLLDGLKAGVSSRDIVHIQNAKGLGYAMNTSEELNFVKEVAATTGVVLDPVYSGKAAYAMLKDMSENPKKWERRKILFIHTGGLLGLYDKVDQLASFVGNWQRMDVNESVPRQDGIGKMF

SEQ ID NO: 41114 - protein, 181 aa, Shewanella oneidensis MR-1
MNTETLSLIKQSIKTIPNYPKEGILFRDVTSLLENATAYKATIDLLVEHYRSKGFTKIVGTEARGFLFGAPLALGLGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 41115 - protein, 469 aa, Photobacterium profundum SS9
MTKNKKPTHFDAIIIGSGPGGEGAAMGLTKAGLNVAVIERENSVGGGCTHWGTIPSKALRHAVSRIIEYNQNPLYCKNNSSLHSTFSQILGHAQDVVNKQTRMRQGFYDRNKCSLIFGEASFIDAHTVRVKNADNSTDLYSADKFVIATGSRPYHPEGVDFDHSRVYDSDSILQLEHDPRHIIIYGAGVIGSEYASIFRGLGVKVDLINTRHRLLEFLDNEISDSLSYHLWNSGAMIRNGETFEKIEGTDDSIILHLESGKKMRADCLLYANGRTGNTDKLNLNKVGLTPDSRGQLAVNQNYCTDVDHVYAVGDVIGYPSLASAAYDQGRFVAQAITTGEAQGSLIDHIPTGIYTIPEISSVGKTEQQLTADKVPYEVGRSQFKHLARAQIAGTEVGSLKILFHRETKEILGIHCFGERAAEIIHIGQAIMEQKGDGNTIDYFVNTTFNYPTMAEAYRVAALNGLNRLF

SEQ ID NO: 41116 - protein, 1002 aa, Shewanella oneidensis MR-1
MSYQVLARKWRPATFEQMVGQSHVLHALTNALTQQRLHHAYLFTGTRGVGKTSLARLFAKGLNCETGVTASPCGVCGSCVEIAQGRFVDLIEVDAASRTKVDDTRELLDNVQYRPTRGRFKVYLIDEVHMLSRSSFNALLKTLEEPPEHVKFLLATTDPQKLPVTVLSRCLQFNLKSLTQQEIGTQLQHILTQEQLPFEHEALGLLAKSANGSMRDALSLTDQAIAFGGGTVMLNQVQSMLGSIDEQHVLGLLKALTDADIGALMQSCAQVLAYGADAQEVLRSLLELLHQITLTQFAPAAAQQSLYSAQIQAFAEQLAPEQVQLYYQILLTGRKDLPHAPDPKSGLEMALLRAVAFVPEKSVKRWQVDDAVKVDLSAQPALTPQATIPPEVPAERQLAVNAPVAEKKTLLATVANPEAQLQAETTPETALEDDEPELNAALIAEQQVILSQAQSQGFGASADPVVSSNTALNQDVNSSDPTDPDTALTEQTATEDVLDAQNTAGDLAPEPYVAEAYGQYDYAQSNDAQSNYAQFNHAQSYDTSTPLDAYQDDYAHFMSEDAAEQLIISEHAVEQLSASEGNLFSNGSAQHSASNQTGQVFAVDNTQVAKAAVSLEDDDILSAVLAARESLLSDLDALSTKDGDGKKLSPDVKAKTPTSNAHSRPATSVNVSPRPGQNAVTLEFESDFELPFDDDFEAEIYTKPELSTKATNAPLAPLSTRPITHSIIVPSTQQSAAAQHLPLDPNDRPPWEDAPVAECHHGNAEPITTSRQVNEESHLRQESAALHAPLLAVEPVQVAPALTLPTNTQAAQVEQAAGQSHQLNHPDEVPATPPRELDAAAPPAPASDLTVAQSITGHPLDLHWYKLMASLDIGGRVRQLAVNSICQVQSNPLPLLLKPDQKHLAAQVAIEQLEQALTAALGAPRQVEVVIGTDPSRETPLELRKRFHQELLQQARQSLIMDDNVQWLINRFGAELENDSLLYPPELLNQRSGLIPALPEPE

SEQ ID NO: 41117 - protein, 277 aa, Photobacterium profundum SS9
MELSHLIPSVVDIARESGQVILDIYQRGQFEKYIKQDNTPVTSADLAAHKLVVERLTELTPNIPVLSEEDATVPLKERSKWDRYWLVDPLDGTQEFIAGSGDFATIIALVEGNKPIMGVVYAPVSGVVYYAYSGKGAWKITPEGETVRISTHKHELPTQSIAVAISRRQDISAITNRLDPALNYELVPLGSAALKACLVAEGAVDCYLRLGPTGEWDTAATQCIVEEAGGRILNTHLNPLSYNERDTLENPNFITLGDESLPWADILTPDNRLIDVQ

SEQ ID NO: 41118 - protein, 418 aa, Haloarcula marismortui ATCC 43049
MSPEVNPFESLQEQIDDASDYLEYSTDVLERLKHPERVLETNLSVEMDDGSVEVFRAYRSQFNGDRGPYKGGIRYHPQVTRDEVKALSGWMVYKCAAVNIPYGGGKGGIEIDPRQYSASEIERITRSFAKELRLIIGEDRDIPAPDVNTGQREMNWIKDTYETLENTTEPGVITGKAPESGGSAGRVEATGRSVMLTAREAFDYLGKDIEDATVAVQGYGNAGSVAAKLIEDLGANIVAVSDSSGAVYNPDGLGARDAKAFKSETGSLAGYEGATEELTNEELLTMDVDLLVPAALENAIDGDLARDVQADIVVEAANGPLTPNADDVFTERDVAVFPDILANAGGVTVSYFEWVQNRQRFYWSEERVNDELETIITNAFDDLVETYEETGAPNFRTAMYVVAIQRVVAAAEEGGIWP

SEQ ID NO: 41119 - protein, 438 aa, Zea mays
MAPAPALTATSVLKRSHLPGVHSLACRRQPGADRVSVLSPAIPPPRVSWQQGSGVVAKRLLWASASGSFEKDNIGEDAVLPSQIAVENKVDFLKILKSANSIIPHIVLGSTILALVYPPSFTWFTTRYYAPALGFLMFAVGVNSSAKDFIEAIKRPDAIAAGYIGQFVIKPLFGFLFGTLAVAVLNLPAALGKKLSSCIFICFRISIAAYVVNSDVNLSVGAGIMLVSCVSGAQLSNYATFLTDPHMAPLSIVMTSLSTATAVFVTPTLSYFLIGQKLPVDVKGMMSSIVQIVVAPIAAGLLLNRFLPRLCAAIQPFLPSMSVFVTALCVGSPLAINIKAVLSPFGLTIVLLLFAFHTSSFVAGYHLAGTWFRKSDDVKALQRTISFETGMQSSLLALALANKFFPDPLVGVPPAISVVLMSLMGFALVMVWSKKREA

SEQ ID NO: 41120 - protein, 389 aa, Arabidopsis thaliana
MSLFVSREEEDGAKVVRVENVDNPYRRQTNFNSRFKLTLNKLYAWALSDYDRVVMLDADNLFLKKADELFQCGRFCAVFINPCIFHTGLFVLQPSVEVFKDMLHELQVGRKNPDGADQGFLVSYFSDLLDQPLFSPPSNGSVLNGHLRLPLGYQMDASYFYLKLRWNIPCGPNSVITFPGAVWLKPWYWWSWPVLPLGFSWHEQRRATIGYSAEMPLVIIQAMFYLGIIVVTRLARPNITKLCYRRSDRNLTTIQAGFKLIALLSVVAAYIFPFFTIPHTIHPLIGWSLYLMASFALSSISINTLLLPTLPVLTPWLGILGTLLVMAFPWYPDGVVRALSVFAYAFCCAPFVWVSFRKITSHLQVLIEKEVLFPRLGDSGVTSGFSKLY

SEQ ID NO: 41121 - protein, 217 aa, Vibrio fischeri
MKLNQDSLTSKFGSPIERVEQAIKSVQQGNGVLLLDDESRENEGDLIYSVDHLTSEQMALMIRSCSGIVCLCLTEDKADYLELSPMVEHNESVNQTAFTISIEAKKGVTTGVSATDRVTTIKTACKNGALPHELAKPGHVFPLRAKDGGVLTRRGHTEGTVDLMRLAELTPAGVLCEVTNSDGSMAKTPEIIIFAEQHHLPVLTVNDIALYRKEKSN

SEQ ID NO: 41122 - protein, 684 aa, Candida albicans
MPSCDDTASSDTDCQSQVSSTAHLHSYRSNGLVEPPSKRRLTTTNETSLSSAGATTFQIESPGSISAITTNNSTTSAGDSNNSNSFSDQHSRHPRTPNAMNSPTHTPISDIEEDPIQQLPLPSPSASPIQSDTENEHVTTPDSLQGKANLDSIENVMSNEPTTQSELVDLVTKLSGFLSEANQNHLVFKLLQKTTRPTLSTFNNLINNSLKRDILSNVPFEVTMKILSYLDYKTLLSVAQVCKKWFDIINNPDTWIKLLKRDKLITDDAVIKYELQYPDQLLREWSTLPEINSAQVLYKKRKIIVNRWMDPKFKPHRISVSGHGNKVVTCLQHDDEKVVTGVDDKCISIYSTQTGQLMKVLEGHEGGVWALKYTGNTLVTGSTDRTVRVWNMKTGQCTHIFRGHTSTIRCLDIIHPAVIGKNQDGEDIVFPEYPLLITGSRDHNIHVWKLPVVDDSQDYIETFEGEFDNPYLIAVLSGHTQSVRSISGYGNIIISGSYDSTVRVWDLLDDGHCTHVLQGHLDRVYSTAIDFHSKTCFSGSMDSNINVWNFETGELKKVLVGHASLVGLLDLVDDVLVSAAADATLRIWDAKTGELRSKLKGHGAAITCFEHDGLRVVSGSEKMLKLWNVEKGTFARDLLSDVTGGIWQVRFDYKRCVAAVQRIINEDEGETFIEILDFSQPLLQ

SEQ ID NO: 41123 - protein, 409 aa, Zea mays
SSGPRPWTSPMLSVTTVPLQQGGGLSEVSGIRSSASLPMRRNATSDNFMTAVSFRTHAVGTSGGSRRAPTEAMLKVAINGFGRIGRNFLRCWHGRGDALPLDVIVINDTGGVKHASHLLKYDSLLGIFDADAELVGDNAISVDDKVIKVVSDRNPSNLPWGELSVDLFIEGTGVFVDHEGAGKHIQVGAKKVLITAPDKGNIPTYVVGVNADQYNPDEPIISNTSCTTNCRVPFVKVLDQKFGIIKGTMTTTHFYTCDQRLLDASHRDLRRARAAALNIVPTSTSAAKAVVLVLPNLKGKLNGIALWVPTPNVSVLDLVVQVSRKTLAEEVNQAFRDAAANELQGILEVCDVPLVSVDFRCSDFSSTIDASLTMVMGDDMVKVISWYDKEWGYSQRVVDLDDICANQWK

SEQ ID NO: 41124 - protein, 635 aa, Xylella fastidiosa Dixon
MIDSTCYPRLSRIQTPEDLRAFQESELRAVADELRNYLIESVGLSGGHFAAGLGVVELTIALHYLYCTPIDQLVWDVGHQTYPHKILTGRRDKISTVKHQGGLAPFPKREESIYDTFGVGHSSTSISAALGMAIVAQRNGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEVFVTIEDNVVAGGAGSGVAELLNAEGIVLPIVHLGLPDAFQQHASREDLLAEAGIDAAGVYAALLSRWPDLAVQNHPLSAVS

SEQ ID NO: 41125 - protein, 399 aa, Xylella fastidiosa 9a5c
MFELSCNLISGGGIGVPGSQSETPPVTEPAILVLEDGTVFEGDAVGANGLSVGEVVFNTSLTGYQEVLTDPSYAYQLVTLTYPHIGNTGCTDQDDEANKVWAAGLIVRDVPRRPSNWRSQISLSDWLAARGVVAIAGIDTRKLTRILREKGAQHGALMAGEIDVDRAQDAARQFTGIKGMDLAKVVSTKQAYSWYEGQLDLDRNEWKRAAPQYKVVAYDYGVKLNILRMLAERGCDLTVVPAQTPVDEVLALCPDGVFLSNGPGDPEPCDYAVAAIKTFIMRRVPIFGICLGHQLLAQTVGAKVVKMRHGHHGANHPVQDLRSGRVMITSQNHGFAVDEATLPSNVRVTHRSLFDGTNQGIELLDVPAFSFQGHPEASPGPHDVDVLFDRFITMMAAQS

SEQ ID NO: 41126 - protein, 257 aa, Saccharomyces cerevisiae
MSTGITYGEDRKTQLIAQYESVREVVNAEAKNVHVNENASKILLLVVSKLKPASDIQILYDHGVREFGENYVQELIEKAKLLPDDIKWHFIGGLQTNKCKDLAKVPNLYSVETIDSLKKAKKLNESRAKFQPDCNPILCNVQINTSHEDQKSGLNNEAEIFEVIDFFLSEECKYIKLNGLMTIGSWNVSHEDSKENRDFATLVEWKKKIDAKFGTSLKLSMGMSADFREAIRQGTAEVRIGTDIFGARPPKNEARII

SEQ ID NO: 41127 - protein, 977 aa, Neurospora crassa
MTGLRIGWGSVLLVLALVLVVLPDKAAAFGAGNIPSIAQVEGHNWRHGDIEDVLKTLAFINGKKWTTMMVGRTYFGNWLRDYSQAIDVGSLKGVNAATIRIIASLSSHLRRALVWVLSFLAHGYATEEFEVTEERLGVYRPEEHIDNPLGYADGKDAREFDPRLRGPVHPGELEIDLYSGMKNYIANERLAYQQGWNTTSAGYIRFSLERCIHFGRLYTSGSRGRGKESDLCEALRCLGQALHTLEDFPAHSNYCELVLIDMEERRGGHSPVFPHVGTDTRITLRNDTRNNGKSVWPLVTGTFGGVDFLHSVLGEANDHFTQSEVDEMNDALLTAEQLTKGSGGGSSRDRGLSLFGLNLGGSSSNDGDFISLVSKLPGVGDGYASTARSLKAASEAQEQENSRSAGNVNVVPGMSPNFDPVKTAAKIYPILEFRDKIVRSINNMIEKIPGLESLLEKISETLTAFILGLLAPFLRPIINQVTQVLKEGSSGLIATSAKQQLEPWNNPQCDNPTHSMLSKDHFTNILNSCAGRVAANIVQYVVPRVVYAWENPGVPDSEVIADVLQVFHHPANYKEEVEIQRTMYETVVQWSRETHHDYKTLLASESVKEGHNHVLNGQPMDRGPGGGHTSCGADGGHGKVAGSLWSKIQSRDLDTSAPSGGVGGGRPSSSTGHKYGYSASSSHHEVPTHGEAASYFSSADPRHASPPTDRYYGSRPSSSGYGSSVHGSGRPSPAPASFGYHHGGHQAYEGSSSSYPSQPSYGGSSGPSYGGSSGPSYGGFSQPSYGSQPSYSSQPSYGAPPSQPPYGSQPHYGGPPHSSYSGGRPPSPPRPSGYGGGYAGYSAGPPPSHGGYGGSPHGGAPYPHGGAVGGGGSAPYPHGGRADAYERNYDQHYERDERRGGRDGRRRRGSHGSRSSSEERDGRGYPGQGSRGSGHHGGGGGYGGGYGGGYGGGYGGGYGGGGGYGGSYGGRDEHRRY

SEQ ID NO: 41128 - protein, 194 aa, Oryza eichingeri
VLYARVRTNGVVQIQFSPVGENKRGGEVYRLYDVGGQRNERRKWIHLFEGVNAVIFCAAISEYDQMLFEDETKNRMMETKELFDWVLKQRCFEKTSFMLFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGI

SEQ ID NO: 41129 - protein, 239 aa, Aspergillus nidulans FGSC A4
MAPRCFIIRHGETEWSLNGRHTGITDLPLTENGEKRIKATGKALVGNDRLIAPKKLVHVYVSPRTRAQRTLELLEIGCRERLPWTEKRKAESDEPIRTEAKVEITEAIREWDYGDYEGLTSKQIRERRAEQGEGSWDIWRDGCPGGESPEDVMKRLDALIAEIREKHHKPCFEGNKESGDVLIVAHGHILRAFAMRWTGRPLTETALILEAGGVGTLSYEHHNIEEPAIILGGGFVVEN

SEQ ID NO: 41130 - protein, 263 aa, Marinobacter sp. ELB17
MNADDYAFRFGGIERLYGRSALGAFRQAHIAIVGLGGVGSWAAEALARSGIGTLTLIDMDDICVSNTNRQLHALSGQYGKTKTDAMAERLRAINPAADIRTQFAFITIDNIPQRITADITGVIDAIDSVKPKAALLAYCQRNKLPIVCAGGAGGQMDPTQIRVADLSKTTQDPLLAKVRNLLRRQYGFSRNPQRRFGIEAVYSLEQLTYPAADGTTCLQKPVNAGPVRLDCATGFGAASPVTASFGFFAASRLLNKIAQRAQP

SEQ ID NO: 41131 - protein, 441 aa, Glycine max
YSCTPLISPRTHFIFPKRSQLCFNLEDSSFSVPVSWASLGIGNHRHRKAWTRTSLILTAFFTVLLNTSNSVPLKEQKIFAYETLAAATKNFSAIHKLGEGGFGPVYKGKLNDGREIAVKKLSHTSNQGKKEFMNEAKLLARVQHRNVVNLVGYCVHGTEKLLVYEYVAHESLDKLLFIKSQKREQLDWKRRIGIITGVAKGLLYLHEDSHNCIIHRDIKASNILLDDKWTPKIADFGMARLFPEDQSQVHTRVAGTNGYMAPEYVMHGNLSVKADVFSYGVLVLELITGQRNSSFNLDVDAQNLLDWAYKMYKKGKSLEIVDSALASTIVAEEVAMCVQLGLLCTQGDPQLRPTMRRVVVMLSRKPGNMQEPTRPGVPGSRYRRPRRHSALSSTVGTSGASDSHTSDSSNNYNTTVTTSATGTISATAETDPKGKRPIREG

SEQ ID NO: 41132 - protein, 278 aa, Oryza sativa
MAASHGNAIFVLLLCTLFLPSLACDSGGVKFGYTGSIGPDFWGNLSADFTRCSNGKQQSPIDIDTNNLVHELNMEPLHRNYTAANATLVDNIFNVALRYEEAAGVLSINGVKYTLKQMHWHSPSEHTINGFRFPLELHMVHTNENGNITVLAFLYRFGRPDPFFEQIQDKLAALNAEGCKAEKGSPVPAGSVSLLTMRQHVHIYYRYVGSLTTPPCAENVIWNIPAMPREMTPQQAADLMAPLDEGYRRNSRPTQQMNGRTVQLYHRFWGKKKRRSSP

SEQ ID NO: 41133 - protein, 77 aa, Glycine max
MASKLQKLQATASQASQFVSSRGTNYYKQLLEQNKQHIQEPPTVEKCNLLAKQLFYTRLASIPSRNESFWKELDYAK

SEQ ID NO: 41134 - protein, 249 aa, Pyrococcus furiosus DSM 3638
MRVVKIGGSVISMLENLWRENGISEILGNSVIVHGGSRHVDELSRKMGVKIEKLTSPSGVTFRRTTKEVLKVYVAAMIRANKEIVEFLRNQGINAIGLTGLDRELIIGERKKLIKAVINGRVVAIRDDYSGVIKKVNTQILREYLKIGTPVIASIAYDPIENTPLNVDGDKVAYHVALAMDAKELYFLSDTAFMAGGKVVSELPADEIEKYLIFAKGGMKKKLLMAKEAINSGIKNVVIEGLNGRTVIY

SEQ ID NO: 41135 - protein, 388 aa, Nostoc sp. PCC 7120
MPLSDAMPALLVLADGTAYRGWSFGATGTTIGEVVFNTGMTGYQEVLTDPSYRGQIVVFTYPELGNTGVNPEDEESARPQVRGAIARNICHKPSNWRSTQSLPDYLKQHHIPGIFGIDTRALTRKIRMYGAMNGGISTEILDEAELLEQVQAAPNMAGLNLVREVTTSTVYEWSDPTTAVWEFNPDGTVKNGESLTVVALDFGVKRNILRRLASYGCRVIVVPADTSPEEILKYNPDGIFLSNGPGDPSAVTEGITTAKALLESEKPIFGICMGHQILGHALGAETFKLKFGHRGLNQPAGLTQRVEITSQNHSFAIDPDSLPEAVVEISHLNLNDRTVAGLRHKSLPIFSVQYHPEASPGPHDADYLFAQFVHQMRTTKQATTAEVS

SEQ ID NO: 41136 - protein, 232 aa, Vitis vinifera
MIIDYILHFYLVVVKEEMANHDGEISSKTSGFPHHVVLNERILSSMSRRSIAAHPWHDLEIGPGAPSVFNCVVEIGKGSKVKYELDKASGLIKVDRVLYSSVVYPHNYGFIPRTICEDSDPMDVLILMQEPVLPGSFLRARAIGLMPMIDQGEKDDKIIAVCADDPEFRHYKDIKEIPPHRLAEIRRFFEDYKKNENKEVNVNDFLPADSAIEAIKYSMDLYASYIVESLRQ

SEQ ID NO: 41137 - protein, 488 aa, Zea mays
  misc_feature (47)..(47): Xaa can be any naturally occurring amino acid
MAPPQTIPRRGLFIGGAWREPCLGRRLPVVNPATEATIGDIPAGTAXRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 41138 - protein, 478 aa, Ralstonia metallidurans CH34
MHAQHFVANRLIAPDSGLRIKVFDPSSGQPFAEIARGNATDINVAVHAARRAFDGAWGAMSPADRVRLLNRVALTLIEHEDELAALEARDTGKPLRQARADARAVARYFEFYAGAADKLHGQTIPYQAGYTVLTVREPHGVTGHIIPWNYPLQIFGRSVGAALAAGNACVVKPAEDACLSLLRVAELAAEAGLPEGALNIVTGYGHEAGAALARHPDINHISFTGSPETGKLVSQLAAENHVPVTLELGGKSPQIVFADADLDALLPVVVNGIVQNAGQTCSAGSRLLVERPVYEELLDRVASVFESLRVGPSELDLECGPLISRKQQQRVWDFVSDAQHAGISVMAQGQIVAEAPESGYYQVPMLFRDVPATHRLAQEEVFGPLLAAMPFDTEDEALQLANGTAYGLVAGVWTRDGGRQLRLARKLRAGQVFINNYGAGGGVELPFGGTGQSGYGREKGFEALYGFTTLKTIAIQHG

SEQ ID NO: 41139 - protein, 175 aa, Ralstonia metallidurans CH34
MSFNLVSPGKDLPNDFNVIIEISAQSDPVKYEADKETGLLFVDRFIGTGMRYPANYGFIPQTLSGDGDPVDVLVITPFPILAGAVVRCRALGMLKMTDESGVDAKLVAIPVDKLCPATAHMKGLSDVPQNTLDQIKHFFENYKALEAGKWVKVEGWAGIEEAHKEISDGVANFKK

SEQ ID NO: 41140 - protein, 396 aa, Coprinopsis cinerea okayama7#130
MSTTITASAYDISTNLKASLAQIRNTTNLSTWTLVLATVLTVGVWLRLSRQNDSKKNLGYSSGRAVGNGTSAEILKPLQVRVSRILIHPIKSCRGISVQKALYTPEGMEFDRLWAIIDTAKQAIITAREVPKMVLITPQIERDDSSPHLGRLVVSVPLASGTETFSIPLRPSEDILRGWEVLPQIRIFPNQGPVDGYICNSLEGRTPSDVLSDYFGKPVQLVYKGPRTRHSDPTVEFPNLKATAKYQDMYPLLVLSEESTSVVDQHIRNHVGTQGIDERWKTDTVVIERFRPNIVFSGGGPFAEDNWEEISIGTEDAPTITLVSKCTRCLLPNVSPETGERDAAVPYKVLMKFRTGLDPKQKLKPCVGCNAVPGGNGVVSVGDWVFVKKVSKPLVT

SEQ ID NO: 41141 - protein, 291 aa, Schizosaccharomyces pombe 972h-
MSRHLETSLNNKEFVLNSLEKGLRLDGRQLSDFRSLEIQFGKEYGQVDVSFGHTRVMARITTEITKPYTDRPFDGIFSITTELTPLAYSAFEAGRVSDQEIVISRLIEKAVRRSNALDTESLCIISGQKCWHVRASVHFINHDGNLVDAACIAVIAALCHFRRPELTVVGEEVTVHPVEERVPVPLSILHMPICVTFSFFNNGELAIVDATLEEEDLCNGSMTITLNKNREVCQIYKAGGIIIDPSKIISCAKTAFDIAVSVCSVIQQALDEDLRKKETQYLGGSAENERS

SEQ ID NO: 41142 - protein, 398 aa, Schizosaccharomyces pombe 972h-
MAYNHFSIPKNIEEKENSFFDVTFQDEPDETTSTATGIAKVSIPTPKPSTPLSTLTNGSTIQQSMTNQPEPTSQVPPISAKPPMDDATYATQQLTLRALLSTREAGIIIGKAGKNVAELRSTTNVKAGVTKAVPNVHDRVLTISGPLENVVRAYRFIIDIFAKNSTNPDGTPSDANTPRKLRLLIAHSLMGSIIGRNGLRIKLIQDKCSCRMIASKDMLPQSTERTVEIHGTVDNLHAAIWEIGKCLIDDWERGAGTVFYNPVSRLTQPLPSLASTASPQQVSPPAAPSTTSGEAIPENFVSYGAQVFPATQMPFLQQPKVTQNISIPADMVGCIIGRGGSKISEIRRTSGSKISIAKEPHDETGERMFTITGTHEENEKALFLLYQQLEMEKDRRSH

SEQ ID NO: 41143 - protein, 463 aa, Achromobacter denitrificans
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEEGARIAGWKDSVKALFGGQLSKITPALWGAFVCSSVTVFFLASWIPVLTVGTGRSASLAAVGLALFSAGGRFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 41144 - protein, 145 aa, Physcomitrella patens subsp. patens
MAAAAMTSIVPVASIAPVSKVANVRPSSVSVAKAFGLKSRSMGRLTCMATYKVTFLDGETGAENVVECSDEEYVLDAAERAGMDLPYSCRAGACSSCAGIIKAGEVDQSDQSFLDDSQIDDGFVLTCVAYPASDCIILTHQEENM

SEQ ID NO: 41145 - protein, 757 aa, Haloarcula marismortui ATCC 43049
MRLTVKPLKQKDAGRGLAAIDRAAMDELELENGDYIVLEGKQDSRAVARVWPGYPEDEGNGIVRIDGQLRQEANVGIDDPVNIEKADVNPATSVTVALPQNLRVRGNVGPMIRNNLSGQAVTQGQTVPVSFGLGPLSSMSGQKIPLKIAETEPSGTVVVTDSTDIQVSEMPAEQVHSGEGAPEASDTPDVTYEDIGGLDRELEQVREMIELPMRHPELFQQLGIEPPKGVLLHGPPGTGKTLMAKAVANEIDAYFTTISGPEIMSKYYGESEEQLREVFDEASENAPAIVFIDEIDSIAPKRGETQGDVERRVVAQLLSLMDGLEERGQVIVIGATNRVDDIDPALRRGGRFDREIEIGVPDKKGRKEILQVHTRGMPLSEEINIENYAENTHGFVGADLATLTKESAMNALRRIRPELDLESDEIDAEVLERLEISDKDFREAMKGIEPSALREVFVEVPDVTWDSVGGLEDTKERLRETIQWPLEYEDVFESMDLEAAKGVLMYGPPGTGKTLLAKAVANEAQSNFISVKGPELLNKFVGESEKGVREVFSKARENAPTVVFFDEIDSIAGERGGGTTDSGVGERVVSQLLTELDGIEDMENVVVVATTNRPDLIDDALLRPGRLDRHVHVPVPDEEARRAIFQVHTRDKPLADGVDLDELASRTDGYVGADIEAVAREASMAATREFINSVDPEDIGDSVSNVRVTMDHFEHALSEVGPSVTEETRERYDEIEQRFDRAEPGVTDESTASRTFQ

SEQ ID NO: 41146 - protein, 507 aa, Xylella fastidiosa Dixon
MTIHNFDLLVVGGGINGTGIARDAAGRHLSVCLCEQHDLASHTSSASTKLIHGGLRYLEYYEFALVSKALAEREILLRQAPHIVRPLHFILPHQPHLRPTWIIRAGLLLYDHLGFSRRTLPSSRRLNLAQHPAGQPLKQELHTGFMYCDAQVQDARLVVLNAMDAAQRGARILTRTRCVRTRRDGAHWLTELEDAQGRHQQIRTRAIVNAAGPWAVTFLDHIAQQPHQHTLRLVKGSHIVVPRLFEHEHAYIFQEPDRRIVFAIPYEQHFTLIGTTDVDYVADPANPHIDAAETIYLCNAVNAYFRQQITPEDVLWSYSGVRPLLNDGHNNASKVTRDYQLEILGNSAPLLNVFGGKLTTYRKLSEEAVNQLCVALDHPYRAWTANGPPLPGGEHHDIAALQNTLRQHRPWLPTATAQRLIHNYGTCAETLLGNATNLHTLGIHFGADLYQAEVDYLRTHEWACSAEDILWRRSKLGLHLDAHSTQRLEDYLRSCSRIPDHADTTTQ

SEQ ID NO: 41147 - protein, 339 aa, Brassica napus
  misc_feature (167)..(167): Xaa can be any naturally occurring amino acid
MAGGKIKIGINGFGRIGRLVARVVLQRDDVELVAVNDPFITTEYMTYMFKYDSVHGQWKHHELKVKDEKTLLFGEKPVTVFGIRNPEDIPWAEAGADFVVESTGVFTDKDKAAAHLKGGAKKVVISAPSKDAPMFVVGVNEHEYKSDLDIVSNASCTTNCLAPLAKXVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDSRSSIFDAKAGIALSDNFVKLVSWYDNEWGYSTRVVDLIVHMSKC

SEQ ID NO: 41148 - protein, 616 aa, Marinobacter sp. ELB17
MPVSTVWLLASIGVLSLFCQWLAWRVRMPAILFLLAGGIASGPVLGYLNPEDVFGDLLFPMVSLAVAIILFEGSLTLRFAEIRGHGKMVRNLLPIGAIVTGTIGTLSAHYILGISWEIALLFGAISIVTGPTVIAPLLRSVRPSSKLANILQWEGIIIDPIGALLAVLVFEGIVSWGQGNVFGHSLYIFAKTIAVGTFLGAAAGYLNGQVLRKHWIPQYLHNAGTLTFMLGVYALSNELAHESGLLTVTIMGIWMANMKQVPVDSILEFKESLSVLLISALFIILAARIEFSAIADLGWGLAWVLAILMLVARPLSIFLSAIGTSLNWREKLFLSWIAPRGIVAAAVSALFAFQLQKVGYDGAGALVPLVFMLIIATVTIQSLTARPLANLLNVAEPSEFGFLILGANPVARMIGLTLKKHEVPVVLADTNWENVRQARMENLQVYFGNPVSEHASNQLDLTGVGNLLVISPYKHMNSLATYHFLDWFGDNCVYSLAEGDQDQKARHQTAEKIQQTRGLFNGVSYAKLASLVSQGYSVKTTELSDEFSYQKFLDKYQSQALVLFMFDGKGRITPVKSMDKLKPDEDFTLISLVPARAPKERKERKDRDNAEGNGAK

SEQ ID NO: 41149 - protein, 472 aa, Bradyrhizobium sp. BTAi1
MRRHRRAKIVATVGPASNSPEMLKALFLAGVDTFRLNFSHGTQADHAKVHAAIRALEKDVQRPIGILMDLQGPKIRVGTLRDKKIQVESGETIRFVLNGTEGDKTSIPLPHPEIFAAVAPGHDLLIDDGRVRVRVTGLGDDWIEAKVIVSGTISNHKGINLPGTILELSPLTPKDRSDLAFGLELGVDWVALSFVQKPSDVLEARGLINGRAGIMSKIEKPAALDRIDDIIQLSDAIMVARGDLGVEIPNEDVPGKQKELVRACRLAVKPVIVATQMLDSMVATPTPTRAEVSDVATAIYDGADAVMLSAESASGQYPREAVAMMDSIIKATEGHKMYRSIVEATQPGEEQTPPHAVATAAADLASAIHAKAIVAYTSSGTSASRVARKRPSLPILAITPNEDTSRRMCLLWGAHSVLSQDVQSYEEMVERATFFAVQEEFAQTGDLLVVVAGIPFAQAGTTNNLRVVTVPR

SEQ ID NO: 41150 - protein, 357 aa, Bradyrhizobium sp. BTAi1
MRTHSIAAIPADGIGPEVISAGVRVLEALAKRSGDISFNVKTFDWGSDYYKKNGVMMPADGLAELKKFDAIYFGAVGAPDVPDHITLWGLRLPICQGFDQYANVRPTKILPGVSSPLRNVGVGDLDWVIVRENSEGEYAGMGGRAHRGLPEEVGTEVAVFTRIGVTRIMRFAFKLAQSRPRKFLTVVTKSNAQRHGMVMWDEIAAEVAREFPDVTWDKMLVDAMTVRMTLQPKSLDTIVATNLHADILSDLAGALAGSLGVAPTGNIDPERRFPSMFEPIHGSAFDITGKGIANPVATFWTGAQMLEHLGEKEAATRLMAAVEKVCAAGILTPDVGGKATTKEVTDAVIDAIHGSNV

SEQ ID NO: 41151 - protein, 264 aa, Oryza sativa
  misc_feature (192)..(192): Xaa can be any naturally occurring amino acid
MQVWSGILYPRLPRVVPRRRIETPPSAAAAAAAATPDAMDPGGLRPAPQSAAAAAAAAAAAGAGAGASAADEPRDARVVRELLRSMGLSEGEYEPRVVHQFLDLAYRYVGDVLGDAQVYADHAGKPQLDADDVRLAIQSKVNFSFSQPPPREVLLEVARNRNKIPLPKSIAPPGSIPLPPEQDTLLSQNYQXFLAPLKPPPQFEETEDDNAGANPTPTSNPSNPSPNNLQEQQQLPQHGQRVSFQLNAVAAAKRRGTMDQLNMG

SEQ ID NO: 41152 - protein, 468 aa, Medicago truncatula
MEENTSSWLRRAKYSQTVCHRLDTSRLNNIPIREQSEQNSRPSSNVKNNLLANKQRSLSPLPETFLNDVFREARHEQKRFSTPGPRRDKRIMGKVSNKDTRESPKVSSTKFLSSSPNGQKMFKDISKDGSWGKYFENGGGGGGKVTALETAEEWTIDMSKLFLGHKFAHGAHSRLYHGVYKEESVAVKIIRVPDDDENGELASKLENQFVREVTLLSRLHHRNVIKFIAASRNPPVYCIITEYLSEGSLRAYLHKLEHKAIPLQKLIAFALDISRGMAYIHSQGVIHRDLKPENVLIDEDFRLKLADFGIACEEAVCDLLADDPGTYRWMAPEMIKRKSYGRKVDVYSFGLILWEMLTGTIPYEDMNPIQAAFAVVNKKLRPVIPSNCPPAMRALIEQCWSLQPDKRPDFWQIVKVLEQFESSLARDGTLTLVQNPRCPDQKKGLLHWIQKLGPVHQNNGPKLKPKFT

SEQ ID NO: 41153 - protein, 455 aa, Mycobacterium tuberculosis
MSAVALPRVSGGHDEHGHLEEFRTDPIGLMQRVRDELGDVGTFQLAGKQVVLLSGSHANEFFFRAGDDDLDQAKAYPFMTPIFGEGVVFDASPERRKEMLHNAALRGEQMKGHAATIEDQVRRMIADWGEAGEIDLLDFFAELTIYTSSATLIGKKFRDQLDGRFAKLYHELERGTDPLAYVDPYLPIESFRRRDEARNGLVALVADIMNGRIANPPTDKSDRDMLDVLIAVKAETGTPRFSADEITGMFISMMFAGHHTSSGTASWTLIELMRHRDAYAAVIDELDELYGDGRSVSFHALRQIPQLENVLKETLRLHPPLIILMRVAKGEFEVQGHRIHEGDLVAASPAISNRIPEDFPDPHDFVPARYEQPRQEDLLNRWTWIPFGAGRHRCVGAAFAIMQIKAIFSVLLREYEFEMAQPPESYRNDHSKMVVQLAQPAAVRYRRRTGVHHHH

SEQ ID NO: 41154 - protein, 307 aa, Pyrococcus furiosus DSM 3638
MIESFREAFGRALVEIGKKREEVVVIDADVKGSTKTIYFEKAFPKRFIQVGISEQDMIGTAAGLAIAGKIPVASAFAVFLMRAWEQIRNTVARDNLNVKIVGTHSGFSDYMDGSSHQCLEDIALMRVLPNMKVVVPADAYATKVLLEQIIDTYGPVYMRLGRDYAPRVYEDGTKIKLGKANVLRKGKEILLVAAGTLVHTALNVAKMLEKLNVDASVIDMHTIKPLDEKTLLNYAKRAELVITLEEHSIYGGLGGAVAEVLSEKLPRRVVRIGTVEFGQSGRDYLALLDRYGLTPDKIYQKIVQVVM

SEQ ID NO: 41155 - protein, 375 aa, Arabidopsis thaliana
MPFSAASSSSVSSIAEEPPPKKQHDPSPSCSSYLLLLPDEIILNCLARLPKCYYPVISLVSKTFRRLIASPEIYVERSLLRRTERVLYVVLRSHATETPRWYTLNFKPFGNDSNNHRLVPIPSFPSIPCWGMSIVAIDSEIYVLGGCIDNELVSTGFVVECPSHTCRLLPSMKQARGCAAVGFFDGKLYVIGGCNPLSVNWVEAFDLKTQTWESGLGVNNVEMHDLTIRSFAIDDKIYIMDRKNSFVYDPKEGTLETDELLDTQWSVGSCVIDGKIYTFGSKNRIWVFDPIAMVWDRLKGLDDLPDKRDGSRMSNLGGNLAIMFNLEKGSTKICCTEIRLERREGGKIWGTVLWSNIVITLKEPSTIVRCLTVTV

SEQ ID NO: 41156 - protein, 293 aa, Triticum aestivum
  misc_feature (217)..(217): Xaa can be any naturally occurring amino acid
  misc_feature (231)..(231): Xaa can be any naturally occurring amino acid
  misc_feature (242)..(242): Xaa can be any naturally occurring amino acid
  misc_feature (264)..(264): Xaa can be any naturally occurring amino acid
MAKDEVMETGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAXVFMVHLATIPITGXTGINPARSLGXAAVIYNKDKAWDDQWIFWGRPXSGAAIAAFYHQYILRAGAIKALGSFRSNA

SEQ ID NO: 41157 - protein, 76 aa, Vitis vinifera
MAANFWTSSHYKQLLDQEEVDVVHPLDKEKGVTLEDFKLIKMHMANYIGRLGQNVKVRQRFVLFSCCFIPFPTSYI

SEQ ID NO: 41158 - protein, 344 aa, Coprinopsis cinerea okayama7#130
MTVPTTTEAITIPHIGGIEVIEKNTIPLQHNPSNLVIKVVDYAGVNFIDTYYRSGLYPYPSFPAVIGKETAGTIVALPTDPKVLEDPTFKKQGFKVGGKVAADYLGTHASYISVPPKYAYPVPDSVSTKTAAAALLQGLTTITFVEEAYPVKKGDVILVHTIAGGLGLLFAQLIKRKGATVIGTTSTAEKAELAKAHGADHVILYPVEDTVQRVLELTNGEGVDAIFDGVGKDTFDNNFKMIKRKGTIVSLGNASGAVEPFSLLRLVQKNVKILRPTMTNYVFTAEEAEHYGSRLFKEVANGDLKINIFKEYPFTAEGVKQAQSDLTGRKTTGKLLIKVNPDAQ

SEQ ID NO: 41159 - protein, 631 aa, Chlamydomonas reinhardtii
MAPTGRIERAKSKLKSTYAKFRSKAFVVRSMEEQKDKTASGFEMHKVLGPFSLVMLGIGCIIGAGVFVLTGVAARKYAGPGVVVSYALSAVTAMLTAFCYAEYAAELPVAGGAFNYVSMTFGEYAAWVTACDLVLEYTLSAAAVAKGFTAYTAALIGIDVSYLRLQASVFTLDLPALASVIGMSFILMRSTADSSLFNNLVTGLNVALIIFVLAAGFPHVEAENYHPFAPFGARGIFTGASVVFFSFIGFDTVATAAEEVKNPGRDLPIGIVGSLAICTCLYVLMCLAITGMQSYTVIDLNAPFAVAFDHVGLGWAQRIVAAGALTGIVTSLLGQARIYVTLGRQSLAPAWLAKVHPTRGTPVNATYVTMFTAGFLALFIEIELLAELVSIGTLVVFCSVCAGVLFRRYYVHGSGEPLRPVLGRLGGVVAAAVCFSVSFTEAAPAWVPAIFLVVWFAITLSFYRLPVKYVPQVFRCPLSPWLPSAGMLATLHLIGSLGWPAYVRWIVWFVLGTTVYLTYGMHRSQIAGCKYCLYVLDKPMGEAELARTRSDGGSGTPLEQHLMRHGIPPSSSPNGSPVADDDSVHSGTALNRPSTDVAHTFGGPPHHRAGSHTAAGVGAGVHGSWAACSVP

SEQ ID NO: 41160 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTPELENRCVNIIADLWHAPKDQKFMGTSTIGSSDACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKTTANVNWTLYDLADRLQMRGWQVPAYPLPKSLENIIIQRYVCRADLGFNMAEEFIQDFQASIQELNNAHILFHDTQQSGVHGFTH

SEQ ID NO: 41161 - protein, 365 aa, Nostoc sp. PCC 7120
MNYLAKYSYFESIFKPQSGNHSKWKNTTATDVTQALGNVPIVKLRNISPVCAIAECFLKLESCNPGGSIKEKNAVYLVTCAEEEGLLVPGGTIIESSSGNFGVGLAMVGAVRGYRVIIVVDAKTPPPFRRMLKAYGAELVDVPLHEADESGSMQKARMKRAKELAATIPDAWYPCQHLNPLNTEAHSYYTAREIEAHFADELDAVVVGVSTAGQIMGIARYLRPRFPKIRIIGVDVVGSVIMGTSAKPYKMTGIGLSFFPPNLDLSLLDRAYIVPEDLAYSVCHALARREGLLLGASTGAIVAGGLHLARELGRGARILMINPDRGDRYLETVYDSEWLERHGFTLKQDSHLDDAIASLSPVYFE

SEQ ID NO: 41162 - protein, 149 aa, Parvularcula bermudensis HTCC2503
MADGPAFAESVARLASPVRAGGYTAIAGIEARGLVFGAAVAAATGLGFVPIRKPGKLPATVLRESYELEYGRDALEIHHDAIAAEAKVFLIDDLLATGGTLLAAATLIERLGGTVGGAGVVVDLPDLGGSRRLAERGIPLHTLVCFEGE

SEQ ID NO: 41163 - protein, 1141 aa, Coprinopsis cinerea okayama7#130
MVSLRPHLQKLLESLPAPPADQKKLEELVKQTLEDAKARASSENWKSQWEYLLREEIFRLAGTEGQALNSNDVAYYDELRDKLDIVLIFTEQDACEQTFPFLVLQDLLETQTIASCSQIFSWIEDRASRLTEGMVPQKGKALILLRTLNELLRRLSKMGSTTIFCGRILTFLSGVFPLGERSGVNLRGEYGPTWEGVKYSDKEKVVSSEDEDVEMAPADESQTQDDKMQVDTKESQPAPQTAAEKREDFYNTFWSLQLYFSKPTEFANKGALEDFRASINKVIPVIKEATAKERAMMGSRNLTGPGAGLKRKREPEAEESNVTEYFFAKFLTSPELLDLEIADTHFRRQFLFQMLILLHHLLTFTKEAKEGWATLRNRSLQMDFTLEPDDARWVQEYINKVTEELRQTTPNGRQFSDTVTTILDRERNWVKWKNEICVPFDKEPWSQEVDGKKVDMFEATRQFRDELRTQPEPWKWAYGTEPLTEIWEMGYRSLYDLENPFQPGDVKDFVKQLKRYDAQIEMRKRQLAMAAERVAKAQARAAAAKAAAAPPAPAPAPTPSEKPEGKQEPELAAPKPVPAAGNSPLHPSLPPKPGSPVKPSPSQEAPKAATPAPAAPTPTPSAPAPSPFVPPPPTTDPQIKKFEEDKLRLTWLGLRTAREQHLQHFGKIGTGDLELLVNEIDNCKVSLCLRLNVWMPVQQYPLKNVLVTGGAGYIGSHVIYALQKTRRYKVISVDNHHNSKREALKRVSQLSRSELPPNPTQQEIESTEIDAYKCDLAQADQLRAVFQRYGKGGIWGVIHIAARKAVGESSEVPLDYYHNNVAASVTLLRVMDEFDCHRIVYSSSATVYGTPPTIPIPEGTRLQADSPYGRTKIMVEHILEDLCRSDQKWRALSLRYFNPAGAHPSGHIGEDPLGRPGNLLPLLAQMAIGRVKDATLKVFGNDYPTPDGTCVRDYLHVLDLAGGHVLALDGLSPNSTIFNPKSEVFFKSYNLGRGKGFSVLQIVEAMRKATGFDYRCEIVSRRRGDVPDLTADPSLAERELGFRAPQDLETMCRDLWNWQTKNPYGYEESPTVNGFNGHAKSFTNGVLANTNSRPLTNGKSAYTNGTGAIYTNGNGVYTNVMNAVHTYFNGSGNVAYMNGHV

SEQ ID NO: 41164 - protein, 369 aa, Microcystis aeruginosa PCC 7806
MTIISRSIPQSPTKSSSIGGWRGLIEEYRQFLPVSSKTPVITLLEGNTPLIPAPYLSAQIGRDVKVFVKYDGLNPTGSFKDRGMTMAISKAKEEGAKAVICASTGNTSAAAAAYARRAGMRAFVIIPDGYVALGKLAQALLYGAEVIAINGNFDDALKIVRQLSENYPVTLVNSVNPYRLEGQKTAAFEIVDVLGNAPDWLCIPVGNAGNISAYWMGFCQYHQIGKCDRLPKMMGFQAAGAAPFISKQPVDHPETLATAIRIGNPANWEKAWAASHASQGQFHAVSDEEILAAYRILGGQEGVFCEPASAASVAGLLKVHQQVPDGATVVCVLTGNGLKDPDSAVKHSNNQLKSGIAPELTQVAQIMGF

SEQ ID NO: 41165 - protein, 255 aa, Ashbya gossypii ATCC 10895
MSVTPIEELPSLGDALEDAKRAASYRAVDENLDPAKHRVVGIGSGSTVVYVAERIGKYQASPELKAKVEFICIPTGFQSRQLILDNGLRLGSIEQYPEVDIAFDGADEVDPELNLIKGGGACLFQEKLVSTSSAQFIVVADSRKRSPQRLGTSWTRGVPVEVVPSAYVRVLRDLHGIPGCRSAQLRLGEPGKAGPVVTDNNNLLIDADFGPLEDPAALHARIKALVGVVETGIFAGNAAKAYFGSADGSTQTLAR

SEQ ID NO: 41166 - protein, 426 aa, Schizosaccharomyces pombe 972h-
MKSFTRNLRRFQTPRRNLHGISYTPKKVEGVSFAGRETPTATGSLSVVINAGSRYQPDAGVSHLLEKFAFKTTEERSALRITRESELLGGQLSTQITREHIILTARFLNEYLEYYARLLAEVVDATKFLPFQLTEEVLPTARIESELFREDILRVAMAKLHEKAFHRGIGNEVYLPASASPSISEIKDFASKAYVKSNFSVISSGPDVQKASDLCAKYFAVIPDGSPLKSAPTKISSGESRVYSKGTNYFCLGFPAPAASPELFVLSSILGGDAAVKWSHGNTLLAKAAGTASEYKATAVADLTPYSDASLLSVVISGSCPKAIKATASESFKALKSLSSNIPNDVVKSGIAMAKTKYLSAFEPVTLNAISASSLVSASKGSDAFISGFDKVTPASISKVVSSLLAKPASTVAVGNLDVLPYYDEL

SEQ ID NO: 41167 - protein, 475 aa, Escherichia coli
MSIRLEGYMQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 41168 - protein, 323 aa, Xylella fastidiosa Dixon
MTVLVTGAAGFIGAHVCRVLAARNDTVVGLDNYNAYYDPQLKRDRVTALCPDVHIRTLDLTDRERCAALFNEVQPDRVVHLAAQAGVRYSIENPHAYVDSNLVGFLNVLELCRHCRVQHLVYASSSSVYGDSAIPPFSEQQRVDQPRSLYGATKVANEVMAYSYAQLYGLRATGLRFFTVYGPWGRPDMAPLIFSRAVLEGRPIEVFNHGRMERDFTFINDIVAGVIGALDAPGEQAVPHRLFNLGNHTPVSLEHFIKVIEQAAGRPADKHYKPMQLGDMMATMADIAAARAAFGFEPVTSIEIGMPQVVEWCRHYFDTRAST

SEQ ID NO: 41169 - protein, 705 aa, Haloarcula marismortui ATCC 43049
MSGSTEAGVELTVEGANKRDAGRGIARLPESARTELGVLSGSPVIIDGDDMTVVKVWPADDDGSFVRIDSDTRANAGVNIGDTVTVTSGSVSEATEIAVQPVEPMPGSEDYESLVRKRLVDQIIQADERTHIDGLGTFLVRKTSPSGPVRVTDATAVTVLPGLDGGSGAGQSSSDEATTTNTPTAETESGVSYEDIGGLDEELDRIREMIEMPLSEPEEFRRLGIDPPSGVLLHGPPGTGKTLIARAVANEVDAYFDTISGPEIVSKYKGESEERLREAFEKAEANAPAILFVDEIDSIAGSRDEDADMENRVVAQLLTLMDGLEDRGRVVVIGATNRVDAIDPALRRGGRFDREIEIGVPGEHGRREIMDVHTRDMPLHDDVDLDRIAAQTHGFVGADLASLTTEAAMAALRTDRDDGDVHQDDFETALATVDPSAMREYVAESPTATFDDVGGLAEVKQTLTETIEWPLSYGELFTATNTDPPSGILLYGPPGTGKTLLARAVAGESDVNFIHVAGPEIMDRYVGESEEAVRELFERARQTAPSIIFLDEIDAIASHRGQGNEVTERVVSQLLAELDGITENPNLVVLAATNRRDMIDDALLRPGRLEQHVEVPNPDRDAREEILAVHTAGKPLAADTDIEDLAEKTDGFSGAELEAVVREASMLAIREVASAYGPEEATENAEEVEITPAHFSEALERERTR

SEQ ID NO: 41170 - protein, 291 aa, Bacillus clausii KSM-K16
MKKVGFLGPKGTFTEMAAYSLFPKEELVPLKTIPKVLDLAFAKGIDYAVVPIENAIEGTVNITLDYLIHHKPMPIVASISLEIAQHLLFSPNKDRETFVPKKVVSHPQAIAQCHQFLQKNYPEIEIEYADSTGSAAAWLAENPNADACVIANAQAASTYGLAVAQGDIHDFEHNRTRFIVLTAKKEQAPHIVGPEHTGDKTTLMVTLPSDFAGALHQVLSAFAWRKLNLSKIESRPTKTGLGNYFFLIDIDQLMDDVLVPGAIAELTALGCKVEVLGSYATYSSKATASIN

SEQ ID NO: 41171 - protein, 397 aa, Leuconostoc mesenteroides subsp. mesenteroides ATCC 8293
MPEVKPSLLNNLNQHLKLVGPSAIRAFDIEVSEIPDIIKLTLGEPDFNVPDHIKQAAIRSIEANDSHYAASNGTIHLREAAAGFLADRYDIDYDPTNEIIVTIGATEAIYDTLTTILNPGDKIILPTPIFPLYIAVGLVDGAEPVFIDTSSNDFVLSPEMLKAAIAKHGDDIKAVVLNFPSNPTGVTYNDEQIKAIADVLRGTDIIVISDEIYSELSYENSHVSMAKYLPEQTILLNGVSKSHAMTGYRIGILAGPAQLVQKIAMIHQFATTTASNPAMAAAAEALGTEAGRQDTLVMKAEYLQRRDYVYDTMTQLGFKVAKPDGAFYIFAKIPAGYIQDDFAFARDLAQNNGLALIPGSSFGPGGEGYVRLSYAASIETLQKAMHRLTAYMEENGK

SEQ ID NO: 41172 - protein, 248 aa, Medicago truncatula
MKFNVANPTTGCQKKLEIDDDMKLRAFWDKRISQEVLGDALGEEFKGYVFKITGGCDKQGFPMKQGVLTPGRVRLLLHRGTPCFRGHGRRNGERRRKSVRGCIVSPDLSVLNLVIVKKGENDLPGLTDVEKPRMRGPKRASKIRKLFNLSKDDDVRKYVNTYRRTFTTKAGKKQSKAPKIQRLVTPLTLQRKRARIADKKKRIAKAKSEAADYQKLLASRLKEQRERRSESLAKKRSRLSTAKQGVAA

SEQ ID NO: 41173 - protein, 720 aa, Aspergillus nidulans FGSC A4
MVGPSLLQLPWVALAYARPKHRQDPNWTYRQAFTNSLLKAFLRNWVALHLKWRLSLKPRSESDRFIQIPPANPALYTGIVIDEKIRPETIGATWYPAPYPSPDSSQTALPEGQHVVLHLHGGSYILGDGRTSSCNFLATTLLEHTPSSYILCPQYRLAGNRNGNFPAQLQDTIASYAYLIHTIGIPASQIIISGDSAGADLALALLRYTIEFDNLSILPAPKCCWLWSPWCDVPPAVDPGRWNHSANYRTDYIPGSFPARGAKLFLKNVDVTKYVERYVSPVLHPFAVPSPVLIITGDREVLFEDHKKLSQGLKELAHKDEQIELFVTRGVPHDVLMIAWIMGFQKEARESAIKAGEFLHSSFFSTRYRHLSLHCNLFLPFWGFNITIMGLFQPKVMPLPHGIDLTGKTAVVTGATAGLGLETARQILRLNVSTLVLAVRNTEKAQSCVADLFRDADIQARLTRPDIHVLECNMEQYSSVKSFSAKLKESIPRVDILILNAGIHSFVYEKTSDGHEKALQVNYLSNVLLLAELLPFLESTAEQTGSAVRITWLGSRTYYLSNSLEKSDILTYGGGILQYMDSEKASASAGMNQYSDRKLLCALFVYELASRLNRDKVTLNLVCPGMVKTDLGSNGPLWIRTLIEIVKILRARPVEVGGWLVLNAAVVAGKESHGSLIGDKEVTEPTKFIKSSAGQELQKRLWKETVEEMATLTELLSAFV

SEQ ID NO: 41174 - protein, 466 aa, Leuconostoc mesenteroides subsp. mesenteroides ATCC 8293
MSLLARAFKRESVDNYLSADSHMSRVLTTRDLISLGVGTVIGTGIFILPGHEAADHAGPAVAIAFLIAAIFSGLSGMAFAEFSAAMPVAGSAYSYGGAIYGEIIGWLLGWSLIVEYFLAVSAIATGFSAYLGNLLAIFGIHIPKYLSAGPMEGGIVNLFAVLIILFVAAILSRGLNTSKKVENGAVVIKIAILILFIVGGSFFIKTSNYVPFYPKEFHSGLGGLNGIWAATASIIFAFLGFDTIAAHAAEVKNPQKTMAKGIVGTVIISALLYTLFSIVLTGIVNYKKLGVDDPAAFALQVVHQTQFSIVITIGALIGMFTAVLALIYASSRLTYSFGRDGLLPRSLGKISPGSHLPVNALILAVAVEVIFAGLIPLSTLASLINAGTLTAFAFINFGILILRRRKDLAHDGFKVPGYPIVPFIAGMISLFFITQLSAETLKMFGLWLLLGVIWYFSYGIKHSKLS

SEQ ID NO: 41175 - protein, 345 aa, Pyrococcus furiosus DSM 3638
MFNVYELFNKINEVKPEIRLDAGQPDIPVANEIIEEAINSLKRGETGYVSTTGINELREKIAEVEGVSKEEVIVGPGAKILIAAEIAMANKIGVIAPYWNAYLLIAKNFEKEVKIIETTLENSWEPEINDNLDVDLLILNYPNNPTGKILPREKLKELVEVAEEKGIKILSDEIYAEISFKSFTPVRELYENTVTVKGFSKLYSMTGFRLGYAIADKEEIRKIKTFIESTVTCVPPFVQRAGIKALELRDELMKKVSREYKRRAELASKILRGLEFYEPDGAFYIFLKTPIDGLEFVYKLLERGVSAFPGIAFGNYQNFIRISLTSDKLEKGLNIIKEVAECESQ

SEQ ID NO: 41176 - protein, 450 aa, Ipomoea batatas
LTVEAPILERRRANPKNVAAIILGGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECSVEHSIIGERSRLDCGVELKDTLMMGADTYETESEIASLLADGKVPIGVGENTKIRNAIIDKNVRIGKDVVIMNKDGVQDSDRPDEGFYIRSGITIIMEKATIPDGTVI

SEQ ID NO: 41177 - protein, 196 aa, Zea mays
MAATRASPVLLLLLTVQLSLLFRLPDSPSTLALALAAEPEQQNAKQHRQPALLVQSTCNSTSFYDLCIAALAADPASSTADVPGLGAIAVSAAANNASGTAAFLGNASDAAATPQADRALLASLAEQAYDYAFVHVSAAGEYPAVCRTLFRRRQQQQRGASRSAYPAELAKREEALRRLCTIALDIISLLQNQETY

SEQ ID NO: 41178 - protein, 463 aa, Synechococcus elongatus PCC 7942
MPDSVVLPATLQTALQTAEQLLWDRALVRYHDQWAGAIAALPEDQELAAANYREIFIRDNVPVMLYLLLQGKTDVVRDFLQLSLSLQSQALQTYGILPTSFVCEETHCVADYGQRAIGRVVSADPSLWWPVLLQAYRRASHDDAFVHSPTVQQGLQRLLAFLLRPVFNQNPLLEVPDGAFMVDRPLDVAGAPLEIQVLLYGALRACGQLLQYTEAANAAHVQARRLRQYLCWHYWVTPDRLRRWQQWPTEEFGDRSHNPYNIQPIAIPDWVEPWLGESGGYFLGNIRAGRPDFRFFSLGNLLAIVFDVLPLNQQGAILRLILQNEAQILGQVPLRLCYPALTGSAWKILTGCDPKNQPWSYHNGGSWPSLLWYLSAAVLHYQQRGGDRNLCQVWLNKLQHYHTQQCEQLPGDEWPEYYEGQDSVQIATRACRYQTWTFTGLLLNHALLSQPQGIQLLSLRGLP

SEQ ID NO: 41179 - protein, 325 aa, Mycoplasma gallisepticum
MSTLIEELKIKIKNSKKVPEILLVEGWNAYVQEAAKQLVAEKLVKPVLMFRTMDEIPADFDPRIKRYVIEKMDLSKYATYLFKLREKKGMTLEVAQQEVQKPNVLASLLVKLDEVDGEVCGKEYTTKETLKPALQIIKTSETAKIVSSVMVLEKNQERLVFADCAINVYPTAEELAEITKSTIKFAKDVLQIEKINLAMLSYSTLNSGVGESVDKVKAVTKLVEESDVGKLASICGPMQFDAAYVEEVRKQKAPKLDWEKGANVFIFPNIDAGNIGYKIAQRLGGYDAIGPVLTGLAKPVNDLSRGANAHEIYSVAIITACQAVA

SEQ ID NO: 41180 - protein, 297 aa, Achromobacter denitrificans
MSVVSFAECSARERIAHLLDAGSFHEWLPPAERATSPHLAQLGLPCAFDDGVAVGRATLDGRPVFVAAQEGAFMGGGVGEVHGAKLVGMFRRALRNRPAAVLLLAESGGVRLHEANAGLIAVSEVMRALLDVRAAGIPVLVLIGGANGCFGGMGIVARCADRIVMSDVGRLAMSGPEVIEASHGVEEFDSRDRALVWRTTGGKHRYLCGDCDALVEDDVQAFRAAAIAWMAAPDASRPLTREALEDEHALLAARLNVLSGAADGGEESFRLWQLLGIREPERVPDLDVEAVRALRAA

SEQ ID NO: 41181 - protein, 251 aa, Photobacterium profundum SS9
MVHFTQFYIKVISLLHEDLTELTVNQPLNYRNTGFITSAPDIRHLPQDTGVEIAFAGRSNAGKSSALNRITDQKGLARTSKTPGRTQLINMFEVTQGCNLIDLPGYGFAQVPLELKIKWQKALGEYLQKRECLKGLVVLMDIRHPMKDLDQQMIFWAIESRLPVLVLLTKADKMKSGARKAQLLKVRESSKSFGGDVQIELFSSLKGIGLDQVRRKLDTWFGPELERQLMLAAAENGETYTGESLSDKSDD

SEQ ID NO: 41182 - protein, 507 aa, Candida albicans SC5314
MSFDSFGDYATIVVFGASGDLAKKKTFPALFGLFREKQLPSTVQIIGYARSHLEDEEFKQRISEHFKGGDEKTKTEFLKLVSYISGPYDTDEGYKKLESRCQEYEKANKDKNDSYTPERLFYLALPPSVFTTVCEKVKKNVYPPEESKGKLRIIIEKPFGRDLDTYREMQKEISPLFTEDEIYRIDHYLGKEMVKNLLVLRFGNELFSGVWNNKHISSIQVSFKEAFGTEGRGGYFDTIGIIRDVMQNHLLQVLTLLTMERPVSFDPEAVRDEKVKVLKAFDAIDINDVILGQYTKSEDGKKPGYLDDKTVNPDSKAVTYAAFRVNIHNERWDGVPIVLRAGKALDESKVEIRIQFKPVAKGMFKEIQRNELVIRVQPNEAIYLKINSKIPGISTETSLTDLDLTYATRYSKDFWIPEAYEALIRDCYLGNHSNFVRDDELDVSWKLFTPLLNAVEDPAKKIELQYYPYGSKGPKDLRKYLNEHGYIFSDPGTYQWPLTSPNVKGKI

SEQ ID NO: 41183 - protein, 325 aa, Sulfolobus solfataricus P2
MLKSVTVSAPSNIAVVKYWGKRGDERLNLPLNNSLSITLDDQLSVITKVTLNDKNIVIVNDRILSEDEMKEYAGRVLDTFKKIVGKEFHVKVESKSKFPINAGLASSAAGIAALAFSLNELLELNLKSEELSKIARLGSGSACRSMFGGFVVWNKGEREDGEDSYCYQIFRHDYWSELVDIIPILSEKEKKISSRKGMIRSAETSELMECRLKYIEKTFNEVIEAIRNRDEKKFYYLMMRHSNSMHAVILDSWPSFFYLNDTSIRIMEWIHDYGKAGYTFDAGPNPHIFTTERNIGDILEFLKSLEIKRIIVSKVGDGPKVLSRE

SEQ ID NO: 41184 - protein, 485 aa, Anabaena variabilis ATCC 29413
MTLAETFNTENHPNPLITLNYEPALESLGNDYYDEVTAAEFPQLTLRWRNDAILPRLGLDPQTVTDEDFITAFGLFQGRKPLLALRYHGYQFGEYNPNLGDGRGFLYGQVRGTDGELYDFGTKGSGRTPYSRGGDGMLTLKGGVREVLAAEALHQLGVRTSRCLTMIETGLGLWRGDEPSPTRSSVMVRMNKSHIRFGTFERLHYFQRSDLIKKLLDHVIEHYYQHLTHESDKYALFYAELVKRVAELVAQWMAAGFCHAVLNTDNMSITGESFDYGPYAFIPTYNPYFTAAYFDYYGRYCYIQQPSICQWNLEMLQVPLRAVIDKADMEAGLAKFNEYCHAEYHSLMLKKLGFEQLTTPEAEELLSLTLKFLQESQVGYHQFFYEMARTFSVKWRDEPGLVLSGSDIVPPSGTDANFDNWCVLYHKILNNFDYEQVKIIAQNLTYYNPKTSLLRPTIEEAWEPIVQEDNWQPFYDLVKSIQSRG

SEQ ID NO: 41185 - protein, 397 aa, Synechococcus sp. WH 8102
MSETPMKAMILAAGKGTRVQPITHVIPKPMIPILQKPVMEFLLELLKEHGFNEVMVNVSHLAEEIENYFRDGQRFGVEIAYSFEGRIEDGELIGSALGSAGGLKKIQDFQNFFDDTFVVLCGDALIDLDLTEAVRRHREKGALASLVTKRVPKEQVSSYGVVVTDAEDRISHFQEKPKVEEALSDTINTGIYIFEPGIFDHIPSGVSFDIGSDLFPKLAELGAPFYAIPMDFEWVDIGKVPDYWQAIRSVLLGDVRQVGIPGKEIQPGVYTGLNVAANWDKINVSGPVYVGGMTKIEDGATIVGPAMIGPSCHICEGAVIDNSIIFDYSRIGAGVQLVEKLVFGRYCVGKDGDHFDLQEAALDWLITDARRQDLVEPSPQQKAMAELLGTELTQAAS

SEQ ID NO: 41186 - protein, 147 aa, Zea mays
  misc_feature (110)..(110): Xaa can be any naturally occurring amino acid
MRNETRHQLTIQGDVCRTEEDGMRVVTVENLRNPYESNLGGTNKRFKLTLNKLYAWTLVDYERVVMIDSDTSFSQNTDELFQCGQFCAVFINPCYFHTGLFVLQPSIDVXKGMLHDLETGRENCDGADQGFLIGCGRWVDAVPDRNW

SEQ ID NO: 41187 - protein, 340 aa, Lactobacillus sakei subsp. sakei 23K
MKVLTFGEMLMRLKTPGNQRLLQADSFEASYGGAEANVAVSLALLGDQVAYLTKLPENLLGQKGMQTLRGYGVDTTKIQYGDGRLGLYFFEKGASVRSTNVVYDRAHSSFATMAASEFDWKTIFEDIDYFYFSGITPAISAELAQAAETACQYCQAHDIPVVCDLNYRGKLWSPEQAQATIKRLMPYVTICIAHDEDFEATLGIQAFDGNESHGIAQKESFKAAMQQVRQIFPNCQMVASILRNIRSVEDSEWLALLLKDDQFFETGTYQMHVMEGVAARDAFGAGLMHGLLNNFTPDEMLQFGLAASVAKLTIAGDFNLIGEAEIEAIAQSGGGARLSR

SEQ ID NO: 41188 - protein, 554 aa, Zea mays
MTSRVLSSLRKQDNVSRIHAAPTAVLLQGSRHFFDGHVSSCTGLKALLRQPRQRVGDGLMAMLVLWLAWLLVSLIAVYFLDLYVHARRGLPPGPRPLPLIGSLHLLGDQPHRSLARLAKFHGPLMSLRLGAVTTVVISSPDVAREFLQKQDAVFANRFVPHAIGDHVKNSVPWLPHSGRWRALRKIMATELFAPHRLEALQHLRRQKVEELVGHVRLLALQGRAVDVGSVAFTTSLNLLSRTIFSCDLTNLDDHTGSAKEFQEVVTEIMEVAASPNLSDLFPALACADLQGLRRRLAKLFARLHQVFDVEVDRRLCERDAGDRRKNDFLDLLLDTDGGTAALDRDSLLSLFTDLFAAGSDTSSSTVEWALTELLRNPVPMAKTCDELLAATGAARNIEESEIEQLPYLQAVVKETFRLHPPVPLLLPRRAGAATRAMGHTIPKGARVLVNVWAMGRDGDVWPDPEKFMPERFLGRPTDFRGGDLELIPFGAGRRICPGMPLASRMVHLVLASLLNQFRWRLPAEVERDGTDEMAESFGVTLKKASPLCAIATPV

SEQ ID NO: 41189 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTDLFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKESKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGLPKGMDPSQLIMEEKFGLTLQKEPPLYIVPKTRD

SEQ ID NO: 41190 - protein, 524 aa, Mycobacterium avium 104
MTEMAPAPIQHTTAEKLAELYRRLELAKEPGGEKAAAKRDKKGIPSARARIHALVDPGTFLETGALAKTPNDPNALYGDGCVTGHAMIDGRPVGLFSHDQTVFQGTVGEMFGRKVARLMEWCAMVGCPIIGIQDSGGARIQDAVTSLAWYAELGRRHEALSGLVPQISLIFGKCAGGAVYSPIQDDLLVSVRDQGYFFVTGPDVIREVTGEEVTLDELGGSDAQARYGNIHHVVNTEAEAFQYVREYLSFLPSNCFDQPPIVNPGLEPEITPTDLELDSIVPDSDNMSYDMHEILLRIFDDGDFLEVAAQHGPAIITGYARVDGHPVGVIANQPMHLSGSIDNEASDKAARFIRFCDAFNIPLVFVVDTPGFLPGAEEEKRGIIKRGGRFLYSVVEADVPKVTITVRKSYGGAYAVMGSRQLTADFNFAWPTARIAVIGAEGAAQLLMKRFPDPTTPEAQQIKKDFIEGYNLNMAIPWTAAERGFIDAVIDPHETRLLLRKSLKLLRDKQLWFRVARKHGLIPV

SEQ ID NO: 41191 - protein, 479 aa, Leuconostoc mesenteroides subsp. mesenteroides ATCC 8293
MSEHKGHIQRNLKTRHVSMIALGGSIGTGLFVASGATVAQAGPLGAIVAYLAIGVMVYFLMTSLGEMATYSPTSGSFSDYAGKYVDPALGFAMGWNYWFNWAITLAVDIVAVGLVAEFWFPNTPGWIFSAIALLLIFLINIFSVGTFGEAEFWLSMIKVVTIIAFLIVGLATIFGVIHSDINVMKNLSVGNHGFVGGPQAILSVFVVAGFSFQGTELIGITAGEAEDPDKSVPKAINQVFWRILLFYILAIFVISALVYYKDPRLLSSSTQNIAVSPFTIVFKNAGIAFAASLMNAVILTSIVSSANSGSYASTRMLYAMARKGDAPKIFAKLSTRGVPVAALVLTTAIGLLAFIANTKGGSVAYTWLVNASGLTGFIAWVGIAISHYRFRRAYVAQGKSLSDLKYKAKWFPFGPLFALVISIGVIIGQDPDSFAHLNWEKIFVTYLSVPLFVILYFWYKVSHKTKLIALKDVDLKQYK

SEQ ID NO: 41192 - protein, 490 aa, Propionibacterium acnes KPA171202
MADLHGFMNVTRQEAERRPVEERVQDWKEVYPGGPGHALLPIITDQASRCMDCGVPFCHTGCPLGNLIPDWNDLIWRDEWREALSCLQTTNNFPEFTGRLCPAPCETACVEGLNRAPVTIRNVEVAIIDKAWEDRRVIPVVPEWHSLKTAAVVGSGPAGLATAQQLTRAGHTVVVYERDDAIGGLLRYGIPDFKMEKSVLDRRIKQMVLEGTVFKTNTEIGVDITGEQLRERFDAVVLATGATVPRMLDAPGIELDGVCYAMEYLTQQNRVVAGAEVLDQIHADGKHVVIIGGGDTATDCVGTAVRQGAASITQLQYNPEPPKDRSANYPWPTYPLILRVSSSNEEGGQRVYSTNTVEIVSNDRGHVKAVRVVSGHRDENRVFIADEGSEHDLPADLVIFAMGFAHPEYDGVVAELGLELDGRGNIIRNDAYETNVPGVFACGDAGRGQSLVVWAIAEGRAAAHGVDAYLKGSPSVLPKPVKPSDRQMTV

SEQ ID NO: 41193 - protein, 371 aa, Pyrococcus furiosus DSM 3638
MGVHKKGYLVLEDGSVIEGKAFGAETIRYGEVVFTTAMVGYPESLTDPSYKGQILIATNPLMGTYGVSSKSLKEHGLPLHYESDSIKVEGFVISFLMRPNHWSSEMTLDEWLRREGVPGLYGVDTRALVKKIREEGVMRGAIVTTETDLEEILENIRKISYESTNFVELVSPKNPIVHTPKNVKFRVVVLDLGVKFGILRELLKRGIEVVRIPWNWDILEAYYSYNADGIFISNGPGNPTLLKEVAKRIRKAFNEEIPMMGICLGQQLLALADGAEIYKLKYGHRGINKPVKDLESGKAFVTTQNHGYAIVPESLNEFKVWMVNLDDNSVEGIKHESLPIIATQYHPEASPGPWDSLWVFDEFVKILEGRK

SEQ ID NO: 41194 - protein, 261 aa, Pyrococcus furiosus DSM 3638
MKVAVIGAGTIGSAVAKALAESNYEVIATRRSIEKVKWLEKYGVKLEKDNKKASREADIVIIAVKPNKVGKVLEEIKEEVESKIVISLAAGIPIKLLKRFANAKFVRAMPNIAVLVKESFTAYATEDLSEEEIRTVEKIFESFGKYIRIDEEYMDAITGLSGSGPAYVSVFLEAMIYGGLRVGLPRDIAKLAAAQTLLGTAKLLLNFEGHPAEIRDMVITPGGTTIDGIFELEEGKIRTTIMKAIDAATKKSKILSTRLSP

SEQ ID NO: 41195 - protein, 339 aa, Neisseria meningitidis serogroup C
MKKILVTGGTGFIGSHTVVSLLKSGHQVVILDNLCNSSINILPRLKTITGQEIPFYQGDIRDREILRRIFAENRIDSVIHFAGLKAVGESVAEPMKYYDNNVSGSLVLAEEMARAGVFKIVFSSSATVYGDPGKVPYTEDMQPGDTTSPYGTSKSMVERILSDIQKADPRWSVILLRYFNPIGAHESGLIGEQPNGIPNNLLPYICQVAAGKLPQLAVFGGDYPTPDGTGMRDYIHVMDLAEGHVAAMQAKSNVAGTHLLNLGSGRASSVLEIIRAFEAASGLTIPYEVKPRRAGDLACFYADPSYAKAQIGWQTQRDLTQMMEDSWRWVSNNPNGYDD

SEQ ID NO: 41196 - protein, 551 aa, Zea mays
  misc_feature (494)..(494): Xaa can be any naturally occurring amino acid
MELFYELLLTAAVTLLAALLLATLFAANDSHRRTDRAAAAIAEEVAEEERIIEVDEVMRSEGMAAVAPSEADGWVEAEKAPAVVVAEVKEPESLPEEEGVPVKAVREVRLAAEVEEGEDGGGGVKRPDLTSATVVAAVGAEASQLVSGAEVVPKEVSGAAGLEERTVQDVVVNQYDLGAEVALVPVEVLEAGPDKQGVEVVGVAQVPPLETEAAEVKQHHLVAEAAPAEDVLDVGLVDKSVRAIEVRPNELDSETVLEEILDAVLEEEEQVEHELPAGAAPQPVLDVPLAGKGELKHHQPVEEAAEVHEDVQCKQEAECEAQTVDQQQELVPEEESVAGKNDDVNVIHECSFSDEVVTELPVGEVTSQGLPKDDPEADMEFEEWEGIERSEVEKRFGAAAAFAASGAGAAALSKLDSDVQLQLQGLLKVAIDGPCYDSAQPLTLRPSSRAKWSAWQKLGNMNPEIAMEKYMNLLSETIPGWMMNETLCMHVVLXDTENTGSLPAETILTTMASTSDQRSNQGNEDNSSIGEGHPITSPNPEKGQSSDIPTE

SEQ ID NO: 41197 - protein, 273 aa, Vitis vinifera
MAERGGGGERGGFGRGFGRGGRGDRGRGGRRRSAGRREEEEKWVPVTKLGRLVKDGKIRTVEEIYLHSLPIKEHQIIDTLVGPSLKDEVMKIMPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFDCLLKTYAYLTPDFWRETRYTKSPFQEHTDLLAKPTKAIYQDDVERVEA

SEQ ID NO: 41198 - protein, 460 aa, Coprinopsis cinerea okayama7#130
MPSMKPHVEDIEDDYAAEEENKLINEEYKTWKKNAPYLYDLVITHALDWPSLTCQWFPDKEQNPNKPYTTHRLLLGTHTSGQAQDYLQIATVQIPKRSNPATGADALSRTDYDDERGELGGHTLPSSPRIQIVQRINHDGEVNRARYMPQNPDLIATKAVTGEVLVFDRTKHSSEPERGGVCKPDIRLVGQSREGYGLAWNPNKKGHVLGGSEDMTICHWDINSYTKAKTTIEPTTIFRGHTSVVGDVDWHRSQENVFASVGDDKLLMLWDTRSSSKPQYEVQAHDSEILALSFSPATDHLLITGGADKTVVLHDIRAPSKKLHVFESHTDEILHLAWSPHNPTIFASASGDRRINIWDLALIGQEQTPDDQEDGPPELLFVHGGHTSRPTDFCWAPGEAENWTAASVSEDNVVMVWQPTMRVWAGDEVKVDEKELEGDAMEGVETTVGAGGSGSGGAAA

SEQ ID NO: 41199 - protein, 159 aa, Bacteroides fragilis YCH46
MKIKVGFGFDVHQLVEGRELWLGGILLEHEKGLLGHSDADVLVHAICDALLGAANMRDIGYHFPDNAGEYKNIDSKILLKKTVELIAAKGYQIGNIDATICAERPKLKAHIPSMQQVLAEVMGIDADDISIKATTTEKLGFTGREEGISAYATVLINRV

SEQ ID NO: 41200 - protein, 181 aa, Microcystis aeruginosa PCC 7806
MTVFEGNFTEDISSWRFAIVIGRFNDLVTDKLLSGCQDCLKRHGVDVNPDGTQVDYIWVPGSFEVPMVARQVALSHRYDAVICLGAIIRGQTPHFDYVAAEAAKGIAAAAFQTGVPVVFGILTTDTLQQALERAGIKSNLGWNYGLSALEMASLMRQLRPRDEDKPLGLLQNNPPQALMEG

SEQ ID NO: 41201 - protein, 584 aa, Photobacterium profundum SS9
MQWKASCLALLITASLTVTPAIAKQSADSIAPEAVTGLKTQTLEQGSDWMIASANPYASEAGAAMLRQGGNAIDAMVATQLVLGLVEPQSSGIGGGAFLMYWDAKKEALTSFDGRETAPYGVTPRLFQDDKGEPLQFFDAVVGGRSVGTPGTVKLLQHTHQRLGKLPWKALFEPALNLAKNGFIVSPRLAKLVANDQDYLQRSAEAKAYFFNQDGSPIKAGQNLKNPAYADTLTLIADQGASAFYHGKIANDIVKTVRGAKANPGVLNTMDLATYQVKEREPVCAPYRQYSICGMGPPSSGALTLGQIMGMLSHYPIAEMGPENIQSWRLLGDASRLAFADRGKYMADSDYVPMPTEGLLAADYIEQRATLLKGDTALATTAAGKPPWSHAMNYALDEAIELPSTSHFSIVDKDRNMVSITTTIENGFGSRLMVRGFLLNNELTDFSFRSHADGVPIANRIEPGKRPRSSMAPTIVMKEGEPYMAVGSPGGSQIIGYVAKTLVAHLDWGLNLQQAINLPNMNNRFGAFELEQGTTAEQWAPKLEQLGFKVKVKELNSGVQAIRVDGKSLTGAADPRREGKVIAQ

SEQ ID NO: 41202 - protein, 216 aa, Glycine max
  misc_feature (180)..(180): Xaa can be any naturally occurring amino acid
MERKRSHASFTMFAMLVGLLSQSLVIPVISTTVADQKNYYTPDPHAGSPPTGFSDSLCSHNSSPPSHGHGSSPPSHHHSSPSTPSTPSGGNCGSSPPQHHDPTPSTPSTPSNPPSGGYYGGSPPTPVTVSPPSTPVDPGTPSIPSPPLIPSPSPFTGTCNYWRNHPAIIWGILGWWGTLXSAFGVTGTTVPGFSPGLSLPQALSNTRTDGLGALYR

SEQ ID NO: 41203 - protein, 642 aa, Solanum lycopersicum
MSSQKNYKNKHVLFLVMIMCSLAFVTEANLSEPEVLLKFRESLKYDGDPFSTWDANVPPCVKDNNKPKWNNLFCESGKVYGLNLENLGLSGTIDLDILKELPNLRTISVFKNKFEGPLPILNKLPTLKSAYFSNNKFSGPIDQNIFEGMNSLKKLHLANNEFTGPLPPIFGDMPNLRELNIQNNKFEGPIPPSYSHLYLPAYDGNDGLCGPPLAKSCNKEDEKKKEESSSSSSSGWKIALIVVIVVVVIGIIVFVLINRRNKNHQQEVVLGGSSLTSSSPTSQDQKLIPQSHDHLNKMEQGQSSAASTPDRACNDGGKRAEVAGQKLLFLKDDIEKFDLPDLLKASAEVLGSGVFGSTYKAALSTGPVMVVKRFRHMNKVGKEDFHEHMRRLGRLSHKNLLPVIAFYYRKEEKLLVFEYVNNVSLAVYLHGNSKSRGNQSLDWPTRLKIVKGVSKGILYLYNELPSLTSPHGHLKSSNVLLTENFEAVLTDYALLPVVNAEHAHEHMISYKAPELKQSGKVNRKTDVWTLGMLILEILTGKFPSNLLGKGTQDSDDLATWVNTTLGGESSEKEVFDKEMKGTKDCESEMMKLLKIGLSCCEADVEKRCDIKEAVERIDEVKGKGDFSSNVASNEVDNMHTSR

SEQ ID NO: 41204 - protein, 215 aa, uncultured archaeon GZfos12E2
MSRESKRGSRKESWKTEEKWTPITRLGVLVQNGEIRSIEEALKSRYPLKEYQIVDALLPDLSEEVLDINLVQRMTDSGRRVKFRVCVIVGDKEGYLGIGLGKDALVRSGIEKAVRVAKTNITYIERGCGSWECDCKDKHSIPFKVIGKSGSVEITLKPAPKGIGLAAGDIPKRVSEFAGVNDIWAKTRGKTRTTFNLAMATYNALRSTASVKTMN

SEQ ID NO: 41205 - protein, 312 aa, Dehalococcoides sp. VS
MPDKVPYASPAVRLFARELGVDLTRVSGSARGGRISKEDVQSFVKGVMQGSVAAPAAAGAAPSLGGGLNLLPWPKVDFSKFGEVETKPLTRIQKLSGANLARNWAMIPHVTQHDDADITDLEALRVALNKENEKAGIKLTMLAFLMKASVNALQKFPNFNASLDASGENLTLKKYFHIGFAADTPNGLVVPVVRDVDKKGVLQIARETGELAAKARDGKLGPADMSGGCFSISSLGGIGGTAFTPIVNAPEVAILGVSKSATKPVWDGKQFAPRLILPLSLSYDHRVIDGAAAARFTAYLAQLLADMRRSLL

SEQ ID NO: 41206 - protein, 669 aa, Solanum lycopersicum
MSVAYRYSNHNRHHHHHHLLILFVLLLQVIVPIKSDNNEAEILLRFSKSLQKNDATANWNTKVSPCDKKTDRPNWDNVICENGFVFGLQLENKGLSGTIDVDALKDLPNFRTISVMNNNFEGPIPNLSKLAGLKTAYFTNNKFSGQIDNSFFEGMHWLKKLHLGNNQISGKIPSVFGQLPKLTELRLENNKFEGQIPDFNQERLIDMNFANNSLQGPIPHGLASLKPSAFEGNNLCDGPFSKCTSEPKVALWTIILVVIAVAAAVAAIVVVIIILRRGKQTPETETRPIPTPSGAAAGGATNQTGAPSAAELNKMEQGSNQAIAARDQSPEGTAVLNTNKRPEVQAVQQKLLFLKDDIEKFDLPDLLKASAEILGSGVFGSTYKAALSRGRVMVVKRFRQMNNVGKEDFHEHMRRIGRLSHKNLLPVVAYYYRKEEKLLVSEYVNNVSLAVHLHGNKSRGQPSLDWPTRLKIVKGVAKGLLYLYNELPSLTAPHGHLKSSNVLLNESYEPLLTDYALLPVVNLEHAQEHMIAYKSPEFKHNGRITRKNDVWTLGILILEMLTGKFPSNFLQQGKGSDTDLATWVRSVVNEDMTEVDVFEKEMRGTTNSEGEMMKLLKIALGCCDLDMKKRFDIKEAMERIEEVKERDGDDDFYSTRGLSDDYTQVSMNI

SEQ ID NO: 41207 - protein, 271 aa, Physcomitrella patens subsp. patens
MDLAANTRVGFIGAGQMAEAIARGLDRSGLVPADRMYASDVNVSRTQVFESLGTSICSSNSKLAENSNVLILAVKPQAAEKVVTEMRPSLSKDHLLVSIAAGIPIKKLQVWAGDARIVRVMPNVNCLVGETAAGMSLGKTATPADSDLVATMFGSLGKIHVVDERLLNAVTGVSGSGPAYIFMAIEALADGGVASGLTRDVAMSLAAQTVLGSAKMVLESKKHPGELKDMVTSPAGTTIAGVRELEERGFRSALINAVLAGTKRGEELAGN

SEQ ID NO: 41208 - protein, 368 aa, Mesorhizobium sp. BNC1
MLRTETYMPYDQKHVVEALRAFERGEIVVVMDDDGRENEGDLIVSAVHCTPEKMAFIVRHTSGIVCAPMPREEARRLNLAPMVAENDAPHQTAFTVSVDFRHGTTTGISAEDRTLTVRNLANPNVGAQDFVRPGHIFPLVAREGGVLMRSGHTEAAVDLCRLAGLPPVGVICELVNDDGTVMRGPQVTAFAEKHGLKQVSVADLIAYRQRKETLVERVASFPVSTAAGQATAYAYTLPWEVMQHLAIVFGDIRDGQDVPVRLHTENVVQDVFGMERRLQQIMERMGSRGVLVYLRAGSVGVAHQQRRLAGGEDHEEAVRRENEWREIGLGAQILKDLGITSIRLLASRERHYVGLEGFGIEIASTEIL

SEQ ID NO: 41209 - protein, 443 aa, Leuconostoc mesenteroides subsp. mesenteroides ATCC 8293
MGNNEQKLNRGFGLTASLALVVGTIIGSGIFFKQGSVLESAGSTNAAMLAWIAGGLLTLASGISVAEIGSQMDKTGGIYIYIEKIYGKVWGFLAGWMQVVFYGPAMMGSIAAYFGILFVDLFGLSKSLAIPSAIIALSFVGLINSIPNRFSAGFQIITTTVKMLPIIALIIFGLFFGQHDAIGQTVAQVSQSGQGGFGVAVLATLFAYDGWVTLANISGEIKNPQKVLPKAIIFGILIVLVAYVGVSFGVYQSLPANTIVKLGQNTTLYMATNAFGIIGGRLLSIAVLISLLGTLNGKIVSFPRVLFAMANDGLFPFAKQFAKINMRSRTPNKSIWFMIFLGILMIVFTNPDRLTDIAIFTTFLFYILVFAGVFKLRKKDPFGEKRSFSMPLYPWIPIVAICGSLYVEISEIMHDLSGVIISIAIVAAGYPVYIFLSRRTNKE

SEQ ID NO: 41210 - protein, 336 aa, Arabidopsis thaliana
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMFQEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 41211 - protein, 792 aa, Escherichia coli O157:H7 EDL933
MSNNGSSPLVLWYNQLGMKDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGHPMDIEWAKDGHTGKLFIVQARPETVRSRGQVMERYTLHSQGKIIAEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPNEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 41212 - protein, 282 aa, Oryza officinalis
GDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKGAEFKTHPMNFLNERTLKGTFFGNYKPRTDLPNVVELYMKKELEVEKFITHSVPFSEINTAFDLMHKGE

SEQ ID NO: 41213 - protein, 385 aa, Coccidioides immitis RS
MASIFRRGLEYLSPSASPAPSSVSDYEATSVPATGKPAVASKVITAQSPSTLFTVVDPTVDGEDCDHDCASCTIKYPAKFSVDYEDELYGHVKGWATHVLVATGKTDWVRDVADEKGSVMEAIERGGVSAKNGALKLSASNIPVPDEYYHHPEGEQPTTVLLLPAFTIIDHVTPALVPNLIRQFVDLSPTTTTPLSDVMQIAGQEEPTEQTPSDINIPERPPLDLKDLSESLPTSLRSRPCSHAAVILLCSQKTRDARCGQSAPLLRREFERHLRPLGLYRDLHDERPGGVGIYFISHVGGHKYSANVIVYRRRNFEWFKEGKDDCSNNVESMEKEGASQGIWLARVRPEDCEGIVKFTVLQGKVVKPGLQLRGGFDREKGLISW

SEQ ID NO: 41214 - protein, 262 aa, Zea mays
MDRYQRVEKPRNDTPISQNEIRITTQRRMRNYISYGMSLLEENGHDEISIKAMGQAINKTVMVVELIKRRVGGLHQNSATESVDITDTWEPLEEGLLPLETTRHVSMITVTLSKKPLDTSSPGYQPPIPAEEVKPAFDYDHEDSYPTGRGRGRGGGRRGRGRGMSNGPSPPAYGYNEEWGEEGDYYNRGRGRGRSRGRGRVRGGYYGGGRRGGYSYGYGARGGYYEEQDEYYDDPEEYAPPGRRGRGRGRRGMPWRGRGVYY

SEQ ID NO: 41215 - protein, 478 aa, Escherichia coli O157:H7 EDL933
MTLSFITRWRDELPETYTALSPTPLNNARLIWHNTELANTLSIPSSLFKNGAGVWGGETLLPGMSPLAQVYSGHQFGVWAGQLGDGRGILLGEQLLADGTTMDWHLKGAGLTPYSRMGDGRAVLRSTIRESLASEAMHYLGIPTTRALSIVTSDSPVYRETVEPGAMLMRVAPSHLRFGHFEHFYYRREPDKVRQLADFAIRHYWSHLEDDEDKYRLWFNDVVARTASLIAQWQTVGFAHGVMNTDNMSLLGLTLDYGPFGFLNDYEPGFICNHSDHQGRYSFDNQPAVALWILQRLAQTLSPFVAVDALNEALDSYQQVLLTHYGQRMRQKLGFMTEQKEDNALLNELFSLMARERSDYTRTFRMLSLTEQHSAASPLRDEFIDRAAFDDWFARYRGRLQQDEVSDSERQQLMQSVNPALVLRNWLAQRAIEAAEKGDMTELHRLHEALRNPFSDRDDDYVSRPPDWGKRLEVSCSS

SEQ ID NO: 41216 - protein, 1690 aa, Cryptococcus neoformans var. neoformans B-3501A
MILGTDIDLSSIPTAFLEAYPFPAVVIVIDSSLRPRPPLHSRDTDVTVRQTDGQISPLASPPVQQFASAPVAWGNQRWNELTQGKTIAECVDVISQNKLQTWVEGDIGEKSESFTLDMKLPEGVTLHLAKTILPLSPPSASQSFCILTSQYINKPESFTPSISSSDVLFSPLPRFSQTFSRSSSFSSNPRRSIDVPASLPGHRGSATSTSSNLRSSVDLTSPNSEYSPPSREQSTYFTHRFAVREERPSVRRRRSPPNSFKRSKPPESHAQDCWDLVENFDWSKTALGPREQWMDALDPVLAITFESRTADCAWLGPDLELVYNKAYQELIDHPSAFGKPARQVWATNWDYLEPLVKRCLSGTPVYKDNDPLFWRRYGNGRLLEHYHTWRYVPITGKDGSVLGIFNQSIEVTDSVLLERRMGTTRELLEHMSFIRTTEDFFSSIADVFSQNPTDIPFALCYRVRQVDTDGTFVHLDVSLQSSVGVPEGHPSAPDQIPISFFNGNPYPSNVERSFSPAFSIVSIHSSSSHRVCHVSEDTTQWPIAKALQRRQCVIIEECSQLIEGYPIRRWDELPFSAIVVPICSEGSPEIPDAVVILGLNVRRCFDHEYDSWIHSIRSQLSSALVTVKAREAEQKMVEENARMEKAKVAWFRGAAHDLRSPLTLVAGPLADVLDSDLSPNQRTSLTVAQRNLDRLVRLVNALMDFSRVEAGRMEGRFVPTNLSQFITQLAALFKPAVERLGLEYVLDVQPREELVFVDPVLFETVVSNLIGNALKYTETGCITVRVKYTDYAEVSVIDTGVGIPKNELALVTEWFHRASTAIHSGTQGTGLGLALAKELLKLHKGELLVESQTANESGGPHGSIFTARVPLDFKPSPSAHIIPSVESPKTFGKYSQVVANEAMRWVGDSDDFSEACDMSSGTGGSSASNGSGNTTAFGPKFADAFLFDRNDVVLIVEDNADMREYIRQLFTPYCTVVEACNGEQAYSMATQNPPNLILSDVLMSKLSGTELLQKIRSHPDTRIVPMVLISAIAGDESRVEALLNGADDYLAKPFKPKELIARVHLHMQVGKKRAKLEALYAQRETELTALSDYCPIGIFRGDKYGHIVYANAAWRAQSGLLVGDPNDWASYVHPESKAQLLEEWNQWLRGDLKEFRAAWRWSNGIPVRSILVRLDHVKEGFSGLIGCVVDVSHEERRLIEAEERRKEAEESKHQQELLIDLTSHEIRTPVSAILQCSDLVKENLVALKDQLRGAGPKGFVPTPELLADLEQDVEALESIYQCGLVQERIAGDVLSLARIQLDMLSLHDIDVNLRREGRKVSSIFASEAKMKDIDLRLEFGPTIEQSKVLAIKTDPVRLGQVVTNLISNAIRFTSSSAVRKITIQYDVSFVPPADDSCAVPSSGVPDILPAKENTPLWLFVSVTDSGPGMTEQELSVLFQRFAQGNKMIHTKYGGSGLGLFICRKITELLGGRIEVLSQLGHGSVFRFFIKTRAVAPPSAIAALVESSPLKPISATSPSSSLAMSRSSSRSTNVTTPIEGSGTEHVLIVEDNLINQTVLKRQLIKAGLSCNVASNGLEALNIIRETHRQHRRGGPNRKRLFDVVLMDLEMPVMDGITAVQEIRGSEAAGTLGRNMVIALTGNARQGQIDHALASGFDDVVIKPYILVDLLKKIKFMKVRRLELETAKAQEE

SEQ ID NO: 41217 - protein, 132 aa, Solibacter usitatus Ellin6076
MKNIFVGNLDFNASEEGVRSLFERYGQVNSARIMTDRETGRSRGFAFVEMENEGEADQAISALNGYTLDGRALNVNEARPKPDRGFGGGGGGGRGFGGGGGGGRPGGGGGGGGRRPGGGGGGGGGNRREPRW

SEQ ID NO: 41218 - protein, 289 aa, Brassica napus
  misc_feature (203)..(203): Xaa can be any naturally occurring amino acid
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAPGYSKGSGLGAEIIGTFVLVYTVFSATDAKRSAXRDSHVPILAPLPIGFAVFLVHLATIPITGTGINPARSLGAAIIYNKDHSWDDHWIFWVGPFIGAALAALYHTIVIRAIPFKSKSKS

SEQ ID NO: 41219 - protein, 500 aa, Vitis vinifera
MEGGGGWKRPKTKIVCTLGPASRSVEVIEKLLRAGMNVARFNFSHGSHAYHQQTLDNLRTAMANTETLCAVMLDTKGPEIRTGFLKDGKPVQLKKGQEITISTDYSIKGDDHMICMSYQKLAEDLRPQSVILCADGTITLTVLACDKELGLVRCRCENSAVLGERKNVNLPGVVVDLPTLTEKDKEDILEWGVPNKIDMIALSFVRKGSDLVEVRMLLAEHAKSILLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPELAVQTMARICLEAENSLNYGDVFKTIMETAPMPMSPIESLASSAVRAANGSKAALILVLTRGGTTANLVAKYRPSMPILSVVVPEITADSFDWSCSDESPARHGLIFRGLVPVLCSGSAKASDSESTEEALEFSLQYAKTKEMCKPGDSVVALHRVGTASVIKILTVK

SEQ ID NO: 41220 - protein, 359 aa, Coprinopsis cinerea okayama7#130
MLTSSQWEWASTASRMKGDIDIVFSSAKDQLTGASVAIKKIMKPFSTPVLAKRTYRELKLLKHIQHENIISLSDVFISPLEDLYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDIWSTGCIFAEMLEGKPLFPGKDHVNQFSIITELLGTPPDDVIETICSENTLRFVQSLPKRQRVPFSQKLRTTDPDALDLLERMLVFDPRKRINASESLAHAYVAPYHDPTDEPEAEEKFDWSFNDADLPIDTWKVMMYSEILDFHQVDQGQGLGIPEGALAGPEDGGYSNGHA

SEQ ID NO: 41221 - protein, 129 aa, Triticum aestivum
MAMISPAAATVVAARPAQALGLPQLRVTRAEKLRCAYSKDGKEEAAAATPAVVKGVPLLAAASAAMTAASPALALVDERMSTEGTGLSLGLSNNLLGWILLGVFGLIWSLYTVYSSTLDDDDESGGLSL

SEQ ID NO: 41222 - protein, 717 aa, Physcomitrella patens subsp. patens
MKRQWIIFIIGMLLVLFLPVYAVWQQFVMDRQPTAVEGLLDLSKLDLRNHGAISLNGEWEFYRSQLLTPKDFDRTITVKEDERPRLSGMARLPGAWNDYIAEDGQRMAEGYGTFRLIVQVKPGQALTYGLQTNNIRSASRVFMGGYEIGASGNPGRTADDGVQNNVPFLGFATLSGGRIEIIVQIANYLYTTGGVFTPILFGEQHAIMQSKELYLFADWMTIAGFFTAALYFLGFQQIRKKEPASLYLGLFCLAAIIYVLLHGEKLIDGFWPGLSYEWILKSQLMISALIYYFLLKFVSASVRGGVHPIVMRSYAFLGGASIAVAIIFPSILFSKIEPLLVAFSASCIAYIIGIMLRDLRRRRNSGEYLLTILGIISILMVIITNLLPLIGMPDHGAELATVLMVDDDPVNLQVLRNLLALEGYRLMTASNGQEALEKIQSGQSIDLVIADWMMPGMSGLDLCRSVRRQFSLSALPILLLTARSLPEDVRIGLSAGANDFLRKPVDAEELRARVRTLLELRRSVRNAISAEMAFLQAQIKPHFLYNALNTMIALLPIDPEKTAELLHELSRYLRGSFDFRNRDQLTVLRQEMALVTSYLNLEKARFEDRLQVDYDIQADMNRLVPPLTIQPIVENAVRHGIMRKEEGGRVRILVQELEERLEITVEDNGTGMTPERMEAVREGRAGNGVGLKNINARLLTLFGTELMIDSDPERGTV

SEQ ID NO: 41223 - protein, 369 aa, Oryza sativa
MATFELYRRSTIGMCLTETLDEMVSSGTLSPELAIQVLVQFDKSMTEALENQVKSKVSIKARSINSYHIAANLVRWLDAIHHFSSSINSLLNKELLNTLQPNLRIILAIERWERFKGHLHTYRFCDNVWTFILTEASFKNEETTEQVGKVKIVAFLPQASCCRAVLTTKDTVTHFTENGVVVVMYSEIAGDDEWWEYIPCPFCYIEVEVHFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 41224 - protein, 387 aa, Ralstonia metallidurans CH34
MTEQDKSPAADAPAQEAGRQDAPGPSAQEQALSADLAPLRTQIDTVDRELLALLNRRAQLALDVGEVKKKYGAPVFRPERELQVIRKVQGANPGPLLDESVASIWREVMSACRGLEKPLEIAFLGPAGTFSEQALYAHFGHEVTGVPCPSIDEVFRAVEAGTVEYGVVPVENSTEGAVSRTLDLFLQTSLKISGEIALKVHHNLMASTPDMKGVTVVRAHAQALAQCQNWLSANYPHLERQAVSSNAEAARMASEDPTVAAIAGETAANRYHLHIIRSHIQDDPHNRTRFAVIGRYETEPSGSDQTSLILSVPNKAGAVYQLLAPLAENGVSMCRFESRPARSGAWEYYFYVDVEGHQHEPAVTRAIEMLRRNAAYLKVLGSYPSSK

SEQ ID NO: 41225 - protein, 422 aa, Oryza sativa Japonica Group
MASLHRPLSAMAVAAFAAVSSLELPDRLSHHKLPDTTVDAEAVVSIPASRPDVSAAPSASAMSRLHFLPRNLQTSHPAKAPPASLPVIHTVYHYAKFAKYYSEEEAVTTAMPSSSSPDVLYLWHLPDPKVCGDSHGKSQTVVVLLGWLGSRQKHLKRYADWYTSRGYHAVTFTLPMSDIVSYNVGGKAEKNVEMLSEHLADWVSEEDGKKIVFHTFSNTGWLCYGVILENLQRQDPSAMDKIKGCVVDSAPVAVPDSQVWASGFSAAIMKKHSVAAKGVKPNDARPDVLVVESNKDHPKPAVSEAILLSALEKLFDVVLNYPAINRKLSGVMELLSSKQPKCPQLYIYSSADRVIPAKSVESFVESQRRAGHEVRACDFVSSPHVDHYRSNPELYTSQLTEFMEDCVLARCQAKEEEEEVTN

SEQ ID NO: 41226 - protein, 724 aa, Physcomitrella patens subsp. patens
MVARSILDARTDLTVSGSPQQAARRIYVAHCPERVMPGQILRELVENDRIIGGIDIESTQRTVAFYKQFVSGKILETDAKTAEMAKLTENSFRDVNIAFANELSLICDQLDINVWELIRLANHHPRVNILQPGPGVGGHCIAVDPWFIVHAAPEQAKLIHTARIVNDYKPGYVVNKVAERAKRLKSPVIACLGLSFKANIDDLRESPALAIVEHLAKARIGDIYAVEPHIQLLPASLAEAGVQLLETVEARIAPGTGRGALMSTLMMKVKKLRRMPLHAAAAKVAVKALDETRTAYLSIRHRLAPAVLKPSLFSGFRSRGRFLFDPEDKERYAELLCKGGADTEIIRQADRICVHEFDLLGSGPVTLGERLPWHEDFKTGFRWEPRNGIEFTPEYMKRLEKMHEFMLDLMKQDGRTPVVGDADDGRVMIASGYGRWAPADCRHMLAVAGELFNRDDFRRAGRLHREEAMWIAGLPALRPYAAPERASASRPCAAYPDGGYYVLRSSSAYCLVRCGELSFRGQGAHSHNDQLSFELQVSGQDIFVDPGAYIYSADYRLRNLFRSTGMHNTVQVGGYEQNDFDEHDLFLMREQTFARCDAFREGLFAGSHSGYAGKCGVIHRRVFDFHDGELMLSDRLDSVSLGAEEIREFTASFMLAPGAAAAQRDGIVLIRQAGVTIHMNFEGASAIQLEDSWVSERYGVRRPSRLIRVRSSHPEGLSTRIRWK

SEQ ID NO: 41227 - protein, 662 aa, Physcomitrella patens subsp. patens
MALIFSHDRYGLIILEVTRRLLLVLVKAPRRVASNLRIEGPTSERSFKARDLSTRKRVLLLVKLERLIVKHNGLVRGSYEVDTDRFLWACIVAGGVHEHSTVAKQPKTYFPKLHSAANSNSRQRDQKSQVRVPQDHEKSNQAPEQTPSAHEPSSTNVVEAIRVVSGFCSRGGCGVFRVVAGSSETVLDMAPYVPGDNLHYGNMKVGYSVDDGQETTYLDPRLPLLQHADLKDKVVLLRVDHNVVKKGKILDQYRIDVTLATMYNIIERGGRPIIMTHIGRPYDKKTKTLTIKQDDSVDAVVAYLQRKLRIKFAVPQFHVTEKEGIHDIDTSINWLIHDLRARKIGGIYLPNTRWFAGEEDKGVNMERFVVQLAGLADVFVNDAFGSWQPHASTYHITKYLPSYAGLCMQAELSHVREVLEPKHPFVAVVAGSKYDTKIGPLTEIYKKVDNLILGGIIYNTFLCAKYNVRMKGVEESDIELAKGLVEQDKLQKKILELPMIVETDTLAGRFEGQFRTINVNDFKEGQEFGYVVDVDPASFETPEVRQVLESAKTIFVNAVMGMMPAFWHGTSKMDEAIDRNTTAQKFFGGGDTLQEFKSLWPGLYQAALDSAKYYLFTGGGTVLKVLEEGDPFGLPTVRALIENGEQYGHSQENGRSSSPTRM

SEQ ID NO: 41228 - protein, 650 aa, Mesorhizobium sp. BNC1
MSKIKNDKRETGHLKSPPETPLLNRVRFPSDLKQIPEEDLPQLAEELRAEMIDAVSQTGGHLGAGLGVVELTVALHYIFDTPHDRLIWDVGHQAYPHKILTGRRDRIRTLRQEDGLSGFTKRSESEYDPFGAAHSSTSISAGLGMAVARELSGGQRHVIAVIGDGALSAGMAYEAMNNAGALDARLIVILNDNDMSIAPPTGAMSTYLARLASGRAYRGIRDVGKKLTSHLGKSFDRAITRAVEHARGFVTGGTLFEEMGFFHIGPIDGHDLEALVPVLRNVRDNGTGPVLIHVVTQKGKGYPPAEAAADKYHGVAKFDVITGAQAKSPAGAPSYTKVFAQALVQEAREDKRIVAITAAMPSGTGLDLFEKEFPDRSFDVGIAEQHAVTFAAGLATEGYRPFAAIYSTFLQRAYDQVVHDVAIQNLPVRFAIDRAGFVGADGATHCGAFDVAYLATLPNMVVMAAADEAELKHMVRTAADHDEGPIAFRYPRGEGTGVPLPQRGEILKIGKGRIVREGSKIALLSLGTRLADCMIAAEELEAAGLSTTVADARFAKPLDADLIRRLAREHEVLVTVEEGSIGGFGAHVLHFLAHEGLLENGLKVRPLVMPDIFMDQAKPEKMYAKAGLDAAGIVKTVFAALGQAEQAARA

SEQ ID NO: 41229 - protein, 163 aa, Triticum aestivum
  misc_feature (136)..(136): Xaa can be any naturally occurring amino acid
MAQRDHKQEEPTELRAPEITLCANSCGFPGNPATQNLCQNCFLAGPASTSPSSSSSSLPGVSAPTPVIDRPRPAPLEAELARPAVDRAPATEAKPARTSVNRCSSCRKRVGLTGFRCRCGDMFCGEHRYSDRHGCXSYDYKAAARDAIARDNPVVRAAKIVRF

SEQ ID NO: 41230 - protein, 513 aa, Ashbya gossypii ATCC 10895
MLATAQVRTLRALVRCYSSLPLTVQVRLPNGNSYEQPTGLFIDGKFVPSHQAKTFEVIDPGTEEEITHVYEAREEDVDAAVAAAKRAFLPWSRADPEVRAQCLFKLADLIEKHQETLANIESLDNGKSLLCSRGDVALVARYLRTCGGWADKIYGNVMETGPDHFSYTRREPLGVCGQIIPWNFPLLMWSWKIGPALATGNTVVLKPAESTPLSALYVCNLANEAGIPKGVMNIVPGFGKIVGEHLCTHPDVKKVAFTGSTATGRHIMRTCAETVKKVTLELGGKSPNIVFADADIDKAVKNIGFGIFYNAGEVCCAGSRVYVQDSVYDEVLEKFKQFSENLKVGNPFEEGVFQGAQTSQMQVDKILSYVDIGVKEGARIVAGGERLGRKGFFIKPTIFADVNENMRVVKDEIFGPVVTVSKFSTVDEVIAMANNSQYGLAAGIHTTDINKAIDVSNQIKAGTVWVNTYNDFHPNVPFGGFGQSGIGSEMGVQALDNYTQTKAVRMAIDHVKV

SEQ ID NO: 41231 - protein, 514 aa, Lactobacillus sakei subsp. sakei 23K
MSILKVEGLSQQFLDKQLYDDAGFQVNKGEHMGITGQNGVGKSTLINILTGAILPDEGKVTWQKNIKIGYLDQYAKLAPGLSIFEFLKTAFADLYAQEERMSQYYADYATSLDDQLLEKAGAIQELLEAKNFYEIDTRVMQVATGLGIDALGMDHDVSQLSGGQRSKIILAKLLLEEPDMLLLDEPTNYLDTNHIDWLSDYLNNFEGAFITISHDYDFLERVTTCIADIEFGKITKYTGTLQQAFRQKADNQASYMKAYENQQKKIEKTKAYIRKYKAGSRSTIAKSREKQLAHMDILTPPSNRVKANFRFPYHATASQILLTTNDLEIGYENALLPALNFSIGRDQKVVLKGFNGIGKSTLIKTIIKEIPAISGDFEIASTVKFGYFKQDLKWPNNMATPLQYLQGEYPEQKQKELRQVLSRTGLTAEEAMKPLKQLSGGEQSKVKIAELLLTSSNFLLLDEPTNHLDDDTKNALRKAIQEFEGGVLLVTHEEDFYQGDWIDKVLDVESLIKS

SEQ ID NO: 41232 - protein, 171 aa, Bacillus clausii KSM-K16
MDYKQYITIVEDWPQEGIRFKDITTLMQNGTAYKRAVEELAVYAKEKQADVIVGPEARGFVVGCPIATELEIGFVPVRKKGKLPREVIEANYGLEYGKDCLTIHKDSIQPGQRVVITDDLLATGGTIEATAKMVEQLGGKVVGIAFLIELAYIGGRDKLKQYDLFSLMSYE

SEQ ID NO: 41233 - protein, 255 aa, Leuconostoc mesenteroides subsp. mesenteroides ATCC 8293
MNYGFIGAGNMATAMIKGLIYAGIDSKNIYVSSPHSAAKLAANLHIQAADSETIAKKCDIVIIAFLPNQLRTLGNSLNLDGKIVISVLAQVTIADLDEVFPTAFNVRSLPNINSAIGKGSTALAFSKRLNEGQIEVVQNYWHLLGTTSVLDEQHFAIFSAIAGSGPAFVLKFIDALTQAGINNGLDGESAAAIAASTVAGTTETLQKSNSDAVTLMNNVASPGGSTRAGLDNFEQNDFDTIVNSAINATVNHKHT

SEQ ID NO: 41234 - protein, 540 aa, Anabaena variabilis ATCC 29413
MNTAVTLLTEQAPQPIEEFGQLERQIIIILDFGSQYSELIARRIRETQVYSEVLSYRTSAEHLRQLNPKGIILSGGPSSVYSDRAPHCDPEIWNLGVPILGVCYGMQLMVNQLGGEVAKADRGEYGKASLHIDDPTDLLTNVEDGTTMWMSHGDSVTKMPPGFEVLAHTDNTPCAAVADHDKKLYGVQFHPEVVHSIGGLALIRNFVYHICECEPTWTTAAFVEEAIREVRAKVGDKRVLLALSGGVDSSTLAFLMHKAIGDQLTCVFIDQGFMRKYEPERLVKLFQEQFHIPVEYVNARDRFLDIMVGVTDPEEKRRRIGHEFIQVFEETSRNLGPFDYLAQGTLYPDVIESADTNVDPQTGERVAVKIKSHHNVGGLPKDLRFKLVEPLRKLFKDEVRKVGRSVGLPEEIVQRQPFPGPGLAIRILGEVTADRLNILRDADLIVRQEINQRGLYNEYWQAFAVLLPIRSVGVMGDQRTYAYPIVLRIVKSEDGMTADWARVPYDVLEAISNRIVNEVKGVNRVVFDITSKPPGTIEWE

SEQ ID NO: 41235 - protein, 511 aa, Liquidambar styraciflua
MDSSLHEALQPLPMTLFFIIPLLLLLGLVSRLRQRLPYPPGPKGLPVIGNMLMMDQLTHRGLAKLAKQYGGLFHLKMGFLHMVAVSTPDMARQVLQVQDNIFSNRPATIAISYLTYDRADMAFAHYGPFWRQMRKLCVMKLFSRKRAESWESVRDEVDSAVRVVASNIGSTVNIGELVFALTKNITYRAAFGTISHEDQDEFVAILQEFSQLFGAFNIADFIPWLKWVPQGINVRLNKARGALDGFIDKIIDDHIQKGSKNSEEVDTDMVDDLLAFYGEEAKVSESDDLQNSIKLTKDNIKAIMDVMFGGTETVASAIEWAMTELMKSPEDLKKVQQELAVVVGLDRRVEEKDFEKLTYLKCVLKEVLRLHPPIPLLLHETAEDAEVGGYYIPAKSRVMINACAIGRDKNSWADPDTFRPSRFLKDGVPDFKGNNFEFIPFGSGRRSCPGMQLGLYALETTVAHLLHCFTWELPDGMKPSELEMNDVFGLTAPRAIRLTAVPSPRLLCPLY

SEQ ID NO: 41236 - protein, 743 aa, Zea mays
  misc_feature (690)..(690): Xaa can be any naturally occurring amino acid
  misc_feature (703)..(703): Xaa can be any naturally occurring amino acid
MSVLNSLGILLLLTAPAFAAALSADGLSLLAFKSAVTDDPSMALSSWSDADADPCRWLGVTCVNSSSSDGLRVVGVAVAGKNLSGYIPAELGSLAFLRRLNLHGNRLSGTVPAALANATALHSLFLYDNRLTGPFPAALCGIPKLQNLDLSQNALTGALPLELGRCKQLERLLLAENALSGNIPAAVWQDMVGLQMLDLSSNNLTGAIPAELGKLAALAGTLNLSHNHLSGGVPLELGRLPATVTLDLRFNNLSGEIPQSGSLASQGPTAFLNNPGICGFPLQVPCRVAPPSSSSSLPPPPPSSSATTNGGAGGARLPIKTSLIVLISVADAVAVALVGVIVVCVYWKVCDRRRAAKDKGDDSEYEEGCGLFPCPCCMRADACGDSSSECSEVDGKCNGGGGTGEGGYLVAIDKGFRMELDELLRSSAYVLGKGGKGIVYKVVVGNGTTPVAVRRLGGGTAAPERYREFAAEAGAIGRVRHPNIVRLRAYYWSADEKLVITDFVNNGNLATALRGRSGQPSLSWTLRLRIAKGAARGLAHLHECSPRRFVHGEVKPSNILLDADYNALVADFGLARLLTIVGCTDVYSVAGSGGIMGSGLPYARPAALTDRSCSAYRAPEARAPGGAQPPSQKSDVYSFGVLLLELLTGKPPEHASPSASSSSMPGHNGQRELEQQAPELVRWVRQGFEXRGRSRVSLEGPEXLRVRKEVVAAFHLSLRCVEADPERRPRMKAVSDSLDKIGA

SEQ ID NO: 41237 - protein, 215 aa, Zea mays
EHHVKSRSDKQLRFGAKYTADSCSPVEWDNNGSPIVPCGLIAWSLFNDTYGFTRGSKEIKVNRKNISWKSDREHKFGKHVFPSNFQNGTLIGGGKLDPTVPLSEQEDLMVWMRTSALPKFRKLYGVIEDDLHADETIAIFVGNNYNTYTFGGKKSIVLSTASWLGDKNDFLGHAYIVTGSLSIIISILFALIHVKYPRPQGDPNCLSWNRKNSNS

SEQ ID NO: 41238 - protein, 227 aa, Thermus thermophilus
  misc_feature (24)..(24): Xaa can be any naturally occurring amino acid
  misc_feature (101)..(101): Xaa can be any naturally occurring amino acid
  misc_feature (163)..(163): Xaa can be any naturally occurring amino acid
  misc_feature (210)..(210): Xaa can be any naturally occurring amino acid
MERPLESYKKEAAHAAIAYVQDGXVVGLGTGSTARYAVLELARRLREGELKGVVGVPTSRATEELAKREGIPLVDLPPEGVDLAIDGADEIAPGLALIKGXGGALLREKIVERVAKEFIVIADHTKKVPVLGRGPVPVEIVPFGYRATLKAIADLGGEPELRXDGDEFYFTDGGHLIADCRFGPIGDPLGLHRALLEIPGVVETGLFVGXATRALVAGPFGVEELLP

SEQ ID NO: 41239 - protein, 480 aa, Photorhabdus luminescens subsp. laumondii TTO1
MSRRLRRTKIVTTLGPATDRDNNLEKIIAAGANVVRLNFSHGTAEDHLQRASKVREIAARLGCHVAILGDLQGPKIRVSTFKEGKIFLNIGDKFLLDANLGKGEGDKEKVGIDYKGLPTDVVPGDILLLDDGRVQLKVLDVQGMKVFTEVTVGGPLSNNKGINKLGGGLSAEALTEKDKEDIITAARIGVDYLAVSFPRTGEDLNYARRLARDAGCETQIVAKVERAEAVSSDKTIDEIILASDVVMVARGDLGVEIGDPELVGVQKKLIRRARQLNRVVITATQMMESMITNPMPTRAEVMDVANAVLDGTDAVMLSAETAAGQYPAETVAAMARVCLGAEKMPGLNVSKHRLDTIFDSIEEAIAMSTMYAANHLNGVKAIIAMTESGRTTRIMSRISSGLPIFSMSRHEKTLNQTALYRGVTPVYCSSHTDGITAANEAVNRLRDKGYLVSGDLVLVTQGDQMGTIGSTNTCRILEVE

SEQ ID NO: 41240 - protein, 253 aa, Brassica napus
MPTRNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGLLYWIAQLLGSVVACLLLKFATGGLAVPAFGLSAGVESLNGFVFEIVMTFGLVYTVYATAVDPKNGSLGTIAPIAIGFIVGANILAGGAFSGASMNPAVAFGPAVVSWTWTNHWIYWAGPLVGGGLAGLIYEFVFINQNGHEQLPTTDY

SEQ ID NO: 41241 - protein, 297 aa, Orychophragmus violaceus
MGSLVREWVGFQQFPAATQEKLIGFFGKLKQKDMNSLTVLVLGKGGVGKSSTANSLIGEQVVRVSPFQAEGLRPVMVSRTMGGFTINIIDTPGLVEAGYVNHQALELIKGFLVNRTIDVLLYVDRLDVYRVDELDRQVVQAITQTFGKEIWCKTLLVLTHAQFSPPDELSYGTFSSKRSDSFLKTIRTGSKMRKQQFEDSAIEVVYAENSGRCSKNEKEEKALPNGEAWIPGLVKAITDVATNQRKAIHVDKKMVDGSYSDDRGKKLIPLIMAAQYFIVEMIQGAIRNDIKTSGKPL

SEQ ID NO: 41242 - protein, 491 aa, Photorhabdus luminescens subsp. laumondii TTO1
MAVTSTAQACDLVIFGAKGDLARRKLLPSLYQLEKAGYIHPETRIIGVGRADWDKKAYTKVVEEALNTFLPEKLDSELWKILSERLAFCNLDVNQKEDFAKLKAILKQDNRPAIHYFAMPPSTFGSVCHGLGLAGLNKEPNRVVMEKPLGTDLESSKAINDEVAKYFNERQVYRIDHYLGKETVLNLLALRFANSLFVNNWDNRTIDHVQITVAEEVGIEGRWGYFDQAGQMRDMIQNHLLQILTMIAMSPPADLTTDRIRDEKVKVLRSLRCIDHTNVREKTVRGQYTAGFVQGHKVPGYLEEEGANQSSRTETFVSIRVDIDDWRWAGVPFYLRTGKRLPTKCSEVVVYFKKPALNLFSESYQQLPQNKLTIRLQPDEGIDIEVLNKAPGLEHKHRLQTTKLDLSFSETFNHIPLADAYERLLLEAMRGIQALFVRRDEVEEAWKWVDSIMNAWAADNDAPKPYQAGTWGPVASVAMITRDGRSWNEFE

SEQ ID NO: 41243 - protein, 297 aa, Orychophragmus violaceus
MGSLVREWVGFQQFPAATQEKLIGFFGKLKQKDMNSLTVLVLGKGGVGKSSTANSLIGEQVVRVSPFQAEGLRPVMVSRTMGGFTINIIDTPGLVEAGYVNHQALELIKGFLVNRTIDVFLYVDRLDVYRVDELDKQVVQAITQTFGKEIWCKTLLVLTHAQFSPPDELSYETFSSKRSDSLFKTIRAGSKMRKQQFEDSAIEVVYAENSGRCSKNEKEEKALPNGEAWIPSLVKAITYVATNQRKAIHVDKKMVDGSYSDDRGKKLIPLIIGAQWFIVKMIQGAIRNDIKTSGKPL

SEQ ID NO: 41244 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLFKFFAQTEALAFGKSREVVEQEYRDQGKDPAT

SEQ ID NO: 41245 - protein, 457 aa, Ralstonia metallidurans CH34
MKVTIIGSGYVGLVTGACLAELGNSVFCLDVDEKKIALLNAGGVPIYEPGLKELIDRNRAAGRLTFSTDVAASVEHADVQFIAVGTPPDEDGSADLKYVLAAARNIGRHMTGFKVVVDKSTVPVGTGDRVSAVIREELAARGLEDLQFSVVSNPEFLKEGAAVEDFMRPDRIVLGCAPDVAGRHAQAIMRQLYSPFNRNHERTFYMDVRSAEFTKYAANSMLATRISFMNELANLADEVGADIELVRLGIGSDPRIGYSFLYAGAGYGGSCFPKDVQALMRTASAHGKPMRVLEAVEAVNDSQKQVLGDKIIKRFGEDLTGKTFGVWGLAFKPNTDDMREAPSRVLAREMISRGASLRVHDPVAMDEARRVLELDLADIPDAMARIQFCNAQMDVLKDADALVIVTEWKVFRSPDFSQIRNMLKTPVIIDGRNLYEPDAMAEAGIEYHAIGRSSSAH

SEQ ID NO: 41246 - protein, 184 aa, Triticum aestivum
MSSPSKRREMDLMKLMMSDYKVDMINDGMHEFFVHFHGPKDSIYQGGVWKVRVELTEAYPYKSPSIGFTNKIYHPNVDEMSGSVCLDVINQTWSPMFDLVNIFEVFLPQLLLYPNPSDPLNGEAASLMMRDKNAYENKVKEYCERYAKPEDISPEEEEEESDEELSDAEGYDSGDEAIMGHADP

SEQ ID NO: 41247 - protein, 311 aa, Ralstonia metallidurans CH34
MACEKPTDSAPMAYKTIEDTIGNTPLVRLQRIPGTAIEARGNVILGKLEGNNPAGSVKDRPAVSMIRHAEARGRIKPGDTLIEATSGNTGIALAMAAAIRGYRMVLIMPEDLSLERRQSMAAYGAEIILTPVKGGMEYARDLADAMERDGKGVILDQFANPDNPLAHYETTGPEIWKDTDGRVTHFVSAMGTTGTITGVSRYLKEKNPLIQIIGAQPAEGSRIPGIRKWPEAYLPKIYDPKFIDRQEPVTQADAEHMARRMAREEGIFAGISAAGALCVALRIAEEVENATIVFVVCDRGDRYLSTGVFPA

SEQ ID NO: 41248 - protein, 559 aa, Physcomitrella patens subsp. patens
MEGDDKFKLAPHPKLPKGKKLMLIILDGWGEQIPDEFNAIHRAQTPIMDYLKTTAPEKWRLLKAHGAAVGLPTEEDMGNSEVGHNALGAGRIFKQGASLVDTSLESGAIYEGDGFKYVKQALPNGTLHLIGLLSDGGVHSRMDQLQMLLKGSAKQGFKRIRVHVLTDGRDVADGSSLKFVQMLEDTLGELRQDGCDAQIASGGGRMRVIMDRYENDWNVVKNGWDAQVLGEAPHRFTSCLEALKKLKEDDPGLNDQYYPPFVIVDESGKPVGPILDGDAVVTFNFRADRMVMLAKALDHEDFDKFDRVRYPKIYYAGMLLYDAELNLPTHYLVSPPQISETSGEYLVHNGIKSWVCSETVKFGHVTFVWNGNRSGQFSDTLEKYVQIPSDQGISFDKNPEMKAIAIAEKAAEAFRSGEWDQVRVNIANGDMVGHTGNLEATIVGCTATDKAIKIMLDTVEEVGGVFMITADHGNAEDMVKRNPKTGAPIKDKQGNYQILTSHTCAPVPIAIGGPGLPKGVQFRQDLPNAGLANVASTFINLHGFEAPADYEPTLIEIVD

SEQ ID NO: 41249 - protein, 471 aa, Debaryomyces hansenii CBS767
MPIDILGTAIYEGPEAIPGWEYIKTYTPAIMALAGIKYYFGGTSNTWERDYHGKVYIMTGATSGLGANLAYELASKGAQLILLVRSTEDSWLVDYIEDLRERTDNFMIYAEECDLNSLYSIRKFATKWLDNQPPRRLDGVICCAAESIPIGKARQVTVDGVEKQMGINYLAHFHLLTLLSPALKIQLPDRDVRIVMATCVSQALGDLDMKDALWLNRRYPTREPWKLYGTSKLMLTMFAKEFQRRLNSFERKDKAPCNVRVNMVNPGIMRTPSTRRFLSMGAIWGLLVYFVLFPIFWIFFKSTTQGAQSFLYALAAPVFKNLDGGNVIQECKILKPARKELSDEDLQKALYDETEKLLEALEKSSAIERKRQEKIQESKMPLADKLRAQNEESRKKADIHTKPESPEELQAKLASLKRLIGIPSDANDELPLFPSQPNSSQSESRAENLSTTKSTPKSKSKAKKSKSKKID

SEQ ID NO: 41250 - protein, 255 aa, Bacillus clausii KSM-K16
MLHQFSRNELAIGHDGLERLKGSTVAVLGVGGVGSFSAEALARSGVGKIVLVDKDDVDITNVNRQIHALLSTVGKPKVDLMAARISDINPNCEVITRKMFYTEETYESFFSHKLDFVIDASDTISYKIHLIKQCKLRGIPIISSMGVANKMDPTRLRIADISETSYDPIAKVIRTRLRKEGIHKGVNVVFSDEKPIQIREDIRKEIVPETAEQGNIRKAKLPPSSNAFVPSVSGLIMAGHVITRLLEGIEINRRS

SEQ ID NO: 41251 - protein, 422 aa, Magnaporthe grisea 70-15
MSGIAEDVGLGPRSLTRPISPPRKRQKADNERDARPNPVPKNDGSATKSGSGSETASEPDIASRSKNAQQPRLESPGQAIFSSPFRLTRIRDLGEEDNADALGLNDIIGDPLIAECWDFNYLHDIEFLLDALDQDVRDVVKVHVVHGFWKKDDPSRILLQDDAEKHKNVVLHTAFLPEIFGTHHSKMLVLLRHDDTAQVIIHTANMIPKDWTNMTNGIWLSPRLPLLQGQDPADASQYENLAEGTGYKFKIDLLNYLRAYDDKRVVCRDLVTNLEKYDFSSIRGTLIASVPGRHDFTDLSTSAWGWVAIKRALRSVPLQVGKSEVVTQISSIATLGPTDTWLQRTLFESMCRGKTTGVAPRPQFKIIFPTADEIRRSLDGYGSGGSIHTKIQSSQQAKQLIYQKPLLCHWANDSPHGQGKYL

SEQ ID NO: 41252 - protein, 237 aa, Leuconostoc mesenteroides subsp. mesenteroides ATCC 8293
MAKLVLIRHGQSEWNALNLFNGWIDTKLSEKGIAQAKEAGDLLAAEGIQFDQAYTSVLTRAIQTLHLALEEAGQLFIPEAKSWRLNERHYGALQGQNKAEAAEKWGDEQVHIWRRSYDVLPPLLDSYDETMTVQGNTYPAFDRRYADVPEGELPLGENLKITLERVLPFWESDISKDLKAGKNVVIAAHGNSLRALVKHLENISDDDILNVEIANGQPLVYDLADDLSVVSKKTLTK

SEQ ID NO: 41253 - protein, 470 aa, Bradyrhizobium sp. BTAi1
MTRRIIPLIMCGGAGTRLWPASREVRPKQFLPLFGTRSTFQDTLLRVSDADLFARPIIITNAAYRFMVLEQLAEIGIEADVLLEPMRRDSGPAIVAGAAFAQTRDQDAVVLALAADHVVRDSAAFLAACRAGLAAAETGLIVTFGINPERAATEYGYISPGAPVSGDVRAVAKFVEKPDQPTAERYIREGYLWNSGNFMFRAGVLLDEYRKSDAGSVQTVTDSVTKAGRDLSFIILESDAFAAAKPISIDYAVMEKTERAAVAPVSCGWSDVGSWHAVWELSDKDEQGNAARGTAVFEDSRNCNVVTDKALVALEGVDDLVVVAAQDAVLVSRQRDANGLKRLVAKLKTVAPEVTEAHIKVHRPWGSYQSVDNGERHQVKRIVVKPGQRLSLQRHYHRSEHWIVVRGAARVTVNETVKTVHENESIYIPMGAVHRLENPGKILLELIEVQTGSYLGEDDIIRLEDDYRRE

SEQ ID NO: 41254 - protein, 177 aa, Propionibacterium acnes KPA171202
MTYRKDLIASLIRDVPDFPEPGVTFKDITPLLANPNGYAAAISELVDTASRDVDVVLGMEARGFMFAGPVALSLGAGFVPVRKPGKLPGDVYSQSFVLEYGSATLTVHQDAVQPGSKVLIVDDVLATAGTVRATASLVEQLGAELVGVSVLIELSALGGREKLDRAGIGPVNAVLTI

SEQ ID NO: 41255 - protein, 261 aa, Mycobacterium avium 104
MSRKPLIAGNWKMNLNHFEAIALVQKIAFALPDKYYDKVDVTVLPPFTDLRSVQTLVDGDKLRLSYGAQDLSQHDSGAYTGDISGAFLAKLGCTFVVVGHSERRTYHNEDDALVAAKAAAALKHELTPIICIGEHLEVREAGNHVIHCEEQLRGSLAGLSAEQIGKVVIAYEPVWAIGTGRVASASDAQEVCAAIRKELASLASAQIADSVRVLYGGSVNAKNVGELIAQDDIDGGLVGGASLDGEQFATLAAIAAGGPLP

SEQ ID NO: 41256 - protein, 636 aa, Synechococcus elongatus PCC 7942
MHLSEITHPNQLHGLSVAQLEQIGHQIREKHLQTVAATGGHLGPGLGVVELTLALYQTLDLDRDKVVWDVGHQAYPHKLLTGRYHNFHTLRQKDGIAGYLKRTENRFDHFGAGHASTSISAALGMALARDAQGEDYRCVAVIGDGSLTGGMALEAINHAGHLPKTRLLVVLNDNDMSISPNVGALSRYLNKIRVSEPMQLLTDGLTQGMQQIPFVGGAITQGFEPVKEGMKRLSYSKIGAVFEELGFTYMGPVDGHNLEELIATFREAHKHTGPVLVHVATTKGKGYPYAEEDQVGYHAQNPFDLATGKAKPASKPKPPSYSKVFGQTLTTLAKSDRRIVGITAAMATGTGLDILQKALPKQYIDVGIAEQHAVVLAAGMACDGMRPVVAIYSTFLQRAFDQVIHDVCIQKLPVFFCLDRAGIVGADGPTHQGMYDIAYLRLIPNMVLMAPKDEAELQRMLVTGIEYDGPIAMRFPRGNGIGVPLPEEGWESLPIGKAEQLRQGDDLLMLAYGSMVYPALQTAELLNEHGISATVINARFAKPLDEELIVPLARQIGKVVTFEEGCLPGGFGSAIMESLQAHDLQVPVLPIGVPDLLVEHASPDESKQELGLTPRQMADRILEKFGSRQRIGAASA

SEQ ID NO: 41257 - protein, 242 aa, Arabidopsis thaliana
MAPTIRTIGSYATQQRYSVDFFGEELFVTVTPDPSVIGQWIHDVFFHNRLSSHPLVVGVGVQWTPSGYHPASPPVSYRSDSSPDSYRSDSPPVFYSSDPPADTLQLCVGNRCIIIQLRYCERVPQVLRNFLADRDNTFVGIWNSQDAGKLERSRHQLEIAELMDLREFVSDSSGRRSMYNYSLEKIVEENLGYPGVRLDREVSMSDWRVYNLSYDQILQASIDVYACCSLAILDHLWEEKNR

SEQ ID NO: 41258 - protein, 326 aa, Escherichia coli
KTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYCDQGKDPAT

SEQ ID NO: 41259 - protein, 181 aa, Corynebacterium jeikeium
AQGEIDLATVRDLHFLTAKPFLYVFNSDESVLTDDAKKAELRELVAPADCVFLDAATEADLLELDDEEAAELLESVGQTEPGLQTLAKAGFATLGLQTYLTAGPKEVARGRIHQGDTAPQAAGVIHTDFEKGFIKAEIVAFEDLDELGSMAEARAHGKVRQEGKDYVMADGDVVEFKFNVS

SEQ ID NO: 41260 - protein, 471 aa, Arabidopsis thaliana
MAMSDLPNDLVEEIISRVPVKSIRAVSSTCKNWNTLSNDHSFTRKLFGKTITTKENECLVVMMMDSKVYLMSVNLHRIHKENDDNNIKSSIMHKAKLISLNDDDILNNTYIIFHCNGLLLLLGFTDDGIKLVVTNPHLGQTRWIKPRKANYQFCDKYAIGYEKKKNNSLRTNKMLLFHKESFCFRIYWFEIYNFNSASWNVFYFTRDWELPYSQGVSLKGNTYWFAREINIRGERIDDPPDFLICFDFTTERFGPRLHLPFHSHSDDTVILSSVREEQLAVLIKRFDLWRMEIWVTTKIEPKEVSWNKLFLAVDMIPLITAFQFCNVSFFIDEKKNVVVVLGKDVLNTRNIANIIGNDGYFKQVDLGESTNKYCYPLVCSYVPSSVQIKQATRVMHHHHIVLRAVVRAVRDSDRERKLNNGREHKISRRTRIHERILFRMLKLDEEAIGIRSRSVPRDRYQQGFASSPCRA

SEQ ID NO: 41261 - protein, 168 aa, Aspergillus oryzae
MSGIKAGDSFPSDVVFSYIPYTEEADKFNVCGIPINYNASKEWADKKVILFALPGAFTPVCSANHVPEYKEKLPEIREKGVDVVAVLAYNDAYVMSAWAKANGVKNDDILFLSDPDAKFSKSLGWADEEGRTKRYAIVIDHGKVTYAALEPAKNHLEFSRAETVIKHL

SEQ ID NO: 41262 - protein, 1260 aa, Aspergillus oryzae
MEQKTVPLNPESVRAPLVDVSNRVNNCPSPNLVQGEESMGGLQYLSSPQPMSIVTSPPEQKRYVDNNCLSPTANPKTSSKRNSTLSANSVISNQGKRKTHVGPWQLGRNLGEGTTGRVRLAKHKYTGQTAAIKIVSKTSAAMTQSNSIAEMDRNRGLHGKSGTRHIPSGIEREVVIMKLIEHPNVVRLYDVWENRGEIYLVLEYVEGGELFNYITENGPLQEFEAVKLFRQILAGLGYCHRFGICHRDLKPENILLDSQGNVKLADFGMAALQREGYWLKTSCGSPHYAAPEIVKGDEYRGNKADLWSCGIILFALLTSYLPFDGQDLSSTLKLVKTAKVEIPSNVSYEAADLIHKILQKKPEKRIDMADVWKHPLLRRYECLDPVMHNPYIGPAPSWSVKECGPRISRHELESESDILRNLQTLWHDVEREVLIERLLDPEPTLERMFYNALVRFRDEHLENWPGQSLEYSASDYHHISKDSNGTFSRRDNDRSKGSRRRGQVPMSKVAQLRSNAIQEPKSCATVGSYDPFRSPCHVVPEKEGHTYVTIHRDVPDHGGRKEESDSIAEGSVISEEEFRDQTPCPPSSPFAIVQNKKKPSSLKSFHSRTSHTGNRRQLNGLSAPRSASYKRNVCFRHVRNRSQGSTTAMKPKGAPINVPDKDMSENSLMSIDPGPFADRESSPLLPAQPAVVRRPGVALRTCAPQKKVRESDFIWKDDARQVSHELSQICEEAFNRASLSTGCTTTSTCMSAETPATSVSMASPEASHSRIATSNSKAPVTPSRCGESPRSYTAAELTETRRKLIAHSTQDGTEDVPGYLVAVIKHLDRLIEQDKARQRERVYTPEPEAQPSELSQDAGCLPKISEELHNRQSNSATQYKPYRPGLTTSTGTNTGRPSRNGIGTIRMVPQSSVPSIETIQPLTIRKKSEGPSPNIHHEPFADGSNEENLAPCRYSSMNSFHSRRPCELDPIAEIPPKSEKRNAARYPDNKKWSWLPIKHQPPTETVCKNLRPLHPVDRTVTVHEVNPSADSLTNQPETPAGKSKGGFFKKFMKGKASNPKYPTTGQYHLINTIRTSSNRPVPDSQATETTPILSHPTEPPRLINADKPLPQRPGTSRKPVNWFARMFQFTPATKALALNTSKMKGRKEVHRILREWKPYGITVHYDKADGIIYGKVSRSNIRRIRPVAFSAEFYTVLEDGRRGNLSLVRFKQERGAVSSFNKVIDTLEKFMKRRGLLVEDPVRAQQMMKVLDKYQDPQGK

SEQ ID NO: 41263 - protein, 289 aa, Chlamydomonas reinhardtii
MAAEPDPMRETGRYERVQSLGKGAFGFVQLGRNLQNGELAAIKFLKRGDVNKYVESEILNHSVLRHPHVIQFKEVFLTSEYIAIAMEYATGGSLFHYVQKQTRLKEAVARWFFQQLIIGVDYCHKRGVANRDIKLENTLLQKVNGLPLPLLKICDFGYSKADFKSAAKSKRAGRGCVGAWGHWGTGAVWEQPGAAGRVADIWSCGVMLYVMFYGRYPFETPAGSAMPKATEILAMLDNMRYELSPHVEISDQGKDLLRKMLLPDPKQRITLEAVMTHPWFTTNLPPEVR

SEQ ID NO: 41264 - protein, 349 aa, Microcystis aeruginosa PCC 7806
MNIQDTKFQLKRFLSIRVERERPIIWIGKLPPNAIKIEHPPFYLAKMLEILSEPHTFEDLWQKMKLEYPQCYQDELKDSFINLLKLGVISPQFTEGRYHRHQLYFDLFQISPEHYYQTLSTKTVGLIGSGGIGSTAALLLTTAGVGTLILSDEDFIEESNLTRTILFEESDIGTRKVISAKARLESRNQETTIVPVIKMCDGVDFLKEYFSKCDVLLVSADSPSDIHHWVNQAAVELKTPYVTAGYVEIFGSVGPFIVPGITACYNCHLLNTKQPSRKFRQLNNNFQTASYGPLNGLVSSIVVNEILRYLLNLDTKTLAKQMLINSSNYTVSFIEYQKNSQCYCQQSIH

SEQ ID NO: 41265 - protein, 310 aa, Escherichia coli CFT073
MLDANKLQQAVDQAYTQFHSLNGGQNADYIPFLANVPGQLAAVAIVTSDGNVYSAGDSDYRFALESISKVCTLALALEDVGPQAVQDKVGADPTGLPFNSVIALELHGGKPLSPLVNAGAIATTSLINAENTEQRWQRILHIQQQLAGEQVALSDEVNQSEQTTNFHNRAIAWLLYSAGYLYCDAMEACDVYTRQCSTLINTIELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 41266 - protein, 430 aa, Escherichia coli CFT073
MMNTEGNNGNKPLGLWNVVSIGIGAMVGAGIFALLGQAALLMEASTWVAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPEVIMPRAFLVAIGVTTLLYISLALVLLSDVSALELEKYADTAVAQAASPLLGHVGYVIVVIGALLATASAINANLFAVFNIMDNMGSERELPKLMNKPLWRQSTWGNIIVVVLIMLMTAALNLGSLASVASATFLICYLAVFVVAIRLRHDIHASLPILIVGTLVMLLVIVGFIYSLWSQGSRALIWIIGALLLSLIVAMVMKRNKTV

SEQ ID NO: 41267 - protein, 477 aa, Fouquieria columnaris
LEKKKLGRIVQIIGPVLDVAFPPGKMPNIYNALVVKGRNTVGQPINVTCEVQQLLGNNRVRAVAMSATDGLTRGMEVSDTGAPLSVPVGGATLGQIFNVLGEPVDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLE

SEQ ID NO: 41268 - protein, 451 aa, Photobacterium profundum SS9
MAKHFDYICIGGGSGGIASANRAAMHGAKVALIEAKALGGTCVNVGCVPKKVMWHGAQIAEAIHLYSKDYGFDVDVKSFNWSTLVKNREAYIGRIHQAYDNVLGKNKIEVINGFAKFVNDKTIEVNGEQLTADHILIAVGGEPTIPNIPGAEHGIDSNGFFGLNEQPKRTAVIGAGYIAVEIAGVLSALGTDTHLFVRKESPLRSFDPLIVETLVEVMNAEGPTLHTHSVPKEIIKEADGSTTLHFENGESHNTDLLIWAIGRNPTTDKINLASTGVETNSRGYIKVDEYQQTNVAGIYCVGDIMEGGVELTPVAVKAGRQLSERLFNGKTEAKMDYKLIPTVVFSHPPIGTIGLTEPEAIAQYGEDNVKVYTSGFTAMYTAVTSHRQPCKMKLVCAGPEETVVGLHGIGFTVDEMIQGFGIAIKMGATKADFDSVVAIHPTGSEEFVTMR

SEQ ID NO: 41269 - protein, 164 aa, Brassica napus
  misc_feature (96)..(96): Xaa can be any naturally occurring amino acid
MGCMFSHLAAKFAFFPPSPPTYHVTTTPDGKLTAVSSSTSSTFPAAGDASLDVRVVKTRRGNKVTAFYLRNHNARLTLLYSHGNAADWGQLFDLFXQLKVNLRVNLMGYDYSGYGASTGKPSEYNTYADIEAVYECLQTEYGVGQEDLILYGQSVGMDRLAPCS

SEQ ID NO: 41270 - protein, 470 aa, Vibrio vulnificus CMCP6
MKKTKIVCTIGPKTESVEKLTELVNSGMNVMRLNFSHGDYVEHGTRIANFRQVMENTGKQLAILLDTKGPEIRTIKLENGDDVDLVAGQEFTFTTDTSVVGNKDIVAVTYPGFAADLSAGNTILVDDGLIEMEVIATTATEVKCKVLNNGALGENKGVNLPGVSVNLPALSEKDKNDLKFGCEQGVDFVAASFIRKASDVKEIREVLAANGGANIQIISKIENQEGVDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVTIMAQIANRTDSVLKAELGSRLDSPRLRITEAVCKGAVDTAEKLAAPLIIVATEGGKSARSVRKYFPTANILALTTNKKTAAQLVLTKGVTPVVVDSIDNTDAFYVTGKELALESGLGSKGDIVVMVSGALVASGTTNTASVHVL

SEQ ID NO: 41271 - protein, 342 aa, Listeria monocytogenes str. 1/2a F6854
MLNEQQITRLLYRLQDPVLEASLEETEGVLEVQVLEETANIKIALADPAVETDHFVHNIEELLTQFGVNEINIELEYLPAAVIDRIFQARDNILSEASETKFLAIASGKGGVGKSTVSANLAIALAQQGKKVGLLDADIYGFSIPVLLGTTESPHKENGQIIPVETHGIQMISMDFFVEQGEPVIWRGPMLGKMIKMFLEEVRWGKLDYLLIDLPPGTGDVALDIHTLIPKCNELIVTTPHYAAASVASRAGYMAAKNNHKIIGVIENMSYLTLADGQVLKVFGQGGGEKVAADLETQLLIQLPIEQPEPNGNGYVSALFNSSSTSGKAYKTLAEKIIPCLS

SEQ ID NO: 41272 - protein, 517 aa, Anabaena variabilis ATCC 29413
MNVTELIKISIILLLVATGVALLSRRLRVPYVTGLVLAGLPITELLSRPIGLDPALVLNLFLPILIFEAGINTDVSRLRSTFKPIALLAGPGAILSSAIIAILLKFGLGLSWIPAFLVGVILANTDTVSMIAVFKEIPVPSRLSTIVEGETLFNDAAALVSFNLILQVYSTGSLTLIEGIQQLLFISVGGCLVGLVLGYLSIPVFNRLDDPLSSLLLTVAVALGTFQVGQFLGVSGAVAVVVAGLIFGNFGLSGNTSASSRITLLSFWEYASFTANTFIFLLIGVEINLVTLWQTLPAILLAVLAYQVGRVLTIYPLLAGVRWFDRPIPLRWQHLLFLGNIKGSLSMALALSLPTTLPGRESLITIVFGCVLVSLVGQGLSLPLLVKRLKLSKFSHSQQQVEELQAQLITAKAAQDELDTLLKTGVLPKAVYEEMRSAYQVQVAGAEKTLREFYNRRSDDFDHKGGALGKLDAIRRRLLLAEKGALTEAMRKRILSQDIGQNRIQTIDEKLLQLDDD

SEQ ID NO: 41273 - protein, 283 aa, Listeria monocytogenes str. 1/2a F6854
MKTVKLNNGVEVPILGFGTYQITDAAEAEQAVKDAIKTGYRHIDTAQSYMNEEAVGRGIAASGVDRKELFITTKIWVENVSYKGVMSSFDRSLKRLGLDYVDLLLIHQPFNDVYGAWIAMEELQASGKIRAIGVSNFSPDRVIDLAAFNEVTPQVNQIEVNPFQQQTANLAILRKEGVAIEAWAPFAEGKNDVFNNPVLTKIGAKYGKSAAQVILRWLVEQDIIVLAKSVKPERMAQNLAIFDFELTEADKEEIAGLNQGESQFFSHADPEMVKWMASRKLNV

SEQ ID NO: 41274 - protein, 156 aa, Vibrio vulnificus CMCP6
MENQPGALSRVVGLFSQRGYNIESLTVSPTDDETLSRLNITTMTDEMQLEQIQKQLHKLIDVLKVQEVTEFDHIERELMMVKVKASGFARAEVKRTADIFRGQIVDVTASQYTVQLAGTSEKLDAFIQAISEVTEVIEVARSGVVGIARGERALKA

SEQ ID NO: 41275 - protein, 436 aa, Triticum aestivum
  misc_feature (145)..(145): Xaa can be any naturally occurring amino acid
  misc_feature (155)..(155): Xaa can be any naturally occurring amino acid
  misc_feature (230)..(230): Xaa can be any naturally occurring amino acid
  misc_feature (256)..(256): Xaa can be any naturally occurring amino acid
  misc_feature (273)..(273): Xaa can be any naturally occurring amino acid
  misc_feature (318)..(318): Xaa can be any naturally occurring amino acid
  misc_feature (332)..(332): Xaa can be any naturally occurring amino acid
MPLYCTPQEMIALLCWHKIALLRSHICIPYWTANRWRWSMNTSKLTSSVNITSPPGASCRIRHELKSSFLPKKAEWGATRQAAAPKPMTVSMVVRASAYADELVKTAKTIASPGRGILAMDESNATCGKRLASIGLENTEANRQXAYRDLLVTPXGLGNYISGAILFEETLYQSTVDGKKIVDILVEQGIVPGIKVDKGLVPLVGSNDESWCQGLDGLASREAAYYQQGXPRFAKWRTVVSIPNGPSELAVKEAAXWGLARYAAISQDNGLVXPIVEPEIMLDGEHGIERTFEVAQKVWAETFYYMAQNNVMFEGILXLKPSMVTPGAECKXDRATPEEVASYTLKLLQRRIPPSVPGIMFLSGGQSEVEATLNLNAMNQAPNPWHVSFSYARALQNTCLKTWGGRPPKRTCSSRTTATDPSASYSIYGGRVLVAP

SEQ ID NO: 41276 - protein, 370 aa, Brassica napus
MNNAGGQYPDFPAVQTHGGQFISYDIFGSLFEVTSKYRPPIVPIGRGAYGIVCSVLDSETNELVAMKKIANAFDNHMDAKRTLREIKLLRHLDHENIIAIRDVVPPPLRREFSDVYIATELMDTDLHQIIRSNQGLSEEHCQYFLYQLLRGLKYIHSAKVIHRDLKPSNLLLNANCDLKICDFGLARPTSENEFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNSLAIDLVDRMLTFDPNERITVEEALNHPYLAKLHDPNDEPICLKPFSFDFEQQPLDEEQIKEMIYREAIALNPTYA

SEQ ID NO: 41277 - protein, 574 aa, Moritella sp. PE36
MQHRAHLFSLRIAHALRESFSRSDYNSAKFGKDLLAGITVGIIAIPLAMALAIASGVAPQYGLYTAIIGGIVIAISGGSRYSISGPTAAFVVILYPIVQQYGFGGLLLATIMSGLILVIMAVLRLGRFIEYIPDAVTLGFTGGIAVVIATLQFKDFFGLPIESLPEHYWDKLAVLANALPYLHLPSFAVAAFTLVIMLVWPKLKTVVPAHLPAIILGSLLAMVLNDWGMDIATIGSRFHYLLPDGTQGAGIPPYLPTFEWPWLQAGVNGQPLELSWKLISDLLPAAFAIAMLGAIESLLCAVVLDGMTGKRHSANSELLGQGIGNIVVPFFGGITATAAIARSAANVKAGAQTPISAVIHGLVVLASLVLLAPLLAYLPMSSMAALLLVVAWNMSEAGKALHLLKTAPKSDLWVFAICFSFTIVFDMVLAITAGILLAAVLFMKEIAEMVKVTDITDNKRLITTKIPAGWRVFKINGPLFFAAADRVFSELADKTNEVDGFVLYLDAVPLLDAGGLAAMEQFINQCKIYNTQVIFCDLQFQPLKTLARAGVQPIGGVTSFSPTLHEALTEIANY

SEQ ID NO: 41278 - protein, 382 aa, Medicago truncatula
MDEVPVIEENETKSEAHLTSAAAFVEGGIQDACDDSCSICLEEFIDSDPSTVTSCKHEFHLQCILEWCQRSSQCPMCWQSISLKDPTGQELLEAVERERNIRFNPTRNATIFHHPTLGDFELQHLPVGANDADLEERILQHFAAAAAMGRARHIARREGQRNRSSAQGRPQYMVFSAHPNSPPMAPASSSPPQRGDGEQTPATGEEPPQLTLVPPVQTDQVSASGSGSAALATDNLGLSYNSRRSPNQSSPSSQDRAGPSELQSFSESLKSKLNAVSTRYKESISKSTRGWKERWFSRTSPMSDLGSEVKREVNAGIATVSRMMERLETRDNNRSSSDTAPSNLADGPIQGSSDQHLTDTERDSPLRDNNSKTSCTAGSSSN

SEQ ID NO: 41279 - protein, 314 aa, Magnaporthe grisea 70-15
MSDINLAEIQASLVAVAFEAGRMITGANMDVTKMDTKLNSVDIVTETDQAIEKMVSTKLRAAYSSFDFIGEETYVPGTTKLTDRPTFVVDPIDGTTNFIHGFPHACISLGFVVNRVPSVGVVYNPFQDEMFTAVRGEGSFLQRNASLAASGITLPDGAAAKRRLPLRTADPKTAPPLGGLSTALIAVEWGSERDGNNFDLRARVFRDLMASQKAGGRMAHSLRSLGSAALNICAVAAGQLDAYWEGGCYAWDVAAGWCILAEAGGIMASGNPGDWEPAIESRKYLAVRGATSGQKEFVEELWSVIGDGVMHYTH

SEQ ID NO: 41280 - protein, 410 aa, Triticum aestivum
  misc_feature (154)..(154): Xaa can be any naturally occurring amino acid
CLLFAFQVFVWKIIELHDKYVAYVTDCFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTHPSGSRXIHQTKFEEFVADHPESNPGVDLAVTVLTTGFWPTYKTFDINLPSEMVKCVEVFKEFYATRTKHRKLTWIYSLGTCNISAKFDAKTIELIVTTYQAALLLLFNGSTKLSYSEIVTQLNLSDDDVVRLLHSLSCAKYKILSKEPAGRTISPNDSFEFNSKFTDRMRRIKIPLPPVDEKKKVVEDVDKDRRYAIDASIVRIMKSRKVMAHTQLVAECVEQLSRMFKPDFKAIKKRIEDLITRDYLERDKDNANTYRYLA

SEQ ID NO: 41281 - protein, 193 aa, Desulfitobacterium hafniense Y51
MSQLVPMVIEQTSRGERSCDIFSRLLNDRVVMLNGMVTNESASLIIAQMLFLESADCDKDIHFYINSPGGSVTDGLAIMDTMNYIKCDVSTISIGQSGSAASLLLAAGAKGKRFALANSEVLIHQPSISGGLQGQTTDIKIHSDWLTKTKEKLNETYSRLTGQPLEKIQKDMERDYYMTAGQAQDYGLIDKIL

SEQ ID NO: 41282 - protein, 419 aa, Dehalococcoides sp. CBDB1
MYELSVLPSGLRVISHHMPASRSVTICVYIGVGSRYEKDCEAGASHFIEHMVFRGSAKYPNSQLISSAIEGVGGILNAATDRESTLYYAKVGSDKFALALDVLSDMLVTPVFDPEDLEKERKVVYEEISMSMDNPSHRVGLLIDEILWPNHPLGRDIAGSRQSVAGLDRQRLLSFMHCHYNPANVVVAVAGDIKHSPAVSAISQAFSGLGGQNIVQTFEPYHSGNPCPVGVDKRDAEQINLMLAMPGMNRLDNRRYAFSILNTILGDGMSSRLFAHVRDNLGLAYSVQSGTEFLHDTGAFSIFAAVDPANLTACIEAILSEMEAAKTTITAEELTKAKEMSKGRIQLAMEDSRYMAKWIGSQELLCRRVNTHEDVIRLIDGVTLTSVMELAGEYFRKPEMRLALVGQIDKEKVSCLLKD

SEQ ID NO: 41283 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 41284 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 41285 - protein, 725 aa, Rhodopseudomonas palustris [sequence omitted]

SEQ ID NO: 41286 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 41287 - protein, 498 aa, Vicia sativa
MAKLLALSLSFCFLLFSSCFALREQSQQNECQLERINALEPDNRIESEGGLIETWNPNNRQFRCARVALSRATLQRNALRRPYYSNAPQEIYIQQGNGYFGMVFPGCPETHEEPQQSEQGEGRRYRDSHQKVNRFREGDIIAVPTGIAFWMYNDQDTPVIAISLTDTGSSNNQLDQMPRRFYLAGNQEQEFLRYQHQQGGKQEQDNDGNNIFSGFKRDFLEDAFNVNRHIVDRLQGRNEDEEKGAIVKVKGGLSIIAPPERQARHERGSRQEEDEDEKEERQPSHHKSRRDEDEDDKEKRHSQKGQSRRQGDNGLEETVCTAKLRANIGSSPSPDIYNPQAGRIKTVTSLDLPVLRWLKLSAEHGSLHKNAMFVPHYNLNANSVIYALKGRARLQVVNCNGNTVFDGELEAGRALTVPQNYAVAAKSLSERFTYVAFKTDDRASIARLAGTSSVIDDLPLDVVAATFNMQRNEARQLKSNNPFKFLVPPRQSEMRASA

SEQ ID NO: 41288 - protein, 200 aa, Oryza sativa
MKFNISNPTTGQNHVLVVDDDKKLLAFYGKKMGQEVDAAILGDEWKGYILKITGGNDKDGFTMKQGILIQGRTRLLMSAGHSTYRPRRAGERKKKSVRGCIVGPDIAALALTVVKKGEADIAGLTNEKRPRRRGPKRATRIRKLFALDKKKDDVRRFVVLYRRTIEKNGKKRTKCPKIQRLVTPERLRRKRFFRTERVKA

SEQ ID NO: 41289 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 41290 - protein, 476 aa, Mycoplasma gallisepticum R
MKVSVTTNKQGLFVYNKSNQHEIMKTLKEILQSQKAFFDSNVTKDYQFRLENLKKLREIIDIYENDFYEALKKDFNKSAYETYISEFVLIKKELNYAIRHLKKWMKPIKAPRNTFQFFAKVSYRYQPYGNTLIVAPWNYPLLLVFNPLVAAIAAGNTAIIKLSEFVPHTSKLMLEIFNKYFDEKYIYFIDNNKHSIEEMMSLKYDHIFFTGSSNVGKKVMQQAATHLTPVTLELGGKSPCIVDTNTDLEKAVKSFLFGKILNAGQTCIAPDYLIVHSYLYDAFIKELIKQIDDLNLNKSNMTHIINDQHFRRLEALLAKTPKEKIVYQKNNQGNYFHPVIIGDVAFNDEIMQEEIFGPVIPVMKYENLEHLLKELKNKERPLALYMFSNDRVITDKVFSTLEFGGGAINDTIIHIANSHTPFGGVGNSGMGNYHGYFGFKTFSYAKTILTKAGFDNNLRYRPYTEDKFRAIKKIFK

SEQ ID NO: 41291 - protein, 303 aa, Physcomitrella patens subsp. patens
MSSPGSYGFSSPTGLSQAWFDVRVIYVRITGCSPEEDPDSLTIRFPPRTIGVTLEVNGGWISPTEESCVVLRRDRVDSETAEATYVSTDNLRICGTICYEVVNKEEVIVSGTLEHVENCLELIHGSKECFSKKDDQAWAMECRCVAGNSGCFFNKSRQDFSASLLPPTMEVSMVGRHMNVPVFITQTVRLIARRKSSRVLTLDVIPETEELGKSHNGMILVDEPQLVSFLNLMIYISLEFVRATIVLHGVYGVEGEDGQMTWFNAGVRVGVGIGLGMCLGAGIGIGLMVRTYQATTRTLRRVI

SEQ ID NO: 41292 - protein, 363 aa, Vibrio vulnificus CMCP6
MTDKTYKIAVLPGDGIGPEVMAQAHKVLDAIEKKHAIHFEREEHDVGGIAIDNHGCPLPQSTVTACEESDAVLFGSVGGPKWEHLPPNDQPERGALLPLRKHFQLFCNLRPAQIHSGLEAFSPLRADISGRGFDIVVVRELTGGIYFGQPKGREGEGANEKAYDTEIYHRFEIERIAKIAFESARLRRKKVCSIDKANVLQSSILWREVVEELAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIENAVSQALAAGELTADLAGDKPALSTAEMGDKIAQYILNS

SEQ ID NO: 41293 - protein, 571 aa, Lactobacillus sakei subsp. sakei 23K
MSYQALYRVWRPQRFDDVVGQETMTQTLKNAIITKQTSHAYLFTGPRGTGKTSAAKIFAKAINCHYQKDGEPCNECETCRAITAGALNDVIEIDAASNNGVEEIRDIRDKAKYAPTQADYKIYIIDEVHMLSTGAFNALLKTLEEPPANVVFILATTEVHKVPATIISRTQRFNFKRITAADLFKRMAYILEQKEMTYDPAALKVIAKAAEGGMRDALSILDQVLSFSDNHVTLENALDVTGSLTEALLADYVQTIHDHAPKAALQLLQQILAEGKDAQRFVEDLIEYVRDLLMYQQAPELVMANEMDLLDEHFKQLSDALSAEQLYTVIDILNETQQQLRFTNHPEIYLEVATVRLTQQPVAPAAVSANVSAPADNEQVTQLSRQVAQLQAALQKLETAGPSAPVQQAKPKPAKKISKKVNRKLIYPVLADATRTNLENLKEVWPDLLNMLDVTKRAIMRVSEPVAASQSGVVVAFNYEILFERANNDQDLLTVLENGLNRLTGNPFKVVLVPQDNWPEIRKEYLQNHAVSGHNNEDQPTTTEKAPAPEVNEVVQQAQALFGDAVVVQKD

SEQ ID NO: 41294 - protein, 214 aa, Bacillus clausii KSM-K16
MESSMRPVIIGVAGGTGSGKTTVAKEIFKQFSQSSIVLIEQDAYYKNQDHLTFEERLKTNYDHPLSFDNELLYAHLMQLADRSPIFKPSYDYANHTRAKEVTKIEPKDVIILEGILILEDERLRSMMDIKVFVDTDPDIRIIRRLVRDTKERGRSIDSVIDQYTSVVRPMHLQFVEPTKRYADLIIPEGGQNKVAIDLMATKIRTIIEQKKLDA

SEQ ID NO: 41295 - protein, 527 aa, Oryza sativa Japonica Group
MDKAYIAVFSIAILFLLVDYFRCRRRRGSGSNNGENKGMLQLPPSPPAIPFFGHLHLIDKPLHAALSRLAERHGPVFSLRLGSRNAVVVSSPECARECFTDNDVCFANRPQFPSQMPATFYGAGFGFANYGAHWRNLRRIATVHLLSAHRVRGMAGVVSGEIRPMVQRMYRAAAAAGVGVARVQLKRRLFELSLSVLMEAIAQTKTTRPEADDADTDMSVEAQEFKNVLDELNPLLGAANLWDYLPALRVFDVLGVKRKIATLANRRDAFVRRLIDAERQRMDNGVDGGDDGEKKSVISVLLSLQKTEPEVYKDIVIVNLCAALFAAGTETTAMTIEWAMSLLLNHPKILKKAKAEIDASVGNSRLINGDDMPHLSYLQCIINETLRLYPVAPLLIPHESSADCKVNGYHIPSGTMLLVNVIAIQRDPMVWKEPNEFKPERFENGESEGLFMIPFGMGRRKCPGETMALQTIGLVLGALIQCFDWDRVDGAEVDMTQGSGLTNPRAVPLEAMCKPREAMSDVFRELL

SEQ ID NO: 41296 - protein, 442 aa, Glycine max
MRILQLGLFLALASGFAAISIYITGLSDPFVYPSYHLTDEDTQALLSLHDTFQKCVSANGLGLKATRGTDYCQTTINFPSDTIPKWKDPKTGELEALSFDFNLCEAVATWEQVRNSTTILTKEFIDSLPNGWEEYAWRRINKGIQLNRCENKTLCMEKLSLVLPETPPYFPRQFGRCAVIGNSGDLLKTKFGNEIDGYEVVIRENGAPTQNYTDYVGRKSTFRLLNRGSAKALDKVVELDEQRKEVLIIKTTIHDIMNKMIREVPIKNPVYLMLGASFGSAAKGTGLKALEFALSMCDSVDMYGFTVDPGYKEWTRYFSESRQGHTPLHGRAYYQMMECLGLIKIHSPMRADLNRVVKWVPSRHIIRSARIASEKLLRRVGAGSEDPLAACSIIKKQVKRNLNAVSKLRKAALDHLRYVKRTTMYPLEHSPGHGSLCTVPTD

SEQ ID NO: 41297 - protein, 492 aa, Oryza sativa Japonica Group
MGWWPPAAWRRWGVVVVVVAALMAVSATAAVEEELGGRESGVVAAAAQGRWPRHRHAYAAMMYMGTPRDYEFYVAVRVMMRSLARIGADADRVLIASADVPADWVRAMREEDGMRVVLVENMKNPYESNLGGINRRFKLTLNKLYAWTLVDYERVVMIDSDNIFLQKTDELFQCGQFCAVFINPCYFHTGLFVLQPSMDVFKGMLHDLEIGRANSDGADQGFLVGCYPDLLDRPMFHPPENGSKLNGTYRLPLGYQMDASYYYLKLHWHVPCGPNSVITFPSAPWFKPWYWWSWPILPLGLSWHKQRWDDLGYAAEMPVILMEILMYAVIITITRLAKPGMTKLCYNRRPEKQNAMVQGLIKMSAIVAMLIAYAIPFFIIPRTVHPFMGWSMYLFGALALGVLVSNAFLLPLLAVLTPWLAIIGMFFVMAFPWYHGGIVRVLAIFGYAFCSAPFLWASLVRVMDSLQTMLEREPFFPRLGEPAQETEFSKLF

SEQ ID NO: 41298 - protein, 680 aa, Magnaporthe grisea 70-15
MGRIKKKGESGAAKNYITRTQAVRKLQISLPDFRKLCIWKGIYPREPRNKKKVSKSATASTTFYYTKDIQYLLHEPLLAKFRDQKVLEKKISRALGRGDVSDAKRLEGNAARPENTGKPSYTLDHVVRERYPTFVDALRDLDDCLSMLFLFANLPATSSVPAKMIARCERLCLEFQHYLIVSHSLQKSFLSIKGIYYQANIQGEDILWLVPYKFNQRVVGDIDFRIMGTFIEFYMTLLGFVNFRLYTSIGLKYPPKFDATKDDKAADLAAFTLEGAGLTSNGAQPDAIMEGTSESTPDPKLQAKVNKLVKELKSGEDEKPKAITNGEGESETPTDAIDKFEPAAPGGDVLLQPSYSTSDPSQLFANCTIYLSREAPRQALEFILRAFGCKRIGWDEVLGDGAFTTNELDPNITHQIVDRPPVTAVDNDEGEDNQTAQKVGGRVPGRIYVQPQWVWDSINDEELKEPNQYAPGAQLPPHLSPFVKARAGQYDPTVPLEEQQTEAEALKGDSDVEDEEEADGAEADEDDDEAVLAIENGEMDVAGSDDDDDEEDEEADAGFGGFSDAEVDDASEDDEQTSAALQRQIELEAELSGKSVKASEADKQAADPKSKAKQQKRKELQRKAKEEAEDLERAKGMLSKKKRKLFEQMTYSNNKKDAESEKLREKRRRIERKMAKGKAT

SEQ ID NO: 41299 - protein, 540 aa, Prochlorococcus marinus str. MIT 9303
MSSSSSGNSRHFGRVAPVVLAILDGWGHREELEHNSIRSAETPIMDALWHAYPHTLIEASGAAVGLPDNQMGNSEVGHLTIGAGRVIRQELVRISETVQTGRLGQTPALIALAERLRKSDGTLHLLGLCSDGGVHSHINHLCGLLHWAAAAGLNKVALHLITDGRDTPTQSASNYLHQIEDAINASGVGELASLCGRYWAMDRDHRWERTIRAYEVLTDPNQSISRVTAEDVLSASYANGTTDEFLEPTRLSNNYFKDGDGLVMFNFRPDRARQLVQSLTLPDFDGFPRANQPSLDVVTFTQYEHDLPVAVAFPAESLDDLLGQVVSEHGLRQYRTAETEKYPHVTYFMNGGIEQPLAGEERHLVPSPRVATYDLAPAMSADTLTESCVKAIESGVYSLVIINYANPDMVGHTGVMGAAQEAISTVDRCIGRLLDSTGRMGGTLLITADHGNAELMQGSDGQAWTAHTTNPVPVILVEGEKRKLSGYGNDIQLRAGGGLADIAPTLLQLLDLPKPDAMSGLTLIQAIESPTPSARLPQPV

SEQ ID NO: 41300 - protein, 294 aa, Solibacter usitatus Ellin6076
MPAKVRKAVFPAAGLGTRFLPATKAQPKEMLPIVDKPIIQYGVEEAIHSGIQNIIIVTGRGKTAIEDHFDVSFELEYLLESRGKKELLAIVRSISDMISVSYIRQKEALGLGHAVLRSLELIGDEPFSVVLADDVIEAETPCLRQLLDVYEFFAAPVLAVMEVPPENISAYGAIDAEPVMHNGRNDRVYRIRDLVEKPKQSDAPSNLAIIGRYVLTPEIFGSLQSIDPGSGGEIQLTDALRHLLRSRPIYAYRFDGTRYDAGDKLGFLKATVEYALRRHDLGGPFREYLKTLKL

SEQ ID NO: 41301 - protein, 293 aa, Staphylococcus epidermidis RP62A
MEHLLSMEHLSNSEIYDLITIACQFKSGERPLPQFNGQYVSNLFFENSTRTKCSFEMAEQKLGLKLINFETSTSSVKKGESLYDTCKTLESIGVDLLVIRHSQNSYYEELNQLNIPIANAGDGSGQHPTQSLLDIMTIYEEYGSFEGLNILICGDIKNSRVARSNYHSLTSLGANVMFSSPKEWVDNTLEAPYVEIDEVIDKVDIVMLLRVQHERHGISGEANFAAEEYHQQFGLTQARYDKLKEEAIVMHPAPVNRGVEIKSELVEAPKSRIFKQMENGMYLRMAVISALLQ

SEQ ID NO: 41302 - protein, 298 aa, Vitis vinifera
MAGGGSSGRLPTWKERENNKKRERRRRAIAAKIYAGLRAQGNYKLPKHCDNNEVLKALCSEAGWTVEEDGTTYRKGCKPPPTEIAGASANISACSSMQPSPQSSSFPSPVPSYHASPSSSSFPSPTRFDGNPSSYLLPFLRNLASIPTSLPPLRISNSAPVTPPLSSPTSRGSKRKPDWESFSNGSLNSFRHPLFAVSAPSSPTRRNHLTPATIPECDESDASTVDSGRWVSFQTVAPQAAPSSPTFNLVKPVAMESWRGRPEFEFESGRVKAWEGERIHEVGVDELELTLGSGKTRG

SEQ ID NO: 41303 - protein, 366 aa, Staphylococcus epidermidis RP62A
MLEKRYLVLEDGSYYEGYRLGSDDLSIGEIVFNTAMTGYQETISDPSYTGQIITFTYPLIGNYGINRDDFESLTPKLNGVVVKEASTHPSNFRHQKTLHETLAQYHIPGISGVDTRSITRKIRNHGVLRAGFTDNKDNIQELVEQLKTAELPRDEVQTVSTKTPYVSTGSDLSVVLLDFGKKQNIVRELNLRGCNVTVVPYDTSAEEILSMSPDGVMLSNGPGDPDEVDVALDMIRGILGKIPFFGICLGHQLFALSQGATSFKMKFGHRGANHPVKDLRTGKIDITSQNHGYSIDRDSLKNTDLEVTHIALNDGTVEGLRHKELPAFSVQYHPEARPGPSDSNYLFDEFITMMKDFKEKERQINA

SEQ ID NO: 41304 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQELLSKFFAQTEALAFGKSREVVEQEYCDQGKDPAT

SEQ ID NO: 41305 - protein, 676 aa, Methanosarcina acetivorans
MDMLIYLAPICALIGLIFAGISYKNVQNEGAGNDLIKKITASIHGGAMVYLNRQYRAIAVFVVFLAIIIALILPNGALTAACFVFGAVLSATAGYAGMLTATIANGRTTNAATRGIGPAFRVSFASGTVMGMSVVGLGLFGLSLSFIILESVYTDLDLLTIVNIVAGFSLGASSIALFARVGGGIFTKAADVGADLVGKVEAGIPEDDPRNPAVIADNVGDNVGDIAGMGADLYESYVGSILATMLLAASTAATTFPNIPVENVILVPLIISAIGILASIVGTFFVRTNKTESSAIHMAFNMGLIAAIILTVIASYFVTSMLLGEYGLNVFFATVAGLVAGFLIGQITEHYTSYDRKPTLRVANSCQTGSATNIITGFAKGMESTLWPVVIISIAIYIAFQLSGLYGIAIAAVGMLATLGISLSVDAYGPVADNAGGIAEMSHQKEEVRQITDTLDAVGNTTAAIGKGFAIGSAALTALALFASYGIAVGLSAIDVMNPNVFIGLTIGAMLPYLFSSMTILAVGNAAGEVVVEVRRQFREIAGLMEGKADPDYGKCIAISTHSALKEMIPPGLLAVIAPLLVGLVLGPGALGGLLAGSVASGFMIAITMSNAGGAWDNAKKYIELGNFGGKGSDAHKAGVTGDTVGDPFKDTAGPAINILIKLMSIVAVVFAPLFM

SEQ ID NO: 41306 - protein, 534 aa, Arabidopsis thaliana
MAEDKNNGRVNDESEYSSEDEGTEDYKKGGYHTVRVGDTFKNGAYVIQSKLGWGHFSTVWLAWDTQESRYVALKVQKSAQHYTEAAMDEIKILKQIAEGDSGDKKCVVKLLDHFKHTGPNGKHVCMVFEYLGDNLLSVIKYSDYRGVPLHMVKELCFHILVGLDYLHRELSIIHTDLKPENVLLLSTIDPSRDVRRSGVPLVLPITKDKIVSESAVKPETKSYTYNGDLTKNQKKKIRKKAKKVVAQDFGGEEALEESERDSNSEARINGNSTVERSEGSSTRLMEGEEAREKANKKNGRGSRRGSRSTRQKLLSDIECKCKLVDFGNACWTYKQFTSDIQTRQYRCPEVVLGSKYSTSADMWSFACICFELATGDVLFDPHSGENYDRDEDHLALMMELLGMMPRKIALGGRYSRDFFNRQGELRHIRRLRFWPISKVLKEKYDFSEQDAKDMSDFLVTILEFVPEKRPTAAQCLKHPWFNPGPRLLEPSLKPQQPKGEEEGAANENIEKEKDEREAMEAGVGNIAIDVSEPK

SEQ ID NO: 41307 - protein, 714 aa, Agrobacterium tumefaciens str. C58
MRMTVIPIVILCGVLSVVYAVWTTKSVLDADQGNERMREIAGYIREGAQAYLTRQYLTIAIVGLIVAVLAWYLLSAIAAIGFVIGAVLSGVAGFVGMHVSVRANLRTAQAASHSLGAGLDIAFKSGAITGMLVAGLALLGVSIYYFVLTSVLGHPPGSRAVIDALVSLGFGASLISIFARLGGGIFTKGADVGGDLVGKVEAGIPEDDPRNPATIADNVGDNVGDCAGMAADLFETYAVSVVATMVLAAIFFAGTPILESAMVYPLAICGACILTSIAGTFFVKLGTNNSIMGALYKGLIATGVFSVAGLAVATYATVGWGTIGTVAGMEITGTNLFFCGLVGLVVTALIVVITEYYTGTNKRPVNSIAQASVTGHGTNVIQGLAVSLESTALPAIVIVGGIIGTYQLGGLFGTGIAVTAMLGLAGMIVALDAFGPVTDNAGGIAEMAGLDPDVRKATDALDAVGNTTKAVTKGYAIGSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAISMTSGGGAWDNAKKSFEDGFIDKDGVRHVKGSEAHKASVTGDTVGDPYKDTAGPAVNPAIKITNIVALLLLAVLAH

SEQ ID NO: 41308 - protein, 188 aa, Brassica napus
  misc_feature (91)..(91): Xaa can be any naturally occurring amino acid
MSCSSSSGSEEDDEGFDSYRKGGYHAVRIGDQFSGGRYIAQRKLGWGQFSTVWLAYDTHTSNYVALKIQKSAQHFSQAALHEIELLQAAAXDGDPANTKCVVRLIDDFKHAGPNGQHLCMVLEFLGDSLLRLIKYNRYKAMELNKVREICKCILTGLDYLHRELGMIHSDLKPENILLCSTIDAAKDP

SEQ ID NO: 41309 - protein, 197 aa, Heliobacterium chlorum
AGGIAEMAELGPEVRKKTDKLDAVGNTTAAVAKGFAIGSAALTALALFTAFAEEVVKSPGVSSALHGSHFVLNLLEPKIIIGLFIGGTVPFLFCAFAMEAVGKAAFEMIGEVRRQFREIPGLMEGKAKPDYARCVDISTRAAIRQMIAPGLLAVITPLIVGFGFGAQALGGMLAGVTVAGVLLAIFMANAGGAWDHA

SEQ ID NO: 41310 - protein, 197 aa, Allochromatium vinosum
AGGIAEMSGLPEDVRKTTDALDAVGNTTKAVTKGYAIGSAGLAALVLFADYTHNLEVAGKMQVFSLSDPAVIIGLFIGGLVPYLFGAMAMEAVGRAAGSVVIEVRRQFREIKGIMEGTAKPDYSRAVDLLTKAAIKEMVVPSLLPILVPVAVAIGMNILMGDGAGIRALGGMLIGTIVTGLFVAISMCTGGGAWDNA

SEQ ID NO: 41311 - protein, 326 aa, Escherichia coli
KTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 41312 - protein, 416 aa, Aspergillus oryzae
MTVLSTLAPVPADEIFALNRAYANDDYPQKVSLGVGVYRTDDGKPWPLPVVREAEKRLLAEDNLFRHEYTAIEGDIPFLELARDLMFGFDAKDTSDKVKSTKGRIGSVQAVAGTGANHLGALFLSHLMKPKNVWLSNPSWANHLTIWELAGVPRKTYPYYKAATRSFDFEGMMSTLEAEAQQGDVILLHACAHNPTGLDPNKEQWKAIADLCERKKLFPFFDSAYQGFASGSADEDAWAVRYFLNEKPQMEMCVAQSFSKNFGLYGQRVGAFHYVLNDGAQNLRDIVVNNLCHFIRGEYSMGPTGGCSIVKKVLTDEELTAQWHEDLKVMSSRIRTMRQALYNELIKLETPGTWRHIVEQNGMFSYTGLTPSQVYALKDKYHIYLLKSGRASISGLSEKNVTYVAQAINDVVRNVN

SEQ ID NO: 41313 - protein, 107 aa, Oryza sativa
  misc_feature (14)..(14): Xaa can be any naturally occurring amino acid
  misc_feature (31)..(31): Xaa can be any naturally occurring amino acid
  misc_feature (99)..(99): Xaa can be any naturally occurring amino acid
HHLDSAGGEGYAIXQGKVPDPAIPKALAEVXEPGQGGGGVVRAIGKGTAGQESEFAVRKSRRMTPAHGGLVHNDNYNRREYGVQVLIEGIPGMTRLNAXVNIMQDAS

SEQ ID NO: 41314 - protein, 569 aa, Vitis vinifera
MGSDRAFGYWKSSIRALHSLHQFRQKKPVQRTSQKFRKPTEKENVDHKIYMRDTIGNISKILRYLTWDSAQEQLEKLSIRWDSYTVNQVLKSHPPMEKAWLFFNWASRLKGFKHDQFTYTTMLDIFGEARRIESMNYVFQQMQEKGIKTDAVTYTSLMHWFSNDGDIERAVRVWKEMKAKGCCLTVVSYTAYMKILFDNKRVKEAADVYKEMLQSGCAPNCYTYTVLMEHLTGSGKYKAALEIFSRMQEAGVQPDKATCNILIEKFCKTGQTWAITQILLYMKDNFLVLRYPVYLEALQTLKVAGESDILLRQVNPHLNVGLSSKEEIVEFKETVADVHSTIDRGFVLLFLTKQNFYAIDCLLTGMIHKNTRLDSVIISQIIEVNCAHCRINGALLAFEYSVKMGINIERIAYLALMGVFIRANSFPKVADIVEKMVRAGISLGMYLGALLIYRLGCARRPGSAAKVFGLLPDDQKGTAAYTALISAYFSSGNVDKGLKIYKTMQRKRIHPALGTYNLLLAGLEKKGRAREAEIYRKEKKTLHTHGHSQDIVSMDEKICNLLFSGNLVS

SEQ ID NO: 41315 - protein, 665 aa, Aspergillus oryzae
MPSILSDADKETVKRTVPKPANKIHAVAVARLYVAYPDPQKWTYTGLQGAVVLANDLVGRTFWLKLVDVSPAGRGVIWDQEIYDNFPYNQDRTFFHTFELEECPAGLSFADEKEAKTFMKKMQDREKNASKETRQTPFASTRGQGPAPIANGKHGVGRSIFGSLLGHRSTSGSNAPPPVAHTEPPSAPSIQVAPPPPSSPPRKPLPFDTSDPSWKGLLDELLQMGITEDQIAENSDFIKAYIEQKQSNGVDSTPSPAEDKRGKAPPPPPPSAPPAPKSSSISPQHTGNSTGSRRGAPPPPPPSRRTRTEAEEESPASTREPSPPRPRFRAPPPIADAGKFAHTNGPPLPGRQRASSGATPGPPPPPRPPKTPVDDSQPRFGVPPPFQGERKVSAPPAPPSRNNAPPGPPPRPPPRTSSPAVPPQLPPKVPHGAASTPAPPPPPPRSPASQPPPPPVPAASRPTPPPPASSAVPPPPPPSSSVPPPPPPPPPPTSSVPPPPPPPPLPSSRGPPAPPPPPPSSSIPPPPPPPGRGPSAPPPPPPPAPAGGAPPPPPPPPGAGAPPPPPPPGGAAPPLPTPSGGRDDLLAAIRASGGKGGGGLRKVKESDKKDRSAAMVPGSANETSAASAGGGAAQGGMAGALKAALDKRKQKVSGSDDEKEDDDDW

SEQ ID NO: 41316 - protein, 242 aa, uncultured archaeon
MKEGKMELIKDGKRLSGRGFEELRPIKIDVGVLKRADGSCYFELGDNKALAAVYGPREMHPRHFQNAKMAVVKYRYNMAPFSVDDRKRPGPDRRSQEISMVSRKALDPVILRELYPKTAIEVYVEVLQSDAGTRTAGINAASVALADAGIPMRDLVSSVAIGKIDGEVVLDLDAKEDNFGEADMPIAMIARTNTITLLQMDGRLKKEEFERGLKIAMSGCRKIYELQRAALVEKYSKNGNGA

SEQ ID NO: 41317 - protein, 260 aa, uncultured archaeon
MGQEVIEDIRKDYVYDLIEKGKRADGRGFLDFRDIIVERDLIKKAEGSTRVQIGDTVVLVGVKVEPGEPFPDTPNKGILMTNAELVPLASPEFESGPPGENSIELARVVDRGIRGSETIDLEKLCIEEGEKVWMIFIDIHTLDNDGNLVDAAALGAIMSLLNVAIPYEQYGLTGEDTLQIRDTPVAVTVVEIRGNLLVDPNVYEESAATSKLTVISNADGSISGLQKSGSNGLTEEKIVKMTEIGIEKAREIREKYLPKI

SEQ ID NO: 41318 - protein, 324 aa, Lactobacillus sakei subsp. sakei 23K
MKKILVLHTGGTIAMSADQDGAVAPTGQNPMAGFEKLFDNQLTIISEEFANLPSPHITPTVMLALKNRIQEAEATGIDGVVITHGTDTLEETAYFLDLTLPNNVPIVITGAMRSSNEIGSDGLHNLISAVWTAASDDAHDKGVLVVMNDEIHTARYVTKTHTTNVATFRTPTFGPIGLVSKHDANFFQELIRSEICDIQELVEPVFLLKAYAGMDGTLFEAINQPTTKGLVIEALGAGNLPPATLPAIQALLDRNIPVVLVSRCFNGIAEDVYDYDGGGVKLKKMGITFCQGLNGPKARLKLQVGLSAGKTGADLVNFVSNAVS

SEQ ID NO: 41319 - protein, 257 aa, Bordetella petrii
MPDEHTFALAFSAARPASSTDGKSQRNAGGPLLQTHDYTIGFATNRIGPPVSLLHRASFFVSAARLDQLPAPGAPEVCFVGRSNAGKSSAINVLCNQRRLAFSSKTPGRTRLINLFGLPDPLSPDQPLGFLVDLPGYGYASVAHREKEKWADVLGGYLRDRSSLAGIVLIIDIRRGITELDRRLADFIAPTGRPVLALLTKADKLPYGQRQRTVFAVRKDLADIGALHTVPFSATERIGLPEATQYIENWISPKVVP

SEQ ID NO: 41320 - protein, 461 aa, Coccidioides immitis RS
MGTATAQSGLSSSVMHRDLHAAPKRAVGAEGNYVILEDGQRLLDSTGGAAVSCLGHANEQVKEAIKKQMDQLSYCHTMFFATDVFEELAAFLKESTGGKMSRLFVVSSGSEAMEAAMKLSRQYFLELPTPEPKRTRFIARQHSFHGVTLGSLSMGGHVFRRELFEPLLLPNISHVSPCNAYRGKRDGESDADYVGRLAAELDAEFQRVGPETVCAFVAEPVVGAALGCVPSVPGYFAAMKAVCDRYGALLIMDEVMSGMGRSGTLHAWEQEGVAPDIQTIGKGLGGGYAPVSGVLIGNKVVEVMDKGTGAFRHGQTYQGHPIGCAAALAVQKVIKEQNLLQNVREMGALLESKLREYIGDHPNVGNIRGKGLFWGIEFVKDKATKEPFDPKLAVGARVQNTALTPKYSFSIYAGGGTMDGKRGDHVLLAPAYNITANEVDMIARLTAAVIVEVFNEVSAST

SEQ ID NO: 41321 - protein, 648 aa, Lactobacillus sakei subsp. sakei 23K
MILLQVQQVARHFGGDYLFKNAQLEVQDHARVALVGPNGAGKSTLLKMIAGITTPDDGQIILGKNVQVGYLAQDSGLSSERNIYDEMLTIFEGLRQMEAQMHTLEQAIADPDANRSDEDYQALLKQYDQIQHDFSEANGYGYEAEIRGVLHGFQFPEETFTKPISTLSGGERSRLALAKLLLEKKDVLILDEPTNHLDIQTLTWLENYLQTYPGALLTVSHDRYFLDKITKEVYDMSRHTLTHYTGNYSHFLTQKSANLSLEWKAYEKQQAEIEKLQTFVDKNLVRASTTKQAQSRRRQLEKMDKLERPTNDASKIHFHFDIDQPSGNEVLQVVDAAVGYSADKVMVEPINFEVNKQERLAIIGPNGIGKSTLLKSILHQIPFLKGHERVGSNVSIGYYDQEQRNLHANKTVLNELWDEHRTTPEKEIRTLLGSFLFTGDDVLKVVSQLSGGEKARLLLTKLAMNHDNFLIMDEPTNHLDIDSKEVLEQALREFDGTVLFISHDRYFINQVATGIIELSTTTGSKRYLGDYDYYLAKKAEEEAFAQAAEVPVEVSDQPVTAQDNYKASKETQRAQRKLEREVTALEEQMATLEEQATAIQEKMTQADIITKPLVLQELQQDLEKVQADLAQTEADWEEQAMALEEFTN

SEQ ID NO: 41322 - protein, 514 aa, Pseudomonas putida KT2440
MPVSQPVSSQPPTANCYDLAVIGGGINGVGIAADAAGRGLKVFLCEKDDLAQHTSSASSKLIHGGLRYLEHYEFRLVREALAEREVLLAKAPHIVKPMRFVLPHRPHLRPAWMIRAGLFLYDHLGKRKRLGASRSLRFGPGYPLKPAITRGFEYADCAVDDARLVVLNAMAARELGAHIRTRTRCLRAERVEGLWQVELQHADGSLQTIHARALVNAAGPWVASFIKDDLKLDAPYGIRLIQGSHIIVPRLYEGEHAYILQNEDQRIVFCIPYLDRFTLIGTTDREYSGDPAAVAITEQETHYLLKVVNEHFNHQLSQADILHTYSGVRPLCNDESDNPSAVTRDYTLALSAEVGQAPLLSVFGGKLTTYRKLAESAMAELKPFFTQMRAPWTASAPLPGAEGMTTVQALIDAVLARCGWLPVDLAKRWVLTYGSRVWRLLDGVHGPEDLGQAIGAGLFTREVDYLLEEEWAEQTADIIWRRTKLGLSLTAQEQMALEAYLQQARKVRANSRAA

SEQ ID NO: 41323 - protein, 181 aa, Arabidopsis thaliana
MSGITYQILFLLLLASVSLSPVRCLGYGASSEERTLAMIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHSIRALCGKNSQKNCVHGSDSTSSAEREIKFFFKDVVSGDIATQQHDEL

SEQ ID NO: 41324 - protein, 223 aa, Propionibacterium acnes KPA171202
MVVRITPSILNANLANLASEVGRIPSADGLHIDVMDGHFVPNLVMGAPFVESLRPATNLMFDVHLMIENPDWWARQYVEAGAQSVTFHLEAATAPIKLARELRSMGARASVALRPATPVEQLADILTEFDQILLMTVEPGFGGQKFLDPVLAKIRKARKLIDATRKDIWLQIDGGVSADTIERAAEAGADTFVAGSAVYRSDNPDHVVASLRNRALAAQVCAH

SEQ ID NO: 41325 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 41326 - protein, 152 aa, Arabidopsis thaliana
MSTKKIILKSSDGHSFEVEEEAACQCQTIAHMSEDDCTDNGIPLPEVTGKILEMVIEYCNKHHVDAANPCSDEDLKKWDKEFMEKYQSTIFDLIMAANYLNIKSLLDLACQTVADMIKDNTVEHTRKFFNIENDYTHEEEEAVRRENQWGFE

SEQ ID NO: 41327 - protein, 415 aa, Saccharomyces cerevisiae
SKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKKSLSSKLSVQDLDLKDKRVFIRVDFNVPLDGKKITSNQRIVAALPTIKYVLEHHPRYVVLASHLGRPNGERN

SEQ ID NO: 41328 - protein, 447 aa, Zea mays
MEAADYGKLFVGGISWETSEDRLREYFGRFGEVTEAAIMRDRSTGRARGFGFVVFTDAAVAERVTMEKHMIDGRMVEAKKAVPRDDHSIVSKSNGRSTGSPGPGRTRKIFVGGLPSSITEADFRRYFEQFGVITDVVVMYDHNTQRPRGFGFITYDSSPMYLGHYDPLFSLYFNIWVKKAVPKEQSPGPVARSPVGVGQNYAANRVHSFLNGFNQGYNPIPMGGYGMRVDGRYGFLSGARNGFSSFGPGYGMGMNVEGGMSGTFGASSGFISNSNGRQMGSYFNASSNRLGSPIGYLGLNDVPGSMLGSMSRNVWGNGSLNYPSNPTNMSAFASPGNGGQVSLTGDNWGGLPSAHGMGNISSLGSGNLGRGAGDNNFGLPSGSYGRSNSTGTIGEPFSAAGNTYDVNNPDTYGSSSVYGGTVWRFTSSEVDMHSFGHDIGNVGPTIK

SEQ ID NO: 41329 - protein, 250 aa, Prochlorococcus marinus str. NATL2A
MTLSKLLEGQTAIVTGASRGIGKAIAIFLAKEGAEVIINYSSSLENANKVVSEINSFGGKAYPLQADISNENSVNELIKTVLEKNNKIDVLVNNAGITKDGLLMRMKTDDWQKVLDLNLSGVFYCTRAVSRQMLKQKKGRIINITSVVGLMGNPGQANYSAAKAGVVGLTQSAAKEFASRGITVNAVAPGFISTDMTKDLNSESILSAIPLGRFGNPEDVAGAVKFLAADPSASYITGQVIQVDGGMVMS

SEQ ID NO: 41330 - protein, 224 aa, uncultured archaeon
MHRKEQIRGNVKRLLAELPKEVVLEAAAKTRTTEEIMAAIEAGITIVGENYIQEAERAFKVIGRMVKWHFIGHLQRNKVKKAVDLFDLIETIDSFSIAEEINRVSSKIGKIMPILIEVNSGREPRKFGVLPEDVDELVVKISALASVKIEGLMTMGPYEEDIEKSRLYFRETKEIFEQIKKSGIPAVDMRYLSMGMSDSYIIAIEEGANIVRVGIGIFGPRRRV

SEQ ID NO: 41331 - protein, 703 aa, Aspergillus oryzae
MAIALAEADKYEVLEKIGCGSFGIIRKVRRKADGFILCRKEINYIKMSQKEREQLTAEFNILSSLRHPNIVAYYHREHLKASQDLYLYMEYCGGGDLSMVIKNLKKTNKYAEEEFVWRILSQLVTALYRCHYGADPADVGSNILGPAPKPSGLKGKQAQMTILHRDLKPENIFLGHDNTVKLGDFGLSKLMNSHDFASTYVGTPFYMSPEICAAEKYTLRSDIWAVGCIMYELCQREPPFNARTHIQLVQRIREGKFAPLPEFYSPELKNVIASCLRVNPDHRPDTTALINLPIIRLMRKEKEVVDLSSKLRKREESALQKAKEVEQTFAKLEKERQQMKSDIESSLRREWEVKARLEIDRQVQNELERLRKRFETEVQDRVAIELEKQRKSQNVRDDAALRSSVYGSRSSTSNGEDTDFPSTTDISQLSMESPVNKPLRRETRTPFNRSKTVVESPVDVQMAEPSPISIASLSLSPRRTSATSSGKNIFAEAERQRAKWEPTLAYSDDEDDTPDLPSPTRPKVKPDPFKAPSRPLLRQNTAALMQKLSTQPPLFPSNPSRLPQASGSGQNEARHGEPKARSPHRRLSKIPSSANLAADAGSPTRKSGLKQHPTKVNGGGEEMFKAVMQRNMGGRTLVELAQARAGGRPVEDLKRCASDSRTSNCSSGLKSSDRDPPAVWDPEKDEMPSPFLARGRKVIRNLR

SEQ ID NO: 41332 - protein, 486 aa, Lambertia inermis
STLEEKNLGRVAQLIGPVLDVAFPRSKMPNIYNALVVKGRDTAGQQTNVICEVQQLLGNNRVRAVAMSATDGLMRGMGVIDTGAPLSVPVGGATLGRIFNVLGEPVDNLGPVATRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGKEHYETAQRVKQTLQRYKELQDIIAILGLDELSEEDRLAVARARKIERFLSQPFFVAEVFTGSPGKYVGFAETIRGFQLILSGELDGLPEQAFYLVGNIDEATAKAMNLEVESNLKK

SEQ ID NO: 41333 - protein, 376 aa, uncultured archaeon
MEERGISKHELKLFLKEQKQRDLTYRKVLSSMCTYPHEIAVYAHNLFLDSNLGDSGLFPGTKEIEDELIRMIGALLGNENAHGYISAGGTESNIQAIRAIRNRKRKEGLQQMNIIVPKTAHFSFDKIEDLLSLEVKKAGLDDELRVDVNLVEDLIDDNTISIVGIAGTTEFGQIDPIKELADLAHNSDIFLHVDAAFGGFVIPFLDAEYLFDFSLDAVSSISIDPHKMGLSTIPAGCILFRDVSYLADLAVNTPYLTTNEQCSLIGTRSGAPVAATYAVLKYLGRNGLRAIVDECMQLTRMLVHGAKEMGIYPVIEPVMNVVTLRFPDVERVAKALEARGWQVSTTRAPKALRLVIMPHVTEDTIEMFLNDLENAK

SEQ ID NO: 41334 - protein, 337 aa, Oryza sativa Indica Group
MEEEKAAAYYDELSRKGEGARRFKQGLGFSSSDPQSTSFPSKPPSTSSSFLSGFVRAGATPAPAQPTKQPPPPPHEPSRTGRHSRSPSPSRRHRTRSRSPSRSRRHRSRSRERRRRSRSREREREDRRASRRRSRSRSRSRSPSRRSGRSSYSEDRHGDRRRDDGGGRRGSSKGRGGREGGKVDYSRLIEGYDRMTPAERVKAKMKLQLSETGFGPLFVYVLVFPLQKIPPLEMPLWGGKDLNSIRMLHLMKMTMMLKSKHEDTVRDAHENAIFGVPAYPIVDTETTEAEPETNDESEKAKDVEAEPSSSLISDKVLATQSGSWRERAQKLRQNPNA

SEQ ID NO: 41335 - protein, 305 aa, Prochlorococcus marinus
RIGRNFMRCWLSRGENTGLDLVGVNVTSDPKTNAHLLKYDSILGQIKDAEIDYTDDTFVINGKTIKCFSDRNPMNLPWREWGIDLVIESTGVFNTFEGASKHLQVGAKKVILTAPGKGEGVGTFVVGVNADQYRHDDFNVLSNASCTTNCLAPIVKVLDQSFGINKGLMTTIHSYTGDQRILDNSHRDLRRARAAAMNIVPTSTGAAKAVALVYPEMKGKLTGIAMGVPTPNVSAVDLVFESGRSITADSINAAPKSASEGSMKGIIKYGDTPLVSSDYAGTNDSTIVDTALTMTIGDNLGKVVA

SEQ ID NO: 41336 - protein, 302 aa, Spirochaeta aurantia
RIGRNVLRAALGVPGLRIVAVNDLTDSATLAHLLKHDSILGNLSVPVTAGPGVITVDGQDIKVFAERDPGLIPWSSVGVDVVIEATGRFAEKDKAEVHITKGGAKRVIISAPAKGDDLTIVMGVNHQNYDPAKHRVVSNGSCTTNGLAPAALVLHEAFGIEHGLMNTTHAYTNSQVLHDQPEKDLRGARAASLSIVPYSSGAAKAIGKVIPSLDGKLTGYSLRVPVPVVSIVDLTVTVSKDVTVEEVNAAFRKAAESGPLQGILGYSEEPLVSSDYQGDPRSSIVDALSTLVIGKRMVKILA

SEQ ID NO: 41337 - protein, 269 aa, Candidatus Protochlamydia amoebophila UWE25
MGDKTSLRDACEYALLNGGKRFRPALVLMIAKALGFQVDVSQAALCVEYFHTASLIADDLPCMDNDDERRNAPTLHKIFGESTSLLATYTLIAAGYACLARNTAILKDSAHPYVNQKERLCVLALENATQNTGILGATGGQYLDLNPPNLSLKTLKEVIEKKTVTLFEISFVLGWIFGGGVLEKLSLVKKCAGHFGMAFQIADDLGDMKQDSFHDHTMNFANVYGKPAATQLFHDEIHQFNQTLTALDFQSEDLQALTCLLIEQVQLLS

SEQ ID NO: 41338 - protein, 397 aa, Zea mays
  misc_feature (176)..(176): Xaa can be any naturally occurring amino acid
MRKKGRAVPEWLNSPIWSATPPAPAQPDPYGADLAPPPPPKPPPPPATASPVPPPPSYEQAVGVGGGRREEEDDEGAGAVIRAHLLSDFKAALSKKVVNMGELRRLACLGVPDGGTGVRPVVWKSEKLRMIEETKLSRKKDTSIERIGFLSRFEVTNEEHPLSSGKSSLWNQYFQXLLEQIDRDVKRTHPDISFFSSKSNQESLRRILIIFSKLNPSIRYVQGMNEVLAPLFYVFKNDPDPSNSASAEADAYFCFVELLSGFRDNYCKHLDNSSVGIRSTLSKLSQLLKRHDEELWRHMEVTTKVYPQYYAFRWITLLLTMEFSFNVCIHIWDAILGDPEGPSDTLMRICCAMLILVRKRLLAGDFTANVQLLQHYPATNIDHLLHIANRLRGTVAG

SEQ ID NO: 41339 - protein, 189 aa, Zea mays
  misc_feature (72)..(72): Xaa can be any naturally occurring amino acid
TSTLPSINSLARWFGEPVRAAILQTEAFLTNAKGYPCLSKRHQSLLTGFFKHSVQVIIYGRSNHNVFPVSEXVLSGDESYAEDSRVRHALTPYLEYIAYLYQKMDPLPEQERIEINYRDFLQSPLQPLMDNLEAQTYETFEKDVVKYTQDSRRIFKVKCSVNRMQKKLKAATIRQKKCSQRCPQRSAST

SEQ ID NO: 41340 - protein, 483 aa, Lavandula bipinnata
TTSGSGVSTLEKKNLGRIIQIIGPVLDVAFPPGQMPNIYNALVVKGRDTVGQPINVTCEVQQLLGNNRVRAVAMSATDGLMRGMEVIDTGAPLSVPVGGATLGRIFNVLGEPVDNLGPVDTRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIKGFQLILSGELDGLPEQAFYLVGNIDEATAKGY

SEQ ID NO: 41341 - protein, 266 aa, Physcomitrella patens subsp. patens
KLFWLSEKPVCSFHGHTGDILDLSWSQSKLLLSSSMDKTVRLWHISEEDCLRVFCHNDYVTCVQFNPVDDSYFLSGSLDYKLRTWSIPGHQVVDWIDLREMITAVSYVPDGEKAIVGSHKGTCRFYNTKGNKLQLDASFDVRTENKKGRGKKITGLHCMPGDPQKVLVTSNDSRIRVYDGMGLCAKYKGLKNINSQISASYTRNGDYIISASEDSRVLIWSSDNKDPSSAKSLYGRDKQLACEEFSCRFVSLAIPWPGTRNYSSFS

SEQ ID NO: 41342 - protein, 142 aa, Zea mays
  misc_feature (116)..(116): Xaa can be any naturally occurring amino acid
IRLELAPLLFTKLADVLSKEGLFYAVIFPSIAWFGALGYLLYPMRDAIHPTAVDDRLVASLGPRLLGPAAIVRAWSFCLSYVMADLWGSVVISVLFWGFANQTTTVEEDKEFYPVXGLGANEALIYLGLTVKYFSNMRKNWG

SEQ ID NO: 41343 - protein, 518 aa, Leuconostoc mesenteroides subsp. mesenteroides ATCC 8293
MALLEISGLSMAYAEKTLYEDAAFELQAGEHMGIVGQNGAGKSTLIKIITGQELPLSGKIEWQKGLKVGYLDQYAEIPEGMTLVDFLHTAYQDLYDKQDRITELYNEYAESLSDKLLERAGRMQEELDAAGFYDVDTKIERVISGLGLEAIGRTRALESMSGGQRAKVILAKLLLENDDVIILDEPTNYLDVAHIEWLEDFLQSFEGSAMIISHDFDFLDKVTNAIIDLSFGKITKFRGSFKKAMRQKDERAEQQLRQYEKQQGEIEKAQKFIAKNKARASTSKQAKSREKMLARMDRVDPPSEALQAKFNFPYVNSQSANALTVNELSVGYVTPVLEPVTFSMTSGQKVVFKGFNGAGKSTLIKSVLGVIPALGGEAEFSPSAVVNYFDQDLEWDNDQKTPLQEMQDRFPKLEPKALRTRLAAAGINAENAQKPMKQLSGGEQTKVKLAIMEMKPSNFLILDEPTNHLDEGTKNALRAAIDKFPGNVIIVSHETSFTKGLGDKELNVAALSYKEEAE

SEQ ID NO: 41344 - protein, 306 aa, Pseudomonas putida KT2440
MSARHFLSLLDFTTDELLGVIRHGIELKDLRKRGVLFEPLKNRVLGMIFEKSSTRTRVSFEAGMIQLGGQAIFLSPRDTQLGRGEPIGDSAIVLSSMVDVVMIRTHAHSTLTEFAAKSRVPVINGLSDESHPCQLLADMQTFVEHRGSIQGKTVTWIGDGFNMCNSYIEAARQFDFQLRIACPEGYEPDQRFMALGGDRVQIIRDAREAVRDAHLVVTDVWTSMGQEEETARRLAHFAPYQVTRELLDLAAPDVLFMHCLPAHRGEEISQDLLDDPRSVAWDEAENRLHAQKALLEFLVEPAYHHA

SEQ ID NO: 41345 - protein, 350 aa, Leuconostoc mesenteroides subsp. mesenteroides ATCC 8293
MKAAVVRNVNDGYVDLIEDWQPRALAFGDALVDVEYVGLCHTDLHCANGDFGDPNKIGERNGNFGRVIGHEGVGRVSKLGEGASDYLKVGDRVSIAWFYDACGVCDYCVSGNETFCRKVRNSGYTIDGAMSQQVVVNAKYAVKVPEGLDPVEATSITCAGVTMYKALKVGETKPGEWVSVHGAGGLGNLAVQYAHSVFGAHVAVIDGNDDKLAAAKANGAEVLVNRKKEDVVAKVNELTGGVHNAQVTAVNDAAFSQAVNVLRPMGKLVAVALPQGDMALNIAKTVLDGIEVRGSLVGTRADLKEAFQFGAEGKVKPIVETVAFQDMNEIIDEMKAGSITGRKVIDFTTL

SEQ ID NO: 41346 - protein, 405 aa, Leuconostoc mesenteroides subsp. mesenteroides ATCC 8293
MAKLTVSDLELSGKKVLMRVDFNVPIKAGVIGNDNRIVAALPTIKYVLENNGRAILFSHLGRIKSEDDKKELSLAPVAARLGELLGKDVKFVPQTRGEELESAINALQDGEVLMVENTRFEDVVDGEVVKNESKNNPELGKYWASLGDDLFINDAFGTAHRAHASNVGIASNVSQAAAGFLMEKEIKFLGDAVANPVRPFVAIIGGAKVSDKIEIVKSLLNKADKVIVGGGMAYTFDAAKGNKIGNSLFEADKVELAKELMAEAGDKLVLPIDSIAADAFSNDAKTEVVDAEDGIPDGYMGLDIGPKSVKLLQDTLSDAKTVVWNGPMGVFEMSNFAKGTLAIGEELVKVTENGGTTIVGGGDSTAAVQQLGVADKLTHISTGGGASLEYLEGKELPGIASISEK

SEQ ID NO: 41347 - protein, 447 aa, Escherichia coli O157:H7 EDL933
MDQTYSLESFLNHVQKRDPNQTEFAQAVREVMTTLWPFLEQNPKYRQMSLLERLVEPERVIQFRVVWVDDRNQVQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKSSRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 41348 - protein, 669 aa, Coccidioides immitis RS
MSTPSTATATHPANHPHYRYPHQSSFHSNVTAYPAATSSSSSSAAVAATRVTNYNYPCQPAAAALPPPSSSASKPSQAQPAMAAYQTSTTLPTAQSRRRKPNWNEFYKNGVPKEIIVIDDDEDDPQNTSAANSVYTSSTVKPSSMASYGNGVAAQPASKKRRTGVETTYDLSYHDPPSYSVAVQQYGEGSSGTSLSTDRTASLHTTAPTSLGSHGSAPTNNVYYEDAAIGQKRKRVVTRKAARDEQKRRELEIAGYSTYIPPPKPPIKAKDVYVPVIRDPNFTKHSKVDDDDGHYIVTPDTNLTDRYSIIKLLGQGTFGKVVEAFDRQKKTRCAIKIIRSVQKYRDASRIELRVLSTLASNDETNRNKCIHLRDCFDFRNHICIVTDLLGQSVFDFLKGNGFVPFPSSQIQSFARQLFTSVAFLHDVNLIHTDLKPENILLVNNAYQTFTYNRTIPSSSHTTNRTARQRRVLLDSEIRLIDFGSATFEEEYHSSVVSTRHYRAPEIILNLGWTFPCDIWSIGCILVEFFTGDALFQTHDNLEHLAMMESVVGSRIDTKLVRQVMQGRNGSNPAAKYFNRTRLDYPNQDTPRSSRKYVKAMKQLQDFIPANNSFNKQFLDLLRRIFVYDPFARIKASEALKHPWFNESIIDDGTEAVRIGQMQRERANRA

SEQ ID NO: 41349 - protein, 460 aa, Nostoc punctiforme PCC 73102
MITTELSKIGDIIQNQREFFETGKTKDVTFRIEQLKNLKQAIIEHEQAIVEALKADLHKPELEIYITEIGVIKEIDYAIKHINAWTKPKKAAVSFDFFSYSAKIYPEPLGVVLIIGPWNYPFQLIISPLVGAIAAGNCAIIKPSEIASHTSGVIAKIIAKHFDPAYIAVLEGDVEASQKLLVEKFDHIFFTGGTAIGKIIMAAAAKYLTPVTLELGGKSPCIVDTDINLEHTVRRITWGKFINAGQTCIAPDYLLVNKKIKKDLIDGLKKCLKEFYGDNPISSPDYARIISQKHFDRLVNFLKDGEVIIGGENQSSERYIAPTVIDNVSSEDSVMQEEIFGPILPIIEYTDVAEAIALINSRPKPLALYLFSQNKNLQKRVLQETSSGGVCINDTVIQVGVSSLPFGGVGDSGIGNYHGKASFDTFSHNKSVLQNSFWLDLKWRYAPYEGKLPLIKKLLG

SEQ ID NO: 41350 - protein, 251 aa, Xanthomonas axonopodis pv. citri str. 306
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHQESSELVARKFAAALHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 41351 - protein, 544 aa, Acholeplasma laidlawii
MYEFKFADIGEGIHEGTVLQWNFKVGDKVKEGETLVIVETDKVNAELPSPVDGTIVSLGAKEGEEIHVGQIIVTIDDGTGTPAAAPAPAQVSAPTPAPAAAPQVAAPAASGDIYDFKFADIGEGIHEGTILQWNFKVGDKVKEGETLVVVETDKVNAELPSPVDGTILKLGKAEGEVIHVGETVVLIGQNGATLEQAQAPKAEAPVSEPKKGAGVVGEIEVSDDIIGGSEEVHVVATTGKVLASPVARKLASDLGVDIATIKGSGEQGRVMKDDVQNSKAPAEAQAPVQQTQAPAQAAASVAPSFAAAGKPQGDVEVVKITRLRKAVSNAMTRSKSIIPETVLMDEINVDALVNFRNEAKGLAESKGIKLTYMAFIAKAVLIALKEFPMFNASFNHDTDEVYIKKFINLGMAVDTPDGLIVPNIKNADRLSVFELASQVRSLADDTIARKISMDQQTGGTFTITNFGSAGIAFGTPVINYPELAILGIGKIDRKPWVVGNEIKIAHTLPLSLAVDHRIIDGADGGRFLMRVKELLTNPTLLLLS

SEQ ID NO: 41352 - protein, 184 aa, Aspergillus nidulans FGSC A4
MSITSQAAARCCRQLVRPSASLRLSATYQQTISRRWQSTEAPAAPANPKITQIVDQISQLNLLETADLVASLKSRLNIPDLPVGGFAMAPGAGAPGAAAAPAEEEEAAPPAQEKTLFNLKLESVDAAQKAKVIKEVKTLLGLSLVDSKKFVESVPKVLKESVPKEEAEKLIETLKAVGAKAVME

SEQ ID NO: 41353 - protein, 219 aa, Glycine max
MKLNISCPSTGCQKPIAIDDEKKLSAFYGRRMGQEVDGEHLGDEFKGYVFKITGGNDKDGFSMKQGVLVQGRVRLLMKAGHKCYRPRRAGERKRKSVRGCIVGPDLSVIALAIVKIGEQPIAGLTDTKQPKRLGPKRATRIRKLFALTKDDDVRRFVIRRKIEKEGKPVRYKAPKIQRLVTDARLRRKRVYKAHKKARWERTRAAVTEYQKVLEKKKKK

SEQ ID NO: 41354 - protein, 313 aa, Oryza sativa Japonica Group
MQASVAVSEALEAGKLSAAPRDGAADFAVAWLAVVVVSLAVAATCVVVSFDAHARQPGRLRRMLDLGPSVRGARLLLAIFAGLLAAAEVIRLPFFSRAVVSPPRHVVPCLAYPLVAHGVAEPCFLATVLLLLRASTGGARLPAAALAVPFACLPFLSAHVAVLVLPAAVAPYPGQLAHAADVDARCAYPAYAAALLVALAALYAPLLLSACWTVAAVAINRRMRARAYALAALVVVPLPVQVVALALSSVWETPRRTSPVAAFLGFLAVGIAAAAALAILVLLPVYDALFLGDDEQLPVAVAAAGEEARELDR

SEQ ID NO: 41355 - protein, 404 aa, Glycine max
  misc_feature (305)..(305): Xaa can be any naturally occurring amino acid
MASATLSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSDIISVDGKEIKVVSDRNPANLPWKDLGIDLVIEGTGVFVDREGAGKHIQAGAKKVLITAPGKGDIPTYVVGVNEYDYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTXPNVSVVDLVVQVSKKTFAEEVNAAFRESADNELQGILSVCDEPLVSVDFRCTDVSSTVDSSLTMVMGDDMVKVIAWYDNEWGYSQRVVDLADIVANKWK

SEQ ID NO: 41356 - protein, 361 aa, Malpighia glabra
MKALILVGGFGTRLRPLTLSFPKPLVEFANKPMILHQIEALKAIGVTEVVLAINYQPEVMLNFLKDFEKKLDIKITCSQETEPLGTAGPLALARDKLIDESGEPFFVLNSDVISEYPLKEMIEFHKNHGGEASIMVTKVDEPSKYGVVVMEESTGRVERFVEKPKIFVGNKINAGIYLLNPSVLDRIELRPTSIEKEVFPKIAADNSLYAMVLPGFWMDIGQPKDYITGLRLYLDSLRKKSSTKLATGSNVVGNVLVDETAKIGEGCLIGPDVAIGPGCVVESGVRLSRCTVMRGVRIKKHACVSSSIIGWHSTVGQWARVENMTILGEDVHLCDEVYSNGGVVLPHKEIKSSIIKPEIVM

SEQ ID NO: 41357 - protein, 396 aa, Cystobacter fuscus
MNLANRLKVIKPSPTLALNTKAKELAAQGVDVVSFAAGEPDFDTPDFIKQAAIEALNKGFTKYTACAGIPELREAICAKLQRDNHLTYKPDQVLVSVGAKHSLYNIFQALLNEGDEVIILSPYWVSYPEMVQLAGGKPVIVHTREEDGFAPDPDAIRKALSPRTKALIINSPSNPSGVVFSRDTLAKIADAVRGHECLLVSDDIYEKLLYTGEFANIGNVAPDLLPRLVVVNGMSKAFSMTGWRLGYTAGPKWLIAGMQMVQDQSTSNASSFSQKAAVAALKGPDSIFEPMVKEYRARRDMVVELLNSFDGVRCRTPEGAFYVLPNISGLYGRSYKGTPLQGSIQVSEILLNDFRIAAVPGAPFGVDENIRLSFATSREQLQKGLERFREFTASVR

SEQ ID NO: 41358 - protein, 767 aa, Rickettsia conorii str. Malish 7
MDEMNKINYAEALEYHEKDKPGKIAISATKSLVTQQDLSLAYSPGVAAPCLEIAKNLEDVYKYTARGNLVAVISNGTAVLGLGNLGAAASKPVMEGKAVLFKKFADIDAIDLEVNTEDPEEFINAVKYLSYSFGGINLEDIKAPECFIIEEKLKSLMDIPVFHDDQHGTAIITAAGLINAAYLTNRKLEDLKIVVNGAGAAAIACIDLLIALGADKSKIIVCDTKGVVYKGRLEGMNKWKELYASDTKFRTLAESLNNADVFIGLSVKGAVTKDMVSRMASNPIIFAMANPDPEITPEDIQLVRDDAIIATGRSDYNNQINNVMGFPYIFRGALDIRAKTINTEMKIAAAKAIADLARRPVPEEVYKAYSGRKMVFGKEYIIPVPFDPRLITVVAAAVAVAAIESGVARVKDFSIGKYKKELGSRLNPTANYMNFLAEKIHNAPLKRIVFAEGEEEEVISAALMMRDKKYGHPIIIGRVERIEVMLKKIGQDISLDGIQIMNAALSDSLEKYTDYLYKRLQRKGYLYRDCAKLVKTDKNIFAACMLACGDGDALLTGVTQSYIDSLEDIMKVISPKTNRSILGYSIMIAKDNNIIIADNCITEYPNSWELAQIATQTAEIAKNMGITPRVALLSFSTFGNSSKAKTARIREAVNILDNFSKDKEELSGMKVDFEYDGEMSVKVALDGDLRKLYKFCRLSGSANVLIMPGLNSAAISTELLQEFSSNSFIGPITNGFEKPVQILQAAATANEILKIATFACVEAINEV

SEQ ID NO: 41359 - protein, 462 aa, Solibacter usitatus Ellin6076
MQKFDIIVIGSGPAGQRAAIQGAKCGRRVAVIEQREIVGGACVNTGTIPSKTMREAVMHLSGFQYQGIYGSNYHVKEKILMADLGFRVKQVIKTEVDVTQAQLTRNGVEVITGRAGFLDSTHVRVESSRGQTDLEAPIIIIATGTKPSTSPTVPLNGRTIVNSDQILDIPEIPKTLIVVGGGVIGVEYTCIFAILGVRVILIEKRPRLLEFADSEMVEALSYHLRDHRVTMRLNEEVAAVEEQAGGGVVARLKSNKVISGDALLYAVGRQGNVEDLNLPAAGLEADGRGRITVDSDYRTKTSNIYAAGDVIGFPSLASVSMEQGRLAAANAVGLKIQSNPATYPYGIYTIPEISFVGKTEEQLTADDVPYEVGVAYYRETARGQIRGDTTGRLKLIFHRETREILGVHIIGEGATELLHIGQAVMILKGTVDYFVETVFNYPTLAECYKQAAFNGINKLMRF

SEQ ID NO: 41360 - protein, 250 aa, Methylobacillus flagellatus KT
MRRKLVVGNWKMNGNLAQNKRLLEALVRGLQDVEHVDIAVCVPYPYLFQAQKILSGTNIAWGAQNVAKHENGAYTGEVSAAMLKEFGASYVIVGHSERSDAYCESNANIAEKFAIAKHYGITPIFCVGETLQERESGVMEYAIANQLDAVLSVSGGALLDQAVIAYEPVWAIGTNRTATPEQARAAHSFIRERIAAMHPGAAESVRIIYGGSVNPRNAAQLLSMPDIDGGLIGRCSLDADDFERICRAAC

SEQ ID NO: 41361 - protein, 591 aa, Lactobacillus reuteri
MNLHPDYLLNEVNEPSDIKDMSLDELKQLATEMRQLVLERDAKIGGHVGPNLGVMELTIAFHYVFDSPHDKVIWDVSHQSYAHKMLTGRKLGFLDPDHYEDITGFTSPEESAHDFFEIGHTSTSISLAVGMAQARDLMKPQSHNNVMAVIGDGSLSGGLAFEGLNNAAKLNSNLIILVNDNQMSIDENQGGLYKGLKELRDTNGESPNNIFKFMGLDYKYVADGNDLQTMIDTFKEIKDIDHPIVLHVNTLKGKGYEPAVEEKMKYHWRTPFDLKTGEDKVKVSGESYSDTVLAELDKQIAADKPVVAINAGIPGVFDLGKFKAKHPDRYYDVGIAEQDSITTAVAMAQAGARPVVFQNSTFLQRAYDQLIHDMALNDAPVVMIVRGGSISESSATHQGTFDISMISDLPNIEYLAPTNVEEMISMLRWAINQTDEPVVIRQPEKPLLHGTPTQDDYSTIKYDIAHRGSEVAIMAVGDFWELGERVRKELQDKLNIDATLINPKSVTGIDSDVLHHLAENHDVVVTLEDGVLSGGFGETIARYYGPKGMKVLNFGAPREFADNVPTEVLYEWYHLTPKQIVDDIEQVIHSL

SEQ ID NO: 41362 - protein, 300 aa, Leptonema illini
RIGRMVFRAVVEQNRNVEIVGINDLLDAEYMAYMLRYDSTHGRFTGDVKVEGGQLIVNGKKIRVTAESDPANLKWNEIGAEYVIESTGLFTTLEKTQAHLKAGAKKVVISAPSADAPMFVMGVNHSSYKNDMDIVSNASCTTNCLAPITKVINDRWGVEEGLMTTVHAVTATQKTVDGPSKKDWRGGRGAYQNIIPSSTGAAKAVGKVIPELAGKLTGMSFRVPTSNVSVVDLTVRLKKPAKYEDICKAMKEESEGAMKGVLGYTDEEVVSNDFLHDARTSIFDAKAGIQLSDTFVKVVS

SEQ ID NO: 41363 - protein, 173 aa, Bordetella petrii
MAKVQGKGAAEKENDDGLREKMIAVNRVSKVVKGGRTMSFAALTVVGDGDGRIGMGKGKAREVPVSVQKAMEQARRGMFKVALKNGTLHHTVVGKHGASTVLISPAAEGTGVIAGGPMRAIFEVMGVRNVVAKSLGSSNPYNMVRATLNGLRASLTPSEVAAKRGKTVEEILG

SEQ ID NO: 41364 - protein, 342 aa, Aspergillus oryzae
MSLYQNIALNGSFALHGLRHPLDMYSSLGPTLSEATFGLLGYSFEPSRDIGDLSGKVLFVTGGNAGLGKETVLQLAQHNPSRIYLAARDATKAREAISSIQDIISASVDIRHIQLDLSSFQSTRDAAEKFCSECDRLDILILNAGTMANPPELTKEGFEIQFGTNHIGHFLLTKLLLPTLKKTVGSPASDVRIVTLSSVGSHAAPSLDVMTSTSALLDSHTLVRYSASKAANILFASELARRYPEILSVSVHPGVVSSELYRHTGAMNAISKFGVGLLSTVFRSIRTGAMNQLWAAGTKREQLVNGAYYVPIGVRGSSRFTDDADMARKLWEWTENQIAEKS

SEQ ID NO: 41365 - protein, 756 aa, Arabidopsis thaliana
MEMERVHEFPHTHMDRRPRKRARLGWDVLPQATKAQVGMFCGQEIGNISSFASSGAPSDNSSSLCVKGVARNGSPPWREDDKDGHYIFELGDDLTPRYKIYSKMGEGTFGQVLECWDRERKEMVAVKIVRGVKKYREAAMIEIEMLQQLGKHDKGGNRCVQIRNWFDYRNHICIVFEKLGSSLYDFLRKNNYRSFPIDLVREIGWQLLECVAFMHDLRMIHTDLKPENILLVSSDYVKIPEYKGSRLQRDVCYKRVPKSSAIKVIDFGSTTYERQDQTYIVSTRHYRAPEVILGLGWSYPCDVWSVGCIIVELCTGEALFQTHENLEHLAMMERVLGPFPQQMLKKVDRHSEKYVRRGRLDWPDGATSRDSLKAVLKLPRLQNLIMQHVDHSAGELINMVQGLLRFDPYLLWNLPRTSSALSDSASPLRIPCLILAGNSTVSNRLMGSAARQPLFSFGVIADVQYADISDGRSFLGVPRYYRNSILVLQRAVETWNQHGNLKFVINMGDIVDGFCPKDQSLAATKKLVHEFEKFNGPVYHMIGNHCLYNLPREELLPLLKIPGRDGNAYYDFSPTPEYRVVVLDGYDISAVGWPQEHPNTIAALKILEEKNPNTDKNSPAGLEDVARRFVKYNGGVGEKQLQWLDSVLQDASNSNQRVIVCGHVPMSPGVASKAALLWNFDEVMNIIHKYDSVKVCLSGHDHKGGYFVDSHGVHHRSLEAALECPPGTYSFGYIDVYDNKLSLVGTDRMQSTDFEN

SEQ ID NO: 41366 - protein, 302 aa, Leptospira interrogans serovar Icterohaemorrhagiae
RIGRLVFRAGIKDPNLEFVAINDLVTPDNLAYLLKYDSTHGRFQGTVEHTEKELIVDGKKILCVSERDPEKLPWKDLKVDYVIESTGLFTDRVGAEKHIKAGAKKVVISAPAKDKDIPTFVMGVNNEKYNPSNDHIVSNASCTTNCLAPIVKVVLDNWGIEEGLMTTIHATTATQPTVDGPSKKDFRGGRGAMQNIIPASTGAAKAVGLCIPEVNGKLTGMSFRVPTPDVSVVDLTVRTTKETSLKEISAKMKAASEGAMKGILGYTEDMVVSNDFVSSTLSSIFDMDACIELNSRFFKLVS

SEQ ID NO: 41367 - protein, 200 aa, Pseudomonas putida KT2440
MSVLVGKKAPDFTVPAVLGNGEIVDSFNLASAIKGKYGLVFFYPLDFTFVCPSELIALDNRIPDFQARNVEVIGVSIDSHFTHNAWRNTPVNNGGIGQVKYTLAADMTHEICKAYDVESEGGVAFRGAFLIDTNGVVRSQIVNDLPLGRNMDELLRLVDALQFHEEHGEVCPANWKKGDKGMNASPEGVAAYLSENAGKL

SEQ ID NO: 41368 - protein, 202 aa, Sorghum bicolor
MASATGGSSSEMAVDHPTGPGAVEKPQFDALMPSEMSGGRPQFRKVTVPQHRFAPLKRCWMEIYTPVYEHMKIDIRMNLKARRVELKTRQDTPDVSNLQKCADFVHAFMLDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 41369 - protein, 97 aa, Trichodesmium erythraeum IMS101
MSIYVGNLSYDVTQEDLSEVFAEYGTVKRVQLPTDRETGRPRGFGFVEMSSEEEEQKAIDALDSAEWMGRDIKVNKAKPREERKPSNRRDPGAGGRY

SEQ ID NO: 41370 - protein, 102 aa, Trichodesmium erythraeum IMS101
MSIYVGNLSYDVTQDDLSEVFAEYGTVKRVQLPTDRETGRPRGFGFVEMSSENEEQKAIEALDGAEWMGRDIKVNKAKPREDRGSGGNRRNSPNYSRGGKFQ

SEQ ID NO: 41371 - protein, 338 aa, Lactobacillus sakei subsp. sakei 23K
MTNSVFQGRSLLAEKDFTKSELEYLIDFSLHLKDLKKKGIPHHYLEGKNIALLFEKNSTRTRAAFTTAAIDLGAHPEFLGKNDIQLGKKESVEDTAKVLGSMFDGIEFRGFSQKVVEDLAKYSGVPVWNGLTDEWHPTQMIADFMTVKENFGKLKGVTLTYVGDGRNNMANSLLVTGSMLGVNIHIVAPDSLQPTQEVRDLAEGYAKETGSKNMITSDVDAGVKGSDVLYTDVWVSMGEEDKFEERVNLLKPYQINMDMVKKTGNENMIIMHCLPAFHDIETEYGKKIDEQFGIQEMEITDEAFRSKYARQFEEAENRMHSIKAIMAATLGNLFIPQA

SEQ ID NO: 41372 - protein, 279 aa, Moritella sp. PE36
MSVIIKTEDQIEKMRVAGRLAAQVLEMIEPFVVAGVTTQELNDRCHEFTLANDALSAPLFYPSYDENDDTAFPKSICTSINSVVCHGVPSDRPLVDGDIINLDITVIKDGLHGDTSKMFLIGEVSPRDKQLCRISQEALYEGLRQVKPGTRLSRIGEIIEKKIKSHNKANPTRKYSIVEEYCGHGIGEKFHEEPQVLHYKSRFNESNQNLVLKEGMCFTIEPMINAGKKHNHVADDHWTVLTKDNKNSAQWEHTIVVTKDGCEIMTLRDEETIPRILKN

SEQ ID NO: 41373 - protein, 164 aa, Arabidopsis thaliana
MNSSGGSCSSLMDVVAYDHHLHHGHDEELHVLAVDDNLIDRKLVERLLKISCCKVTTAENALRALEYLGLGDQNQHIDALTCNVMKVSLIITDYCMPGMTGFELLKKVKESSNLREVPVVIMSSENIPTRINKCLASGAQMFMQKPLKLADVEKLKCHLMNCRS

SEQ ID NO: 41374 - protein, 304 aa, Propionibacterium acnes KPA171202
MDIAVVGSNMVDLISYIHRMPSDGETVEAPEFRMGCGGKGANQAVAASRLGAEVVMVTRVGNDVFADTTLDNFRKNGIDTTHVLRTDASSGVAPIFVDPESRNSILIIKGANAQLSPADVEGARQDIATCKLIMLQLEIPLETVYATIELGDVLGIPILLNPAPVAPELDLERIRGIEFFMPNESELELITGMPVDTLDDIGKATDVLLGAGITNIIVTLGSRGAMWAHAEGRKIIKAPVVQAVDTTGAGDAFIGCFAKEWVDHGDVIAAIRAGNRYAADSVTRHGTQSSYALADGSLPEWLRS

SEQ ID NO: 41375 - protein, 340 aa, Oryza sativa Japonica Group
MSLQVPNVQELALTCNRPDQQIPDRYIRPEAGTEEVICGQGINTAIPVIDLAKLLNPQSSQEECAKLRSACQHWGFFQLVNHGVPDDVISDVRRDLTEFFKLPLEAKEAYAKPPDKYEGYGQHFVVSEKQKLDWGDLLHLRLRPTESRDLRNSMERYSLETAKVARCLLEFLAMDMGVDPESLLEVFRGQPQNMRVNYYPPCRQTGKVLGLSPHCDATSLTLLLHVNDMQGLQIRKDGKWLTIEALDGAFVVNVGDMLEILSNGRYRSVEHRAVVHPEKERISAAVFHQACRDATVGPLPELVTKDGGRPVYKSMAYEDFMKRFFSAKLDGRANVEGMKI

SEQ ID NO: 41376 - protein, 583 aa, Bromus tectorum
LRPWGPSEPRKGADILVEALERCGIVDVFAYPGGASMEIHQALTRSPVITNHLFRHEQVEAFAASGYARASGRVGVCVATSGPGATNLVSALADALLDSIPMVAITGQVSRRMIGTDAFQETPIVEVTRSITKHNYLVLDVEDIPRVIQEAFFLASSGRPGPVLVDIPKDIQQQMAVPAWDTPMSLPGYIARLPKPPSTESLEQVLRLVGEAKRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNDLLNGSKAQKSLDFGPWQEELEQQKRTFPLGYKTFGEAIPPQYAIQVLDELTKGEAIIATGVGQHQMWAAQYYSYKRPRQWLSSAGLGAMGFGLPAAAGASVANPGVTVVDIDGDGSFLMNIQELALIRIENLPVKVMILNNQHLGMVVQWEDRFYKANRAHTYLGNPENESEIYPDFVTIAKGFNVPAVRVTKKSEVRAAIQKMLDTPGPYLLDIIVPHQEHVLPMIPSGGAFKDIIMEGDGRIEY

SEQ ID NO: 41377 - protein, 310 aa, Escherichia coli O157:H7 EDL933
MDNLDVICIGAAIVDIPLQPVSKNIFDVDSYPLERIAMTTGGDAINEATIISRLGHCTALMSRIGKDAAGQFILDHCRKENIDIQSLKQDVNIDTSINVGLVTEDGERTFVTNRNGSLWKLNIDDVDFARFSQAKLLSLASIFNSPLLDGKALTEIFTQAKARQMNICADMIKPRLNETLDDICEALSYVNYAEAKLLTGKETLDEIADSFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 41378 - protein, 293 aa, Zea mays
  misc_feature (105)..(105): Xaa can be any naturally occurring amino acid
  misc_feature (135)..(135): Xaa can be any naturally occurring amino acid
  misc_feature (148)..(148): Xaa can be any naturally occurring amino acid
  misc_feature (162)..(162): Xaa can be any naturally occurring amino acid
  misc_feature (224)..(224): Xaa can be any naturally occurring amino acid
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAXGSPGGHINPAVTFGLFLARKVSLVRALLYXVAQCLGAICGVGXLSRRSRAPTSTGTXAAAPTRSPPATPAAPASAPRSSAPSCLVYTVFSATDPKRNARDSHVPVLAPLPIGFAVFMVXLATIPVTGTGINPARSLGAAVIYNKDKPWDDHWIFWVGPLVGAAIAAFYHQYILRAGAIKALGSFRSNA

SEQ ID NO: 41379 - protein, 404 aa, Oryza sativa Japonica Group
MLEHIEELEVDDEDSNYNFCSAAADDTANTIKLLSKRYINATSDQDQVKNSHALAETCNDPDQQIPERYIRADANADEVISGDDCTAAIPTVDLSKLLDPLSSDEETEKLGSACQQWGFFQLINHGVSEDVIRDARKDIAEFFRLPMETKKAYSQLPSGIEGYGQAFVVSHEQKLDWADMFYLVLRPGESRNMALWPAHPPSFRNSIDRYSSETARVARCLLEFMAKDMGVRPGSLLERFQDQPQGIRMNDYPPCREAGKVVGLSPHTDAACLTLLLQVNDVPGLQIRSPGGRWLAVGAPPDDGAFIVNVGDILEIMSNGKYRSVEHRAVVRPDRERVSAAVFHQPCQDAVVGPLPELVGEGGGDNARYTSMGYLDFMKRYYSAKLDGRNHLDGLRIKLSSSKG

SEQ ID NO: 41380 - protein, 473 aa, Cryptococcus neoformans var. neoformans B-3501A
MSSQNVSGLMAGLSLYAPQSPKGSKAQQAGKTQESSHSSQSQNRLPPVLKKYMNPGLVRPPNSGLANNSHPSSSYSDPSSRGPLLTLAGVNVSYPKSGTVSPMNKSKGAIGHHSAHGIHGPAHSTSSRAMASSINPGASKHAVTTSSSHITNLVSENCKSLELGRYDGGLEEDEANHGDASGPTAKMLELSSVSEGAIPLSLPSFTIGRPLGKGKFGRVYLARSKAPPHFIVALKCLHKAEIIQGKVESQVRREIEIQQNLRHPNILRLYGYFHDSKRIFLVLEFAAKGELYKQLSRLGRFDEKKSSRYIAQMADALSYLHRKHVIHRDIKPENLLIGLNGELKIGDFGWSVHAPSNRRSTLCGTLDYLPPEMVEGKEHTAAVDLWALGVLTYEFVVGGPPFEDLSGNAATYRRIRNVDLHVPSWISPEATDLIKRLLRYKPEDRLPLSQVMIHPWIKMYEKKRSASNGIRRS

SEQ ID NO: 41381 - protein, 502 aa, Glycine max
MEKMLGRNCGKLKTKIVCTLGPSSRSVEMLEKLLKAGMNVARFNFSHGTHSYHQETLDNLRTAMNNTGILCAVMLDTKGPEIRTGFLNEGKPIQIHRGQEITITTDYSIKGDENMISMSYKKLAHHLSPGSNILCADGTISFTVLECDKENGLVRCHCENSAVLGERKNVNLPGVVVDLPTLTEKDKEDILEWGVPNKIDIIALSFVRKGSDLVEVRNLLGKHAKSILLMSKVENQEGVANFDEILENSDAFMVARGDLGMEIPIEKIFLAQKVMIHKSNIKGKPVVTATQMLESMIKSPRPTRAEATDVANAVLDGTDCVMLSGETAAGAYPDIAVQTMARICSEAESFIDYGDLFKRVMETAPTPMSPLESMASAAVRTANCINAALILVLTRGGTTSKLVAKYRPSMPILSLVVPEITTDSFEWFCSQEAPARHSLIYRGLIPVLGTGSFGDSMTESTEETIQLALSYAKKNDLCKPGDSVVALHRLESGTVIKILDVC

SEQ ID NO: 41382 - protein, 459 aa, Escherichia coli O157:H7 EDL933
MDQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRHTGKPLPPVVIADDGKAPQAVPYSALLTGVLLKRVILGSCVLIAMNVVQYTLINWLPTIFMTQGINLKDSIVLNTMSMFGTPFGIFIAMLVMDKIPRKTMGVGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 41383 - protein, 218 aa, Photorhabdus luminescens subsp. laumondii TTO1
MENYKNVHVLPKSQYLTSLHTKARNRKAEQSEFVFYSDRIIRLLLEAASELLPYTSHNIQTPIGDIYNGAILNTKLCGVSVIRAGESIEGEYRRMYPDSPMGKILIQRDKLTKLPHYYYSNLPDDIAERTILLFEPMLATGGSLAKAIDLLKEREVPEDNIIVVNFLSSPVGLNRIMTSYPTIKLITSSIENGLNKDAFMNPGIGDFGDRYFGTYKPS

SEQ ID NO: 41384 - protein, 298 aa, Streptomyces antibioticus
MDLTGRRAVVTGGASGLGAETVRALAAAGAEVTVATRRPLSAEPLVQELAAAGGAGRVTAEALDLSDPASVESFARAWRGPLDILVANAGIMALPTRTLAPNGWEMQLATNYLGHFALATGLHAALRDAGSARIVVVSSGAHLDAPFDFEDAHFARRPYDPWVAYGQSKAADVLFTVGARRWAADGITVNALNPGYILTRLQRHVDDETMRAFGVMDDQGNVKPLPYYKTPEQGAATSVLLAASPLLKGVTGRYFEDNQEARTVQGQEDQPGGVAAHALDPEAADRLWEYGTDALRAA

SEQ ID NO: 41385 - protein, 414 aa, Prochlorococcus marinus str. NATL2A
MTPERLGLLWGITVFSGAGARLLSVLTGLPGVVLLLLSGLLIGRSGLGLVEPLDLGKGLETIVGLLVSLVLFDGGLNLRFPGGAIKSIVLRISSIRLIISLAAGFFAAHWFAGLGWSVAGVYSAIVLATGPTVVTPLVRQIRLASPLSDVLEAEGLILEPIGAVLALLLLELVVGDLHGWRELFLGLLSRLGGGVLIGSLAGLFLSEGLKRLRSEPYIGIRLQLTLGVVFLLYGVCEWLLPESGLPASVAAGFVVGQRPSTQANELDKLIRELAQLAITMLFPLLAADVSWGELSPLGWGGITCVLFLMIIVRPIAVSIATFGLPLDNKQRLFLGWLAPRGIVTAAVASLFSIRLEQAGVLGAGKLQGLVFLTILMTVGIQGLTAQPLAKMLGLLDEDKDLDKPTNSGSIFTES

SEQ ID NO: 41386 - protein, 1475 aa, Botryotinia fuckeliana
MEKDREETLSLGTTTNTARASTDDSETQRENVRNANPNGFVSTDRGIDVKNAESEFAQLQRELSGISTKSKALSRTRSRAQAADEKDVEKSAESIAETEGEQFNLENTLRGNRQAEADSGIRPKHIGVVWDGLTVRGTGGVSNFVKTFPDAFVSFFNVVETAMNIFGVGKKGREVKILQDFRGVMKPGEMVLVLGRPGSGCTTFLKVIANQRFGYTGVDGEILYGPFSAEEFSKKYRGEAVYNQEDDVHHPTLTVGQTLGFALDTKTPGKRPHGMSKADFKEKVIDTLLRMFNISHTRNTIVGNAFVRGVSGGERKRVSIAEMMITSGTVCAWDNSTRGLDASTALDYAKSLRVMTNIYKTTTFVSLYQASENIYKQFDKVLVIDDGREVYFGPTSEARAYFEGLGFKEKPRQTTPDYLTGCTDEFEREYATGRSAADSPNSPETLAQAFLNSKFSTHLSEEMAAYKQQVATDKQAHDDFEVAIADSKRKGASKSSVYAVPYHLQIWALMQRQYLIKWQDKFSLVVSWITSITVAIVLGTVWLNLPKTSAGAFTRGGLLFIALLFNAFQAFSELASTMMGRPIVNKHRSYTFHRPSALWIAQIIVDTAFAAAQILLFSIIVYFMCGLVRDAGAFFTFYLIILSGYLAMTLFFRTVGCLCPDFDYAIKFAATIITFFVITSGYLIQYQSEKVWIRWIYWINALGLGFSALMENEFSRLNLTCSGAYLVPYGPGYDNLDHRVCTLAGSVAGSDIVVGGDYITQGYEYKPSELWRNFGIIIVLIAGFLFTNATLGEWVSFGAGGNAAKVYQKPNKEREELNKALAAKRDQRRSAKSDEEGSEININSKAILTWEGLNYDVPTPAGELRLLNNIYGYVRPGELTALMGSSGAGKTTLLDVLASRKNIGVISGDVLVDGVKPGNAFQRGTSYAEQLDVHEGTATVREALRFSADLRQPFHVPQAEKYAYVEEIISLLEMEDMADAIIGDPENGLAVEQRKRVTIGVELAAKPELLLFLDEPTSGLDSQSAFNIVRFLKKLANAGQAILCTIHQPNAALFENFDRLLLLKRGGRCVYFGDIGKDAHVLLDYFHKHGAVCPPDANPAEWMLDAVGAGQTPGIGDRDWADIFAESPELANIKDRISQMKTERLAEVGGTTNDDGREFATPLMHQLRVVQARTNLAFWRSPNYGFTRLFNHVIIAIITGLAYLNLDDSKSSLQYRVFVIFQVTVLPALILAQVEPKYALSRMIYYREASSKMYSQFAFASSLVVAEMPYSILCAVGFFLPLYYMPGFQTSSSRAGYQFFMILITELFSVTLGQMVAALTPSPFISALVNPFIIITFSLFCGVTIPKPQIPKFWRAWLYQLDPFTRLIGGMVVTELQGREVKCTSSELSRFTAPAGQTCGEYMDNFFSSGGIGYIVNNATSACEYCAYKFGEQFYEPLALEYGNRWRDLGIFLAFIGSNLIILFLASRYFNFNRR

SEQ ID NO: 41387 - protein, 507 aa, Rickettsia conorii str. Malish 7
MDSVDSNFTIWNKARNSKFRHIVWPIRSYELTKFIPMALLMFFILLNQNLVRSIKDSFVVTLISSEVLSFIKLWGEMPMGILFVIFYSKLCNIMTTEQVFRIITGTFLFFFAIFGFILFPYREFFHPDPELIKHYITVLPHLKWFLIIWGQWSLVLFYIMGELWPVIVFTLLYWQLANKITKVEEAPRFYSFFTLFGQTNLLISGTVIIYFAKSEHFLLPLFSHLNDTNEILLKSFITVILISGLICLALHKLIDKSVVEADKNIKFKNQRMDILKLSLVDSAKVILTSRYLGFICLLVMSYSMSISLIEGLWMSKVKQLYPATKDFIAYHGKVFFWTGILTLVSAFLGSSLIRICGWFWGAIITPIMMFGAGVMFFSFTVFENHLGNIVNTLGYSAPLVVIVFIGGLWHVLSKSVKYSLFDATKEMVYIPLDSEMKTKGKAAVDVMGAKIGKSIGAIIQFISFSIFPNAIHNDIAGLLMFSFIIVCLLWLYGVKVLSKYYNKMIQR

SEQ ID NO: 41388 - protein, 715 aa, Salmonella typhimurium LT2
MTTTSAFMLNVRLDNVAVVAIDVPGEKVNTLKAEFATQVRAILKQIRENKALQGVVFISAKADNFIAGADINMIGHCQNAQEAETLARQGQQLMAEIQALPVPVIAAIHGACLGGGLEMALACHRRICTDDVKTVLGLPEVQLGLLPGSGGTQRLPRLVGVSTALDMILTGKQLRARQALKAGLVDDVVPQTILLEAAVELAKKERLAQRTLPVRERILAGPLGRALLFRLVRKKTAQKTQGNYPATERIIDVIETGLAQGSSSGYDAEARAFGELAMTPQSQALRAIFFASTEVKKDPGSDAPPGPLNSVGILGGGLMGGGIAWVTACKGGLPVRIKDINTQGINHALKYSWDLLETKVRRRHIKASERDKQLALISGSTDYRGFSHRDLVIEAVFEDLPLKQQMVAEVEQNCAAHTIFASNTSSLPIGDIAANAARPEQVIGLHFFSPVEKMPLVEVIPHASTSAQTIATTVKLAKKQGKTPIVVSDKAGFYVNRILAPYINEAIRMLTEGERVEHIDAALVKFGFPVGPIQLLDEVGIDTGTKIIPVLEAAYGERFSAPANVVASILNDDRKGRKNGRGFYLYGEKGRKSKKQVDPAIYKLIGVQGQSRLSAQQVAERCVMLMLNEAARCFDEKVIRSARDGDIGAVFGIGFPPFLGGPFRYMDALGPGEMVATLQRLAALYGPRYAPCEQLVRMAERREHFWTNGETDQGN

SEQ ID NO: 41389 - protein, 279 aa, Prochlorococcus marinus str. NATL2A
MNLFSDLLSSENSKIPINNGPVIKQRRGVEIKSSREIEIMRKSSKIVATVLSEIRDLVKPGMSTLDLDNYAEKRIRDHDAKPSFKGYHGFPGSICSSINNEVVHGIPSKKKIINDGDLLKVDTGAFYNGYHGDSCITICVGNTSDKANELSRVAREALMLGIKQIRPQNKLLDIAGAIEDYVKANGFSVVEDYTGHGVGRNLHEEPSVFNFRTNDLPNVTLREGMTIAVEPIINLGSKHCKTLSDGWTVITKDGNLSAQWEHTVLVTKNGCEILTDRGD

SEQ ID NO: 41390 - protein, 442 aa, Methylobacillus flagellatus KT
MAIKDVLVPDIGNFDSVDVIEVLVSAGDTIAKDDSLITLESDKASMDIPAPFSGTVKEVKVKVGDKVAQGTLILTMDALEEGASAAPAPKEDAPPVQVAVPAPVPEATRPAPEPPPTIQPQATPNPIGASVATASGKLAHASPSVRKFARELGVNLALVTATGPKNRITQSDVQAYVKNELSKPRGGGIATGAGGLAVIPAPVIDFSQYGDTETKPLSRIKKLSGANLHRNWVTAPHVTQFDEADITDLEDFRKSMQSEAEKRGVKLTMLAFLIKASVNALRAYPNFNASLSADGESLILKQYYNVGFACDTPDGLVVPVIRDVNRKDVLEIAAELGELSAKARERKLKVEEMQGGCFTISSLGGIGGTAFTPIINCPEVAILGVSRSSIRPVYNSKTKEFEPRLVLPLSLSYDHRVIDGADGARFTSHLRMVLSDVRRLLL

SEQ ID NO: 41391 - protein, 588 aa, Methylobacillus flagellatus KT
MSKIIEVLVPDIGNFDSVDVIEVLVKAGDTIAKEDALITLESDKASMDIPSSHAGVVKEVKVKVGDKVAKGSLILLLEEAGTDQASTTADAAPAAKEESKPVPAATPAAPEPATGDSDINTEVVVLGSGPGGYTAAFRAADLGKQVVLIERYSTLGGVCLNVGCIPSKALLHTAKVITEAEETSLHGVSFGKPKIDLEALRAWKANDVVGKLTAGLAQMAKQRGVTVVQGVGKFTSPHQIAVTAADGKVTTVGFQNAIIAAGSQATKFPGAPEDERIMDSTGALALADVPKRLLVIGGGIIGLEMGTVYEALGSKVSVVEFMDGLIPGADRDLIRPLQKRMEKRFERIMLSTKVANIEAKKDGIHVSFEGENAPKEIEVYDRVLVSIGRRPNGKNIGAENAGVAVDDRGFITVDKQMRTNVPHIFAIGDIVGQPMLAHKATHEAKVAAEVIAGHKVEFQAMVIPSVAYTDPEVAWAGVTETEAKAKGLEIEKASFPWAASGRALSIARSEGATKLIFDKETHRVIGAGIVGTNAGELLAEAVLAIEMGADAHDLGLTIHAHPTLSETICFAAEIKEGTITDMLPPKKR

SEQ ID NO: 41392 - protein, 475 aa, Bordetella petrii
MYEQLALYIDGEFLTGDGRRTQDVINPATLEVLGQLPHATEADLDRALAAAQRAFESWKHSSPMERSAILRKVASLSREHAKEIGRNMTLDQGKPLAESVGEITACAEHADWHAEECRRIYGRVIPPRNPDVRQFVVREPIGVCAAFTPWNFPYNQAIRKIAAALGAGCTVILKGPEDSPSAVMAIARMFHEAGLPKGCLNIVWGEPGKISDYLIRSPIVRKVSFTGSVPVGKQLAALAGAHMKRVTMELGGHSPVLVFDDADVNRAAEMLAKFKIRNAGQVCVSPTRFYVQEGAYEQFLARFTEVLKGIKVGDGLEEGTQMGPLAHERRVPTMTKFVEDAKKHGGKIALGGEPLDRKGFFFSPTVVTDLPDNSMLMTEEPFGPVAPVVRFKDTDEVLRRANSLPFGLSSYVFTNSLQTATKVSNGLEAGMVNINHFGSALAETPFGGIKDSGIGSEGGLETFDGYLVTKFITHV

SEQ ID NO: 41393 - protein, 472 aa, Escherichia coli CFT073
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASINNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRKVN

SEQ ID NO: 41394 - protein, 368 aa, Methanosarcina acetivorans C2A
MKAVLGLEDGTVIRGTGFGAEGTACGELVFTTQFTGYEEALTDPSYKGQILMFTYPLIGNYGVSGERFQSDNIHAEGLVVREACKKPYHYKSTRSIHQFLEDEGKPGIEGVDTRMLTIGARERGTMRAALITGSDDGEEAVKVARNFPQITDEELIARVTCKEPHFIPGAECAWKGSGKPKHAVVVDLGIKRNIINNLHKRGIDLTLVPATTKPKEIAGFEPDLLFISNGPGDPEKATDAINAVKAFAGTIPVAGICFGHQIISLAMGARTYKLKFGHRGGNQPVKDLIENKIFISSQNHGYAVDADSLEGTGLYVKYLNANDKTVEGVSHKDLDIFSVQFHPEAQAGPMDTEETFFGKVVKVLGGDL

SEQ ID NO: 41395 - protein, 657 aa, Aspergillus oryzae
MTLNFARESSDRPALRLPNPPPLLHTRSGNETLDRPSTPSQNGFTSPIQTPQGSPSKNRFPPGALDLPNVFDKAMKLNPTSPNKGTYDHYSHPMFSPKKSVEDFSESVIRQPPGSPTRKANKENTPPSPTRVGKDLGPNPAAAAISRHQTYQPRDVESIQRRQVQMRGLTPEEMEKLQNPRVKRLVNVTQLYFLDHYFDLLSYVHNRQTRYSQFRNAYPEPPATPMDDYEPALLKYLGRERAHLRKRRTRLRQHDFQILTQVGQGGYGQVYLAQKKDTREVCALKVMSKKLLFKLDEIRHILTERDILTAAKSEWLVKLLYAFQDEDQIYLAMEYVPGGDFRTLLNNTGVLHNRHARFYISEMFSCIDALHALGYIHRDLKPENFLIDSTGHVKLTDFGLAAGMLNPGKIESMRVKLEEVGNTPVPFGRPMEQRTMAERRQGYRTLRERQVNYAKSIVGSPDYMAPEVLKGEQYDFTVDYWSLGCMLFEALAGYPPFAGATVDETWQNLKNWQKVLRKPVYEDPNYFLSRRTWDLITKLVASKEKRFKNIHEIHAHDYFAEVDFNRLREQRAPFVPELDSETDAGYFDDFTSEADMAKYKEVHDKQRALEEMAERDEKMGKGLFVGFTFRHRKPAMDGGRSSPRKPIATDGSFGTMF

SEQ ID NO: 41396 - protein, 169 aa, Trichodesmium erythraeum IMS101
MELISIPSLLKKNNQTEFIRFEEFILDLETLSPVRGYLQVTHCGNYLEVKGKSETIITLTCDRCLKQYNYKLVINPKELIWLNKVTTQKELFHIEAENSVEHLVETLPPEGNFNPKKWVYEQVCLEVPSRKLCKNNCQGIKLSGTNTSSSVLDSRWAALEAVKKQLNNS

SEQ ID NO: 41397 - protein, 364 aa, Pseudomonas putida KT2440
MSAVTRAAVEGVLRQYTDPYLNQDPVSAGCVRAIDIQGGQVSVQLQLGYAAGLFKNGWAQVLQAAIGSLEGVTGAQVSIDCVVAAHKAQAQVPSMANVKNIIAVASGKGGVGKSTTAANLALALAREGARVGILDADIYGPSQGVMFGIAEGTRPQIREQKWFVPIKAHGVEVMSMAFLTDDNTPMVWRGPMVSGALLQLVTQTAWDDLDYLVIDMPPGTGDIQLTLAQKVPVVGSVIVTTPQDLALLDAKKGVEMFRKVNIPVLGVVENMAVHICSNCGHAEHLFGEGGGEKLASQYGVDLLASLPLSMLIREQADSGKPTAIAEPESQIAMVYQELARQVGARIVLQEAAAPAMPSITISED

SEQ ID NO: 41398 - protein, 498 aa, Lactobacillus sakei subsp. sakei 23K
MRSDLAALFIIFGGSGDLAQRKLYPALFNLYRKGYLKESFAVIGTARRPWTDEHYHEIVMASLEGFEEDDETKQTFTSHLYYQSHDVTDAEHYETLKALAAKLDDKYQLNQNRIYYMAMSPRYFGTIASHLGSEALLTADGFNRLIIEKPFGRDYESAKALNQELTQTFDENQIYRIDHYLGKEMIQNIVALRFGNGLLSGVWNNQFIDNVQITLAESVGVEERAGYYETSGALRDMLQNHIMQVIGMLAMEVPVNFSAEDVQREKTRLFRSIQPYSPAEIKQNFVRAQYAETTVDGENKPGYRQETNVAPDSQTETFVAGKVMIDNERWCGVPFYVRTGKRLARKETQINIVFKKTGVNIFADDKSDRSAMAPDVLTIYVEPEQGFSLTINGKEVGQGFSLKPDQLNYQYDKQMLADSPEAYERLILEALNGDGTNFTHWHELAASWQFVDAIRQVWDADQTPLPTYSIGSMGPKEATDLLASTDAKWIFDPTQTKK

SEQ ID NO: 41399 - protein, 357 aa, Oryza sativa Japonica Group
MAGARSVGSLPVPNVQALAEICNDPDEHIPERYIRPEASSEEVINNYQGDMAIPIIDLKKLLCPQSSEEECVKLRSACQYWGFFLLINHGVPDEVIANLKRDIVDFFSQPLDTKKEYTQLPNSLEGYGQSFVFSEDQKLDWADMLYLHVHPSDSRDLRFWPTSPASFRQSIDAYSSETKSLALCLFEFMAKAVGAKPESLLDLFEEQPRGLRMAYYPPCRQADKVMGLSPHSDAGGLTLLLEINNVQGLQIKKDGKWFSIDAPNGALIANIGDTLEILSNGKFRSVEHRAVINPNKERISAALFHYPSENMVISPLPEFVKDGKVKYRSISYLDFMKQIFTQQLDGKNRVEVLKLDQ

SEQ ID NO: 41400 - protein, 293 aa, Haemophilus somnus 2336
MWKSISQVLAEQFGAYYFIKHKEKLYSGEMNEIWLINDEVQTVFVKINERSYRSMFRAEADQLALLAKTNSINVPLVYGIGNSQGHSFLLLEALNKSKNKQSSFTIFAEKIAQLHQIQGPDKYGLDFDTWLGPIYQPNDWQTSWAKFFSENRIGWQLQVCKEKGLIFGNIDLIVQIVADTLSKHNPKPSILHGNLWIENCIQVDDKIFVCNPACYWGDRECDIAFSSLFEPFPTNFYQRYNEIYPLEEGYLERKLIYQLYYLLNFSYRYYNKKQSYVSLTQKLINQILHKSDK

SEQ ID NO: 41401 - protein, 137 aa, Escherichia coli O157:H7 EDL933
MANKPSAEELKKNLSEMQFYVTQNHGTEPPFTGRLLHNKRDGVYHCLICDAPLFHSQTKYDSGCGWPSFYEPVSEESIRYIKDLSHGMQRIEIRCGNCDAHLGHVFPDGPQPTGERYCVNSASLRFTDGENGEEING

SEQ ID NO: 41402 - protein, 90 aa, Triticum aestivum
  misc_feature (27)..(27): Xaa can be any naturally occurring amino acid
  misc_feature (37)..(37): Xaa can be any naturally occurring amino acid
  misc_feature (45)..(45): Xaa can be any naturally occurring amino acid
MALRGVHTVAPFQGLKCTAGMPVARRXGNSSFGNVSXGGRIRCMXVWPIEGIKKFETLYYLTPITVEDLLKQIENLLRSRGCLLEGPVPP

SEQ ID NO: 41403 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGNSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 41404 - protein, 331 aa, Escherichia coli O157:H7 EDL933
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 41405 - protein, 159 aa, Schizosaccharomyces pombe
MFSGIKGPNPSDLKGPELRILIVHARYNLQAIEPLVKGAVETMIEKHDVKLENIDIESVPGSWELPQGIRASIARNTYDAVIGIGVLIKGSTMHFEYISEAVVHGLMRVGLDSGVPVILGLLTVLNEEQALYRAGLNGGHNHGNDWGSAAVEMGLKALY

SEQ ID NO: 41406 - protein, 327 aa, Nostoc punctiforme PCC 73102
MTSQVNQRDLEIDSSPLLAVLQELHSQYKLLQEGAVAKYIPELAKVNPDLFSICIVTVDGQIYKVGNYDQLFTIQSISKVFAYGLALEDHGLDYVLTRVGVEPTGDAFNAIVLDEQSKRPYNPMVNAGAIATTSLIKGSGPTERLNRMLDMYKRYIGRDVFVDISVFTSERSTGHRNRAMAHLMLNFGMIDRNIEESLDLYFQQCAVIVNCEDLAVMAATLANKGMNPITKEQAVDKRYIKDILSVMYTCGMYNFAGEWAYKIGIPAKSGVCGGIIAVVPNKMGIGVFSPLLDVRGNSVRGVKVCEELSQRLGLHLFDCSGQEAKFD

SEQ ID NO: 41407 - protein, 272 aa, Magnetospirillum magnetotacticum MS-1
MVSGGGTLFEELGFYYVGPIDGHNFEHLLPVLKNVRDSEETRPVLLHVVTKKGRGYPPAEAAADKYHGVGRFDVLTGQLEKPKANAPSYTSVFAKALIAEAEVDDRVVAITAAMPGGTGLDKFGDRFPARTFDVGIAEQHAVTFAGGLATEGFKPFCAIYSSFLQRAYDQVQHDVVLQKLPVRFAIDRAGLVGADGATHAGSYDMAFLGCLPDIVIMCPSDEAELMHAVATAVAIDDRPSAFRYPRGEGVGVELPERGTVMPIGKGRVCAKR

SEQ ID NO: 41408 - protein, 377 aa, Oryza sativa Indica Group
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGTPIKDALAAGKEISALEGVLEHGLFLDMATFGDHALEQMASVSKTNVCLLSKDYLRVASCRLARFVGQETARQPAFPRLARNVFGCVLLLVTLFTSKFVKQRM

SEQ ID NO: 41409 - protein, 261 aa, Agrobacterium tumefaciens str. C58
MSERLESAVAIIEEAMGLALRFFEARDAIATRTKGFQDFVSEADTTVEKLVRDRLAAAFPGETVLGEEMGGVADDAYWIIDPIDGTANFLRGSPLWGISLGFVRNGRPELGVVAMPIFKDIYAAADGTGLMLNGKPLARHVPFEDVQVMSLGDSAAADAEEVAALSVGLRHAGWVVESIRSTSIGLAFAARGIFDGHLQKLTTMWDIAGGVVLAREAGLDVRIGTRSGSGIPWVAAGTSALMTVTEGLWPEVVEKAPAEPA

SEQ ID NO: 41410 - protein, 214 aa, Staphylococcus epidermidis RP62A
MVKILPSLLSIDFLNLKEELQLLEAAKVDGLHFDVMDGKFVPNISIGIPILDAVRQQSHLPIDVHLMIEQPENYINLFAEHGADMISVHVEATTHIHRAIEQIKQLGKKAGVVINPGTSVETILPILSIVDYVLVMTVNPGFGGQTFIEQCVTKIEQLNQLKHENHLTFDIEVDGGINDQTSKRCVEQGATMLVTGSYFFKQEDYAKVTSLLKE

SEQ ID NO: 41411 - protein, 267 aa, Prochlorococcus marinus str. NATL2A
MTTPFRNVTPNGPGGTTTLLLVLSFTGFLLLTQAFFVVPAGQVSVVTTLGKVSGGSRKPGLNFKVPFVQNTYPFNVQTQVRPEKFDSLTKDLQVISATATVKYALKPNEAGRVFKTISYNDREIYNRIIQPSLLKALKSVFSKYELVTIASSWSDISELVEDTVAEELNKFDYVDVQSLDLTGLTIADEYRAAIEQKQIAEQQLLRAQTEVKIAEQEALRYDTLNKSLDDQVLFKLFLDKWNGETQVVPSLPGNGSGNVPVIVRGKN

SEQ ID NO: 41412 - protein, 355 aa, Zea mays
MVSAVLRTILVTGGAGYIGSHTVLQLLQQGFRVVVVDNLDNASEAALARVAELAGHDGANLVFHKVDLRDRHALVDIFSSHRFEAVIHFAGLKAVGESVHKPLLYYDNNLVGTITLLEVMAANGCKKLVFSSSATVYGWPKEVPCTEEFPLCATNPYGRTKLVIEDICRDVHRSDPDWKIILLRYFNPVGAHPSGYIGEDPCGVPNNLMPYVQQVAVGRLPHLTVYGTDYSTKDGTGVRDYIHVVDLADGHIAALRKLHEDSDKIGCEVYNLGTGKGTSVLEMVAAFEKASGKKIPLVFAGRRPGDAEIVYAATAKAEKELKWKAKYGIEEMCRDLWNWASKNPYGYAGSRDNSK

SEQ ID NO: 41413 - protein, 202 aa, Arabidopsis lyrata subsp. petraea
VSKWTLCVTSPPVRNSAGLNPHCPPARVNLRTELAAFRPQFRLFSRDSSSRRRLRASSSAESGIFLPHLVASMEEVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREI

SEQ ID NO: 41414 - protein, 479 aa, Synechococcus elongatus PCC 6301
MSSEFDYDVIVIGAGYGGFDAAKHACEKGLKTAIVEARDLGGTCVNRGCVPSKALLAASGRVREITDTDHLQNFGIQVQGVSFDRQAIADHAANLVDTVRTNLGNTLERLGAEILMGRGRLAGSQRVTVTAADGTEKTYSARDVILATGSDPFVPPGIEIDGKTVFTSDDALKLETLPQWIAIIGSGYIGLEFSDVYTALGCEVTMIEALDRLLPTFDPDVAKVAQRSLLDGRDIETRTGVLARKITPGSPVVIELADFETKELVEVLEVDACLVATGRIPSTKNLGLETVAVEVDRRGFIPVDDGMRVLRDSKPVPHLFAVGDATGKLMLAHAAAAQGVVAIENITGHPRSVDYRSIPAATFTHPEISSVGLSEADAKALGGQEGFEVGSVRSYFKANSKALAEADADGFAKVLFRKDTGEVLGAHIFGLHAADLIQEVANAIARRQSVKELAFEVHTHPTLSEVIESAYKQAATAIA

SEQ ID NO: 41415 - protein, 301 aa, Triticum aestivum
GVLILSGDHLYRMDYMDFVQSHRQRDAGISICCLPIDGSRASDFGLMKIDDTGRVISFSEKPRGADLKEMEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDMERGDQLAEGKVPIGIGENTSIQNCIIDKNARIGKNVTIANAEGVQEADRASEGFHIRSGITVVLKNSVIADGLVI

SEQ ID NO: 41416 - protein, 412 aa, Salmonella typhimurium LT2
MADFRPERRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEQYAAMGSLEFAKKLLNEAKVCVSPGIGFGDYGDTHVRFALIENRDRIRQAVRGIKAMFRADGVLPSHPKPVEASTE

SEQ ID NO: 41417 - protein, 239 aa, Oryza sativa Indica Group
MAGRGGGGGGGELQLLGTWYSPYAMRAKIALGLKGLSYEYIEQDLFGKSELLLKSNPVHKKVPVLIHAGRPVCESRVVLEYVDEAWPGAAPPLLPADPHGRAAARFWATYFDSTFFPPWRALMRATTAEQRAEAFMNAVPQVEVLERAFVECSKGKAFFGGDAVGLVDVVVGGFVVWFKVVDEVAGSSLLDEAKFPGLAAWAERFLAVDAVREAMPDAGKLLEHYKGFLAKLASPAGST

SEQ ID NO: 41418 - protein, 237 aa, Oryza sativa Indica Group
MAGRGGGGELRLLGTWSSPWVIRVRVALGMKGLSYEYTEEDLSSKSDLLLRSNPVHEKVPVLIHGGRPVCESLVVLEYIDETWGATGTPQLLPADPYDRATARFWTNYVNDTFFPSWKVLFRSTAAEQRAEAFKNVVPRVEALERAFGECSKGKAFFGGDDAGLVDVALGSHLVWIKVVDEVAGANLLDEAKFPGLAAWAERFLAVDAVRQVMPDAGDVLKQYKGFLAKWTAGAGSS

SEQ ID NO: 41419 - protein, 165 aa, Trichodesmium erythraeum IMS101
MNVRIGNGYDIHKLGPERPLILGGIKIDHEMGLIGHSDADVLTHAIMDAMLGALSLGDIGHYFPPSDPQWAGADSIDLLKRVNDLVRGVCWRISNIDSVVVAERPKLKPHIEKMRSRLATTLELEADQVSIKATTNEKLGPVGREEGIAAYAVVLLQKYTEIRKA

SEQ ID NO: 41420 - protein, 338 aa, Vibrio vulnificus CMCP6
MSGMRTLGEFIVEKQADFPHASGDLSSLLSSIRLAAKIVNREINKAGLVDITGAAGVENIQGEVQQKLDVYANEKFKSALEARDQVCGVASEEEDEAVAFNKELNKNAKYVVLMDPLDGSSNIDVNVSVGTIFSIYRRVSPIGTPPTQEDFLQPGHKQVAAGYIIYGSSTMLVYTTGNGVNGFTYDPSLGTFCLSHENMMIPQNGNIYSINEGNYIRFPMGVKKYIKYCQENVPEDGRPYTSRYIGSLVADFHRNLLKGGIYLYPSTQSHPQGKLRLLYECNPMAFLIEQAGGLASDGVNRILDLKPTELHQRVPFFVGSTNMVKKVEEFLEVYRDEA

SEQ ID NO: 41421 - protein, 176 aa, Vibrio vulnificus CMCP6
MSLNNVPAGKSLPDDLYVVIEIPANADPIKYEVDKESGAVFVDRFMSAPMFYPCNYGYVNHTLSLDGDPVDVLVPTPYPLMPGSVIRCRPVGVLKMTDESGEDAKVVAVPHSKLSKEYDHIQDVNDLPELLKAQITHFFERYKELESGKWVKVDGWEDVEAARKEILDSYQRAQNK

SEQ ID NO: 41422 - protein, 364 aa, Ustilago maydis 521
MASSNPQTVPCAYKTGRTLGQGTYAVVKEAVHIKTGQYYACKVISKKLMEGREHMVRNEIQALKRVSQGHRSIVTLVDYFETMNNLYLVTDLCVGGELFDRICERGNYYEKDAAHIVRTIVDAVVYLHDQGIVHRDLKPENLLFRDKTEESDLLIADFGLSRVVDDEKITVLSTTCGTPGYMAPEIFKKTGHGKPVDMWAIGVITYFLLCGYTPFDRDTTMEEMQAIINADYRFEPTQYWEDVSEDAKDFINKLLTIDPAKRLSAKEALQHRWLQEAAPTEGGAQPVASAEQKDLLPDIKSAFNAKRTFRKAVNGIRLINRLRTNEQQPNKEEIEKLRQTIREAEDESSNLDQVLLAQETRAAN

SEQ ID NO: 41423 - protein, 157 aa, Pseudomonas aeruginosa PAO1
MRIGHGYDVHRFGEGDFITLGGVRIPHKHGLVAHSDGDVLLHALSDALLGAAALGDIGKHFPDTDPRFKGADSRALLRHVVAIVAEKGWKVGNVDATIVAQAPKMAPHIETMRGLIAEDLGVAVDQVNVKATTTERLGFTGREEGIAVHAVALLMAR

SEQ ID NO: 41424 - protein, 335 aa, Moritella sp. PE36
MTQTRITVIPGDGIGPDIIESAIQILDKAGCNFAYDFADAGLAALQTSGELLPKATLDLIEKNKVALKGPLTTPVGAGFTSINVSLRKHFNLYANLRPVISFKGTRSRYENIDIITVRENTEGMYSGAGQIIADDGSSAEAKSIITRAGAERICVAAYELAKAENRKKVTAIHKANILKTTSGLFLEVAREVAKRYPEIESEEMIVDAACMNLVMYPERFDVIVTTNLFGDILSDLCAGLVGGLGMAPGANIGEDTAIFEAVHGSAPDIAGKNLANPTSVILASIQMLEYLDMKTEAENIRNAVRDVIESGDRTTRDLGGTHGTTDFTQAILERL

SEQ ID NO: 41425 - protein, 370 aa, Pseudomonas aeruginosa PAO1
MIKSRAAVAFAPNKPLEIVEVDVAPPQKGEVLVRIVATGVCHTDAYTLSGQDSEGVFPCILGHEGGGIVEAVGEGVTSLQVGDHVIPLYTAECGKCKFCLSGKTNLCQAVRATQGKGLMPDGTSRFSYKGEPVFHYMGCSTFSEYTVLPEISLAKIPKDAPLEKVCLLGCGVTTGIGAVLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 41426 - protein, 183 aa, Pseudomonas putida KT2440
MTEQAHADLQAFAMKDPAAGRDLVFIAKTYTSYSAVLHYRLAHWIYNNSAATYGAGGQCLAAMISRRGKMLSGAEIHFRSRIGARFIIDHGMGTVIGETSTIGDDCYVLGGVTLGARGISDNPSSPRHPTLGNRVQIGAFASVLGAIHVGDGAFIGPGCIVTKDVPAAARVQVKTSLQVVLES

SEQ ID NO: 41427 - protein, 444 aa, Kluyveromyces lactis NRRL Y-1140
MMQMQQRVALGDVTSQINNRANRFSVDGDSKKAFVDAGFLKEKRVKNAKENDLFSGHDDDLVVARAQKLREQTLVSSVSTESIRSQQLSSNSNETVQHHLIEVEADDEDDAETDSEALAFKEDEEAETGGDISEEMEDVDESFTPLVPVVTEHSERLYQYVYERLHREEPDPNDEDTWDPVMVSEYTIEIFEHLKFLERKFSPNPRYIEHQPELTWKYRSTLIDWIVQVHDRFQLLPETLFLTVNIIDRFLSKKQVTLNRLQLVGAAALFIASKYEEINCPTLKDMLYMLDNAYTREEILRAERFMINTLNFEFGWPGPMSFLRRVSKADDYEYDTRTVAKYLLETSIMEPEIIAAPPSWLAAGAYYLSKIIIGLTGWSDEHIYYSGYTEEQLIPLATMILDSCRHATERHKAIFDKYSRSRHRKSAFVVAKWISMAESRLEQK

SEQ ID NO: 41428 - protein, 1164 aa, Methanosarcina mazei Go1
MKINKKTAIFFGIFFVLFLMTVGNAAAVMEEGTETQITIHTSSLEQPSNTVPFAYITNQDSNNVSVIDTATNTVTATVPVGHSPEGVAVSPDGTKVYVTSRLFSYVPGGWGDDGIEIETLVETGIVSVIDTATNNVTASVNVGVGPQGVAVSPDGTKVYVTNEGSDTGAISTVSVIDTATNTVAATVNVGIRPRGIAVTPDGTKVYVMNYGSNEISIIDTANDTVTATVSTENPWGIAISPDGTKVYVTNNGENISVIDIATNTVTDTVPVGGLLDGVAVSPDGTKVYVTNGWYKGDDGPSYALDIGTVSVIDTATNAVTATVDVGNLPRGVVVSPDGTKVYVTNFGSGNVSIIDTATNTVTASVNVGSMPIGVAVTPTLEPEINTTPETNTTQITTDTSNQLNPDVYGDRIVWQDDRNGGNAEYWSPAGNWDIYMYDVSTSTEFQITTGESCQINPAIYGNKIVWQDDRGGKSDIYMYDLSTQQEIQISTSGTAFYPAIYGDRIVWKDTRDEKSDIYMYNISTSQKTQISTKGIASGGQLSGPDIYKDKIVWQELEEFADFTNLVLYNLSTQQETQITTSGYGGVSITGFYSFAIHDDKIVMCSPAGDDASYIMVYDLSTQETANIGSGKPLSPDIYGDRIAYEEVSWEGDYVDDPYQYYYNIYVYDLTTEKGIQVSNSGTAYNPAINSDKIVWEDRRNGNADIYMFTFSSSEVPPLDDNETDEGNGTDNETEVPDNDSDNGDDTGSDNGTEDSDSCPELTPLNGMQALNKYLECKYKCHEKTRAGLASPLEKSMCFYEKGEDEKAICMLKSFIHLAEKMKVCKQISVDEADYMIREAEKIIDLIKAELDETDNEKKVSDNDSDAKTGNMNKEACEKSKPVCKPECEETKQVCEKPKPVCKPECEETKPECEETKPVCKPACEKPEKICEEPKKVCKPACEENKEVKKTVCEETKPVCDGSKPVFDKLKPVCKPVCNYIEKVSEDAGEVSEDKEVSSNTEEEVSEPVKKEEIAVEEVSEPEKAISEPVEKEEVNLNTEKVSEDRQVNEGVEEASEDKEVSSNTKEEEVSEPEKAVSEPKKAISESVEKEEVSLNTEKVSEDKEVSEDKEVSEDKEVSEDKEVSEDKEVSEDKEVSEDKEVSEDKEVSEDKEVSKDNIDQIMIN

SEQ ID NO: 41429 - protein, 1680 aa, Aspergillus nidulans FGSC A4
MNSAGLSSGSMEGLTGSDWPVRTCCYPWLFLASSASSSALMFLIKHPLPPDVSSCLCLAIAYSSRALDSLYRAVRTPEITRQIVSNLLIATAHSRSHPRFLILTLHRAARFYFFAPKLWEFFLRDDVESFQRFLASASYTSGGQRAPAGGGTHLNAGSPGPMISSLGASPKGKKSTGTSPVTSVFERGGGPRSTKPISRDELNARDQHGRTLLHHVASSPKPTAADFALALLEVPYLDIYAQDLESGWTALHRALYAGNATIAQALMARDVRDATDPSKPGFSGHPSGGLIKIKDREGYSPFDVYASTITSRSLGPLVPDHGLDDASSVSSSDDEDVAEALEKPSTNLFGDEVFTFGSNKNLNLGVGDQDDRQYPERITLTRPTHLLHRFFREHQERHDDVKTASSPDPSDQDLPAFIKARPLKIQTLAMSKLHTAILTDDPESNLFICGFGPGGRLGTGDESTRFSFVCIEGGGLANKKVASVALGQDHTLAITEHGDIFSWGSNKFGQLGYGLPRANNKDDVPVQLSPRQIFNPFKKEVILGAAASAVHSVVYSTSGLYTFGKNEGQLGLVDSDARSLEVQTTPRRVGASLFSTPIQSVSATDQATAILLQNHEVWVFAHYGYSRLSFPLEINSRFIRDSFMATRYDTSINRIVKIRSGGNTICALSSSGDVFTVQVNKLENLPSLTSTTNPAKIRNSLSPPVRVWSVKKAHMAVKDVDVGQDGSIIICTASGSAWRKERRRKSKNGSSGEYKFARVPCLSRVVGVCSNAFGAFAVVQRECDVTKEQINVNPTSLWGDIWPLSPFSAIRATTKQKDYFADEEVRDLESVTALRQVLMNGPNPELYFRPTFAGLPAGTVWVMTTASDMRVPVHEFILTGRSSVLRRALHDYRHQHSASVPEILTIEKDYNGDCQILLQGMDVLSVLNLTFYLYTDALLDVWQHARSSPENASRYRQVRTEVMRIASHLDLPALERAAALMVRPAKSMKTDFSTAFNDPSFFESCDVVIELNGDCMVAHSQVIRQRCPFFYALFVGRSGGIWVQSRRKSPQDKVHVDLKHIDRSIFEFVLRYMYADTDDRLFDDVRTKNTQDFVDIITDVAFVADELMIDRLSQICQRALGKFDNVCHDNQMAAFPISRGRNAMEYIYEKYPELVSFIEADKRRLIDSIRLKSRVSKIDSPEGKPRAPSEKLAPSPAASRFKTGVDKDRPVYDSPLLKSKHSTGDLMFQMDDEPLSSLDLGKGKAIDRGVKPANENDTRPWNETPVLGASLQDGASSVGRSYLDTRMASPQGTSPARLQPTTPQEKQNGSASPPYPSQVPWNSTTISGSKKTLKDIMSEASEARVSNLSLGMSSVRRENSGSFAPKLSQKERKKMQQQQIQEMAIAQQRAKEAAQSPWKIPSPGPAVPVGPSTDKITNGQDIPSPTPSKSAQRPGMTLRQTVAGAPSPKRESAAKPTPSSSRSHVVSATTTRPPLAPRPADAVAPSTPPTDQVTIKSVRHIPRPEPYQTSFYADTPGSMSLATILMQQQTEKDEIREAATARHNLQDIQAEQAFQEWWDKESRRIQGIPEPGAEDEDTQKKAERDGRGGRRGRGSKGPGGQSQRTRRGKGPQAQTQGQSQGASSPAQQSQASRNGSEAGAPDRGQHQQLSTPTPKKPHTQTHSAHSGNPSRRGRGGYRAK

SEQ ID NO: 41430 - protein, 184 aa, Cryptococcus neoformans var. neoformans B-3501A
MFGAAAVPGSRQGCFKCGNLGHIAENCQAPGRLCYNCREPGHESTNCPQPRSTDGKQCYACGGVGHVKSDCPSMRGAFGPGQKCFKCGRPGHLARECTVPGFVGAFRGRGGFGGAFGGRPRPPINPDGTPVKCYRCNGENHLARDCLAPRDEAAILASKKCYKCQETGHIARDCTQENVSPPAE

SEQ ID NO: 41431 - protein, 543 aa, Coprinopsis cinerea okayama7#130
MHRARAVLSLRPAAVKRAALVQARQLHRHSECQAQRNGHHGTSVIQPSSTSRAMSTTSERHEHITDLGELYEFGLRHVTHGLGRITTGIMTKGDGSYVEYADGRRLLDFTCGIGVTNLGHAHPRISGAAADQCMKLVHSQCSISLHEPYLRLIERLLPVMPHPSLDSFFFWNSGSEAVEAAIKMARTLTGRQNIICMQGAYHGRTMGAMAVTKSKTIYSQGVHPVMPGVYSIPYPYWHQVGVPVETPTHDLATLALTQLDLVLAQQSAPSDTAAIIIEPVLGEGGYVPAPVEFLQGLREVCDKHGILLIIDEVQSGFGRTGTYFAIEESGVRPDILVMAKGLGNGFPISGVVSRKELTDKLKPGSMGGTYAGNAVACAAAVAVQDVIQEECVLENVQARSRELFSVLRGLLYDPSIRPHILDIRGRGLMVGVEFASPTGIGVGAQFAVDNFPTTSTVNTLTLGPSPYILHDSEKKGENGGAETHPRAMASRVAKKCIEKGMLILTTSVFEVIRFIPPLNISKEDLAKGCQIFAEAVKEVVEEG

SEQ ID NO: 41432 - protein, 550 aa, Salmonella typhimurium LT2
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVLQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 41433 - protein, 892 aa, Arabidopsis thaliana
MIRSRSVLLIFRKVLYQSSCLKCLLCANSFSTSVSSSLGFRATNKELNQMIRSGYIAEARDIFEKLEARNTVTWNTMISGYVKRREMNQARKLFDVMPKRDVVTWNTMISGGYAKNRRIGEALLLFEKMPERNAVSWSAMITGFCQNGEVDSAVVLFRKMPVKDSSPLCALVAGLIKNERLSEAAWVLGQYGSLVSGREDLVYAYNTLIVGYGQRGQVEAARCLFDQIPDLCGDDHGGEFRERFCKNVVSWNSMIKAYLKVGDVVSARLLFDQMKDRDTISWNTMIDGYVHVSRMEDAFALFSEMPNRDAHSWNMMVSGYASVGNVELARHYFEKTPEKHTVSWNSIIAAYEKNKDYKEAVDLFIRMNIEGEKPDPHTLTSLLSASTGLVNLRLGMQMHQIVVKTVIPDVPVHNALITMYSRCGEIMESRRIFDEMKLKREVITWNAMIGGYAFHGNASEALNLFGSMKSNGIYPSHITFVSVLNACAHAGLVDEAKAQFVSMMSVYKIEPQMEHYSSLVNVTSGQGQFEEAMYIITSMPFEPDKTVWGALLDACRIYNNVGLAHVAAEAMSRLEPESSTPYVLLYNMYADMGLWDEASQVRMNMETIQNIGGFKFTSYTCSLCFIQFFAAIKTHKKFAYELLTLNFSKRFKTSPFGPLISCSVSPRSIVPCSNVECYHSSFSTKYQIQPRRRWMFCNSRNNSISSDDEYRSSPNIAISLLRRYRTVIGRGEGETLKEFISAGVNAYALGCTDEDLRKELMAMKDSGLEIERMENYGGSTQTKSKITLSEVDECILWLRIVFITILCTPQPTVIRWSSTPSVSDEILSKWRGFCAVIANAYYIRGMAWLPVKTLQLEQMAVTGQSEEPSVVASRMRLVFSTLEVVSPQWPRV

SEQ ID NO: 41434 - protein, 193 aa, Zea mays
PTTPGSGGGYYGPPSPSSDTSPTTPGGGGYYGPPSPSSDTSPTTPDVPLPPISTSPPFSPLTPTPTTPTPYDPNTPPFTGPCTYWIMHPGMVWGLFGFWCPLVRLFGPSAAVPFGHDLTVPEALANTRQDGVGALFREGTASLLNSMVNSGFPFTTQEVKDAFGAALSSGDDGAAAAQAQLFKKANEGHVKRN

SEQ ID NO: 41435 - protein, 413 aa, Salmonella typhimurium LT2
MTDNRVENSSGRAARKLRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELFFSQPDMAQLGKGMVIPALPNPEAVFLAAGVLGATIMPHVIYLHSSLTQHLHGGTRQQRYSATKWDVAIAMTIAGFVNLAMMATAAAAFHFSGHTGIADLDQAYLTLEPLLSHAAATVFGLSLVAAGLSSTVVGTLAGQVVMQGFVRFHIPLWVRRTITMLPSFIVILMGLDPTRILVMSQVLLSFGIALALVPLLIFTSNATLMGELVNTRRVKQVGWIIVVLVVALNIWLLVGTVMGLS

SEQ ID NO: 41436 - protein, 195 aa, Prochlorococcus marinus str. NATL2A
MANLDQAPSRTMPNLLHILPAFANESELRVNTIVELNSNTINKYELITETGHLKLDRVGYSSLAYPFAYGCLPRTWDEDGDPLDIEIVNVTEPLVPGSIVEARIIGIMTFDDGGEVDDKVIGVIADDKRMDHIQSFEQLGKHWINETTYYWEHYKDLKKPGTCTVNGFFGVEKAVQIIKSCEERYLSAIDPNLIN

SEQ ID NO: 41437 - protein, 489 aa, Glycine max
MSQNPRLRSLQTEANCTIDKENAFISSNLSQDKKFSISQKFRKVNEILLKPTAKQYGQEAYHSQTMNPQAGNVQNKYNLEQDFESKMNISRVKKTLSFERNSMNVQRASDLLAAQKERQNYMEKENRLSIIEQRERYSFGEKQIINESKKGLTLNAARAPYAEKEPIRLNPILEPVAREDKYHEEVIPEITEREIEKIPAPTVDINEQCNNSLKDYISDIIRTLKIKDKESTPIYSLKKHKIPVNLRSKMVDWMIEVLSSYKCSDQTFFIAVNLMDLFLEKTNVQHEVSDLHLTGVTCMFMASKYEEIYPLRLSVIHEKIAHRKIHPDQIKKKEMEIFMTLGYKMTNSTPYEFIMNVLYQLNVKETMAPRLYNYLRKVCVYLAKANMHDYELLSQQDYSELAASTLFVAFKIIEQLDKSFPLFEMLNKVRQILKVEEDIVYDCASRILSIAKNFDKLYPNLENLKKFHSFNFEDLPESKDSKVCQKTIF

SEQ ID NO: 41438 - protein, 383 aa, Dehalococcoides ethenogenes 195
MDELIYLDNAASTPVDPRVVTAMLPYFTWHYGNPSAIHPMGRRADEALETAREQVAALINCQPEEVIFTSGGTESDNLAISGAAMAGRGRHIITSEIEHHAVLLACHALEKKGFEVTYLPVDSFGQVSPKDVEAAITPQTALVSIMAANNVIGTLQPVAEIGAVCRRQGVIFHTDAVQMAGHLPLDVKRDNIDLLSLSAHKFNGPKGVGILYAKGDVPLAPLILGGGQESGLRSGTENVPGIAGLGLAAGIAALEMQEEAGRVSSLRKKLAEAILGSIPGSRLNGHPQKRLPGNLNISFEGVEGEYLSKELAKQGICVSTGSACSSASHEAPYVLLATGLERDLANCSIRLSLGKMTTPEHIQKTADTLSAVVSQIRRQTPVW

SEQ ID NO: 41439 - protein, 267 aa, Myxococcus xanthus DK 1622
MADGVFRDGLLAGKVAFISGGSSGINLGIAESFVKAGAKVAINGRNVEKLEAAVKGLQAHGTAMGVAADVRDYAAVEKALQTVREAYGELDVVVCGAAGNFPAPALGMSSNGFKAVMDIDVLGTFNISRAAFEHLRKPGASLINISAPQAYLPMAMQAHVCAAKAGVDMLTRVLAIEWGGSGVRVNAITPGPIDDTEGMRRLAPSDEGRDKLAQALPLQRFGKKQDIAQLALFLASEGSSYITGSIMVCDGGQSLLGGGALMAALGM

SEQ ID NO: 41440 - protein, 122 aa, Brassica napus
MASKLVQVQSKACEASKFVAKHGTSYYRQLLEKNKHYIQEPATVEKCQELSKQLLYTRLASIPKRYETFWKEVDYAKNLWKNRSDLKVEDAGIAALFGLECFAWYCAGEIAGRGFTFTGYYP

SEQ ID NO: 41441 - protein, 304 aa, Prochlorococcus marinus str. NATL2A
MNKEIQQAKHSKNINKPFTDKDSIRVSVLSEALPYIQRFANKRIVIKYGGSAMADKTLQNAVFRDLALLSSVGVQIVVVHGGGPEINQWLEKLGIKPVFLDGLRITDTETMDVVEMVLTGRVNKQIVSGINNHGRLAVGLCGIDGGLIEARTLGGGSHGLVGEVAKVNTKILSPLLEEGYVPVISSVANSSDGKSHNINADTVAGELAAALGAEKLILLTDTPGILRNENDPSSLIEKIRLSEARELIDKGIVKAGMKPKVECCIRSLAQGVNAAHIIDGRTPHSLLLEVFTDAGIGTMVMGRG

SEQ ID NO: 41442 - protein, 209 aa, Myxococcus xanthus DK 1622
MTTEFILLRHGETEWNSLGRLQGHQDSTLSQVGLRQADALAARLEPVRFSALYCSDLGRAQETARRIAIRTGHTVQSDTRLRERGLGILEGLTRDEARQKHPDVFAAYAGGAPDYIVPGGESTSQRLRHAVECLEELGARHRGERLVVVTHGGVLSLLFRHSLGIPHAAPRTFSVLNAGWNQFDYHEGAWRLVTWGDVTHLRASSLDDT

SEQ ID NO: 41443 - protein, 530 aa, Oryza sativa Indica Group
MATATASSLSLLFAHPHSSNPRPFAGGPHLRRPLRAAPHRARCASDAATTATRHRRPAEENIREEAARLRGPGNDFSAWYVPFPPTPEDDPDERYSLDEVVYRSSSGGLLDVCHDMEALARFPGSYWRDLFDSRVGRTAWPYGSGVWSKKEFVLPEIDSDHIVSLFEGNSNLFWAERLGREHLGGMTDLWVKHCGISHTGSFKDLGMTVLVSQVNRLRRAPLSRPINGVGCASTGDTSAALSAYCAAAGIPAIVFLPADRISLQQLIQPIANGATVLSLDTDFDGCMRLIREVTAELPIYLANSLNSLRLEGQKTAAIEILQQFDWQVPDWVIVPGGNLGNIYAFYKGFEMCRVLGLVDRVPRLVCAQAANANPLYRFYKSGWTDFQPRVAETTFASAIQIGDPVSVDRAVVALKATDGIVEEATEEELMDAMSLADRTGMFACPHTGVALAALFKLRDQRIIGPNDRTVVVSTAHGLKFTQSKIDYHDRNIKDMLCQYANPPINVKADFASVMDVLQNKLNVDELGVSQ

SEQ ID NO: 41444 - protein, 429 aa, Pseudomonas aeruginosa PAO1
MAKIVDIKGREVLDSRGNPTVEADVILDNGIVGSACAPSGASTGSREALELRDGDKSRYLGKGVLKAVANINGPIRDLLLGKDAADQKALDHAMIELDGTENKAKLGANAILAVSLAAAKAAAQAKGVPLYAHIADLNGTPGQYSMPVPMMNIINGGEHADNNVDIQEFMVQPVGAKNFAEALRMGAEIFHHLKAVLKARGLNTAVGDEGGFAPNLSSNEDALAAIAEAVEKAGYKLGDDVTLALDCASSEFFKDGKYDLEGEGKVFDAAGFADYLAGLTQRYPIISIEDGMDESDWAGWKGLTDKIGAKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAPYRGRAEFRG

SEQ ID NO: 41445 - protein, 663 aa, Dehalococcoides ethenogenes 195
MLNIQNLSKSFGVRSLYTGVNLNIGARDRLALLGPNGSGKTTLFEMIAGRLEADEGKIILRRGTTVGYLEQDIKPSSKQPLLKAVSSASDRLSSLSHKISLLQGELAEEKDGSENNRLMNELGELQHSFEALGGYNAEQEAKLILAGLGFKPVDFDRPLHEFSGGWLMRAELAKLLFLSPDILILDEPTNHLDLESTRWFESYLKQYSGSVLFTSHDRAFLNSIATKILSLEDQKARLYSGNYDSYLRERELRLNQLESQARRQQELIDKETKFIERFRYKATKASQVQSRIKKLDKLSAVAIPRQTKKIHFNFPEPERSGHDVIKLRNLTKSYGDLVIYQGLELVLARGDKAALVGPNGAGKTTLLKILAGVMPFDSGYRNLGANVNTAYFAQYYVESLSPANNLIEELETILPDAPEQQLRGMLGAFLFSGDDVKKRISVLSGGEKTRLAIAKMLLKPANLVLMDEPTNHLDIPAREILADALQAYKGTLCFITHDRTLIREVANKIIEVRNGKIRVFEGDYDAYLEFAAANPFKGEAPKNPAPVISHRPSPVPAALSQKQRKTLEGQIRNQHYKETGALKKEISDTEAEITSLEQRKQELETLLADPDLYRSGQKAADTSAEYKNCKEQLVTLGDKWLRLCQQNDALKQKLEDALKALDN

SEQ ID NO: 41446 - protein, 303 aa, Actinoplanes sp. SE50/110
MRGILLAGGTGSRLRPVTWAVSKQLMPVYDKPMIYYPLATLVSCGIREILVITTETEAAQFQRLLGDGSQWGLRLEFAVQQRPGGIAEAFLIGEEFLAGGPVALMLGDNLLHGVDFRPCVQRARETAGGHVFGVAVADPSAYGVVEFDAAGRVLSIEEKPVRPRSPYAVPGFYLYDADVVETARSLRPSARGELEITEVNQAYLRRGALSVTLLGRGAVWLDTGTLADCMRAVDYVRAIDEGQGIKIGCVEEAAWRAGFLDTAQLRALAEPLMSSGYGQYLLALTGDGLSRTPQWPALTAAAG

SEQ ID NO: 41447 - protein, 417 aa, Moritella sp. PE36
MTLLALGINHNSAPVSLREKVAFSPDNIEDAFASIVANGVASEAVIVSTCNRTEIYCKIEQGLPERVTQWLVDFHRLPANELADCTYRYYDGDAVRHLMRVAGGLDSLVLGEPQILGQIKQAFAKAKQLNAVAQTLDKLFQKTFTAAKRVRTETEIGANAVSVAFAAVSLSKHIFDDLSKTRVLLIGAGETIDLVATHLAEQNVSEMMVANRTLSRAQVLGDKFGARTMTLEEIPHHLHNADIVISSTASPLPIIGKGMIESALKQRKQKPIFLVDIAVPRDIEEEVGELGNAYLYTVDDLQGIIEQNKEARQDAAEQAEHIITEETQLFSEWIASLSSVDSIKEYRNSAMIEKDILLERAIAAMKNGSDGERVLTELANKLTNKLIHAPTQALVSAGKRSQDDELLLVRRVVGLES

SEQ ID NO: 41448 - protein, 158 aa, Vibrio parahaemolyticus RIMD 2210633
MIRIGHGFDVHKFGGEGPVIIGGVAIPYEQGLIAHSDGDVALHALTDALLGAIAAGDIGRHFPDTDDKWKGANSRELLKDVYRRVKEQGYRLGNADVTIMAQAPKMAPHIDAMCAAIAEDLETDISNINVKATTTERLGFTGRKEGIATEAVVLLFKQ

SEQ ID NO: 41449 - protein, 255 aa, Zea mays
MAKLMNKLVDSFEHDEILDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLSGGMVTPVHALGRGISPMQGLVMEVILTFSLLFVTYAMILDPRSQVRAIGPLLTGLIVGANSLAGGNFTGASMNPARSFGPALATGDWTNHWVYWIGPLLGGPLAGFVYESLFLVQKMHEPLLNGEV

SEQ ID NO: 41450 - protein, 311 aa, Moritella sp. PE36
MKLFAGNATPELAQKVAERLFIQLGKAKVGRFSDGEISVEIEENVRGGDIFILQSTCAPTNDNLMELIVMVDAMRRASAGRITAVIPYFGYARQDRRVRSSRVPITAKVVADFLSSVGVDRVLTVDLHAEQIQGFFDVPVDNVFGTPVLLADMQKMNLENPVIVSPDIGGVVRARANAKLLDEADLAIIDKRRPKANVAQVMHIIGDVKDRDCILVDDMIDTGGTLCAAAIALKKNGAKRVFAYATHPVFSGNAAQNLRDSCIDEIVVTDSIPLSPEVAALANVRVLSLSPMLAEAIRRVNNEESISAMFN

SEQ ID NO: 41451 - protein, 445 aa, Triticum aestivum
  misc_feature (196)..(196): Xaa can be any naturally occurring amino acid
  misc_feature (257)..(257): Xaa can be any naturally occurring amino acid
  misc_feature (267)..(267): Xaa can be any naturally occurring amino acid
MDAAISAAHEAPPAVVLVSAGASHSVALLAGNVLCTWGRGEDGQLGHGDAEDRLVPTVISGFDAPGITSVICGADHTTAYSEDEHQVYSWGWGDFGRLGHGNSTDVFTPQPVKALQGIKIKQLACGDSHCLAVTMAGEVLSWGRNQNGQLGLGTTEDSLLPQTIQAFVGISVKMIAAGAEHTAAVTEDGEIYGWGXWGRYGNLGLGDRNDRFVPEKVSSVEGEKMVLVACGWRHTITVSSSGSLYTYGWSKYGQLGXMGDFEDHLVXPHKVEALKDSSTSQISGGWRHTMALTSDGKLYGWGWNKFGQVGAGDNADHCSPAQVNFPEEQKVAQVACGWRHTLAFTEKKNVFAWGRGTSGQLGHGEIVDRNTPVMIDALSPDGPGCKKLESSAAIPFAAKIWVSPSERYALVPDEKVAKPGDVSARGNGADASVPENDVKRMRVSS

SEQ ID NO: 41452 - protein, 433 aa, Vibrio parahaemolyticus RIMD 2210633
MSKIVKVLGREIIDSRGNPTVEAEVHLEGGFVGMAAAPSGASTGSREALELRDGDKARFLGKGVLKAIEAVNGPIAEALVGKDAKDQAAIDAVMIELDGTENKSKFGANAILAVSLANAKAAAAAKGMPLYEHIAELNGTAGQFSMPLPMMNIINGGEHADNNVDIQEFMIQPVGAATLKEAVRMGAEVFHNLAKVLKSKGYNTAVGDEGGFAPNLKSNAEALEVIAEAVAAAGYELGKDVTLAMDCAASEFFDKEAGIYNMKGEGKTFTSEEFNHYLAGLVEQFPIVSIEDGLDESDWDGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 41453 - protein, 156 aa, Nicotiana sylvestris
MAEVEYRCFVGGLAWATTDQTLGEAFSQFGEILDSKIINDRETGRSRGFGFVTFKDEKAMRDAIEGMNGQDLDGRNITVNEAQSRGSGGGGGGGGYRGGSGGGYGGGGRREGGYGGGGGYGGGRREGGYGGGGGGGYGGGRREGGYGGGSEGNWRS

SEQ ID NO: 41454 - protein, 191 aa, Vitis vinifera
MFAEEDGLRGDPRLQAISEALRIVPHFPKPGIMFQDITTLLLDHKAFKGTVEIFVDRYRDMDISVVAGVEARGFLFGPSVALAIGAKFVPLRKPKKLPGEVISEDYELEYGTDRLEMHVGAVHPGERALVIDDFVATGGTLSAAIRLLKRVGAEVVECACVVGLPEVEGQSRLNGTPLYILVGPQLRERPC

SEQ ID NO: 41455 - protein, 363 aa, Moritella sp. PE36
MGFKCGIVGLPNVGKSTLFNALTQAGIEAANFPFCTIEPNTGVVPVPDKRLDALSAIVNPERVLPTTMEFVDIAGLVAGASKGEGLGNKFLANIRETDAIGHVVRCFENENIIHVNNKISPLDDIEIINTELALADLDSCEKVVVRLAKKAKGGDKDAKFELPVIEKILAHLAEGEMVRSLELTKDEKAAIDYMNFLTLKPTMYIANVDEEGFENNPHLDQVRELAATENAVVVAICASMESDIAELEDDERAEFMEDMGIEEPGLNRVIRAGYELLTLQTYFTAGVKEVRAWTIPVNATAPQAAGKIHTDFEKGFIRAEVVGYDSFIEYNGEAGAKTAGQWRLEGKDYIVKDGDVVHFRFNV

SEQ ID NO: 41456 - protein, 265 aa, Yarrowia lipolytica CLIB122
MSLKLPQSFSLGGPDQLVLVTEEPTYYVLKLNSPPDNRLTPELLTAWIEAMEALALYAEEPKPLVITSAMPKYFSNGLDLEATANVDNFTRDFYYPLIKTLLNFPWPTIGFLNGHTFAGAFVVAGFFDFRVMNPDRGYLCMNEIEFDAPIMGGGMVVFTKLYGRAVAQRITMLAERFPAQKALEAGIIHAKGMWPEVEQMVKKVSHVSGKKFYSLIRKEVMKDIIEALQDSDHQLFLDALMGDHIDPKIEEEQRKRLDPKIKALL

SEQ ID NO: 41457 - protein, 75 aa, Zea mays
SHASDDTKDCKGLFKNLKFYLSREVPRESLLFIIPAFGGTVSWEGEGAPFKEIDEDITHQVDSIRNNLLHQSLTI

SEQ ID NO: 41458 - protein, 485 aa, Zea mays
MGQRQSHSKRDGSSHGRRSRSFQQQPSAQWGAGGGGYYQQDPSTGYYGAPVPQQGGGYYQQDPGTGYYGAPVPQQGGGYAAPYRDKPAAAAAVAAPAPQAAKPRQLDRRYSRIADEYHSVDQVTDALAQAGLESSNLIVGIDFTKSNEWTGKFSFHGRSLHHISNTPNPYEQAISIIGRTLSKFDEDNLIPCFGFGDASTHDQDVFCFSPDEKPCNGFEEALDRYRELVPHLRLAGPTSFAPIIEMAMTIVEQSGGQYHVLLIIADGQVTRSVDTASGQLSSQEQKTVDAIVKASELPLSIVLVGVGDGPWDMMKEFDDNIPARAFDNFQFVNFSEIMSKNMAQSRKEAAFALSALMEIPPQYKATVELGILGRRSFKSPDRVPLPPPSGSHGAYSYYSSKGFSKPSTYPQSSSSSSPYPHYETPHTATPAAPSATYDNQVCPICLVNPKDMAFGCGHQTCCDCGQILESCPICRTPITTRIKLY

SEQ ID NO: 41459 - protein, 456 aa, Xanthomonas axonopodis pv. citri str. 306
MSARYDYDVVILGGGSGGLAAGFRAAKHGARVAIMEPDELGGTCVNLGCVPKKAMWLAADLAGKIELASALGFDVPRPTLVWQELVTHRQGYIANIHASYRRRLNEDGVVLIPQRGVLQDRHTVMGSDGVPVTAGHIVIATGAHALRPDVEGAEHGEVSDDFFNLCHAPEQVAIIGGGYIAVEIAGLLQALGSRVHLFVQGERLLERFDAELTLQLADNLRHLGVRLHFGFTTTALERDMHGALRVHGHSVHPREQGNDVFDKVFFAVGRRANTAGLGLDTVGVALGDKGEVVVDDRQTTNVPNIHAIGDVGGKVGLTPVAIAAGRKLMDRLFGHQPDARMDYENVPSVVFSHPPLGNVGLTEEQARARYNGAVRVYRSNFRPMLHALADAPQRSLFKLVCVGEEERVVGVHLLGESADEMLQGFAVAVKMGATKRDFDETVAIHPTSSEEIVLMH

SEQ ID NO: 41460 - protein, 691 aa, Oryza sativa Japonica Group
MAVSWPGMVQWWEEWQLRVLALSSLFLQCFLFVSATFRRYRIPALFRTCIWLAYLGSDALAIYGLATLFNRHRKPAPGAVAAAGGTSNGHGRSSMLEVLWAPVFLIHLGGQDTITAYNIEDNELWARHAVAMSSQAAVSVYVFCRSWSGGKVPVRCPVALFVAGFLKMGHRLWALRRASITWHATVSSDRRSRRKTTAEEEGGDMSLENYIRQAREQAATRNIDDAVNINDDGEARRAARRRSREQRAQLLAPNILEELMELFIDFPAPYARRIGYLTSFMALENYDAYYNLCNLLDLAFQFFYTKKNTNYTIVGIFLWVLFFLLGITAVAGFDGLDSNKDGLDRDDVKVTYILLCSAIVMEFSSLVWLNDWNWVPLWMLAPEMHRTIVQFNLIGFAARSRWPTMVMWIATLLGCKNYVNQHWYLEHRSSTAKIIGFIRKDLTSGWVSLRSVADHRRFNDRRGHWTLRREQCYGELGWSVTELPFDEAVLVWHIATAICLHCTDVPTAAEDADGASAAARSMEISNYMMYLLLFQPDMLMPGTQQSLFTVACREIRRALRNQRQQEKLSERELARWLLFSVDEPTTAAAEQGGGGGGGEGRHLANARRLAGAMMELDADRRLRVIGGVWVEMICYSASRCRGFLHSKSMGVGGEFLTVVWLLLHRMGMEGLADKLQRPELTTGDVQDAVVV

SEQ ID NO: 41461 - protein, 163 aa, Triticum aestivum
  misc_feature (29)..(29): Xaa can be any naturally occurring amino acid
  misc_feature (114)..(114): Xaa can be any naturally occurring amino acid
LGFNRSKNIIGTGCKKDGGIDFRQYSIKXQPFGITRKIGNSWQNNQVPDLRDLKDVSDYVTKAGYGSESEPDDEAATVSLASDIDKLNRASRKSAVRLQEVGPRMTMRLVKVEXGLCSGDILYPQSVGKEDVKEGQEEEEIEDAEDMMELVDGTEEDDTGDEE

SEQ ID NO: 41462 - protein, 234 aa, Triticum aestivum
  misc_feature (151)..(151): Xaa can be any naturally occurring amino acid
  misc_feature (163)..(163): Xaa can be any naturally occurring amino acid
MASSADPWVREYGEAARLADDVASMVADRAALPQSGPEVMRHTSAIRRKITILGTRLDSLEGMLARLPPKSITDKELNKRRDTLSNLKSRAKQMAESFNMSTFANREDLLGQSKKAADDMSRVAGLDNQGIVGLQRQIMKEQDEGLEKLEXTVAEQQNILALXAIEGTLTRHARLIDDLDDHVDGTNSRLQRVQKRLAVLNKRAKGGCSCMSLLLSTVGIVMLVVIVWLLIKYL

SEQ ID NO: 41463 - protein, 202 aa, Aspergillus oryzae
MADPRVEEIVEEETPKQTVEDAGSDSESEAGEANIPAGAAVTIHSRNEKKARKAIGKLGLKHVPGITRVTLRRPKNILFVINQPDVYRSPSSNTWIIFGEAKIEDLNSQAQASAAQQLAAAEAAAGEHAGHDHEHDLGTKVPEAETKKEEEEDDGEPVDESGLEAKDIELVMAQANVSRKKAVKALRENDNDIVNSIMALSI

SEQ ID NO: 41464 - protein, 481 aa, Vibrio angustum S14
MTERLRRTKIVTTLGPATDRDNNLEKIIAAGANVVRMNFSHGSPEDHIQRTKQVREIAAKLGKNVAILGDLQGPKIRVSTFKEDKIQLAIGDKFTLDSDLPKGEGDQFAVGLDYKELPKDVATGDVLLLDDGRVQLKVTSVEGNKVHTEVTVAGPLSNNKGINKKGGGLSAEALTDKDKADILTAAAMGVDYLAVSFPRNGEDMKYARRLATEAGLNAKLVAKVERAEAVATTEAMDDIILASDVVMVARGDLGVEIGDPELVGVQKKLIRRARSLNRTVITATQMMESMITSPMPTRAEVMDVANAVLDGTDAVMLSAETAAGQFPEETVKAMASVCLGAEKEPSINVSNHRLDRFFSSPEETIAMSTMYAANHMEGVKAMVAMTESGRTPLMMSRISSGLPIFALSRNENTLNQASLFRGVTPVFFNRDSDAGLEAAKHALDVLRDAGFVNVGDLVIITQGDVMDTVGSTNNMRILTVE

SEQ ID NO: 41465 - protein, 361 aa, Methylobacillus flagellatus KT
MISPTIEIIEEMRQGRMVILVDEEDRENEGDLVLAAQFTTAEHINFMAKHGRGLICLTLTEERCKQLNLPAMVQKNGSGMGTNFTVSIEAATGVTTGISASDRARTIQAAVAPNAKPTDIVSPGHIFPVAAQNGGVLVRAGHTEAGCDLAALAGLTPASVICEILKEDGSMARLPDLIEFAKQHNLKIGTIADLIQYRNEHECLVKRAAERDVITPYGPMRLIAYADMIAKETHLALVKGEITPDKEVLVRVHEPLSVFDLIDESSRSHSWNTLQAMRKIQEAEAGIVILLHNGEGAEDLVERIKFADEPVRIRQDLRNYGIGSQILLDLGVRKMKLLAAPRKMPSIVGFGLEITGYVEAP

SEQ ID NO: 41466 - protein, 496 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPIGIGRNTKIRNCIIDMNARIGKNVVITNSKGIQEADHPEEGVI

SEQ ID NO: 41467 - protein, 537 aa, Coprinopsis cinerea okayama7#130
MKGVPNGFYDGEFKDVKKGDDSSVIDEPKGTPAEVDVKSSDGSFKFEQGDDSTDPNRRQIGLVSAIFIIFNRIIGTGVFATPSTILGLSGSVGLALFMWVIGAIIAAAGMHVYIVWGSAIPRNGGEKNYLEYLFRKPKYLITSMFAANGVLLAWAAGNSLVFGEYILRAANADPTRWKLRAVGFACLTFAFLIHGTALKWGLRLQNFLGIFKVLVLIFVIITGFVALGGHMKVPKPNNFSNAFEGTTASASSFCLSLYNVIWSYIGFSNVNYALSEVRNPQRTIRIAGPLAIGFITILYILANIAYFAAATKEEITGSGRLVAALLFENVYGEKATRALSVFVALSALGNVLSVVFSQGRVNQELGREGILPFSKFWGSNRPFNAPLVGLGLHWVVCLIVIFALPPGDAYNFVLNVISYPLSVINAAISFGIVYLHFRPYHDWPGVPIWGLITSAFFGAANVFLFIVPLTRPPPGAEPYESLPYWTHAVAGWAVFGLGLVYWIIWARILPKVLGYKLVRVEEVGKDGLVRHVFQWRR

SEQ ID NO: 41468 - protein, 103 aa, Triticum aestivum
MDSGGGATAIRVPYRHIRDAEMELVRLNSTNSTGGDAERPKEEQGSGAEAGEGGRKGAPKWRVVLACMVAAGVQFGWALQLSLLTPYIQTLGIDHAMASFIWL

SEQ ID NO: 41469 - protein, 659 aa, Oryza sativa
MDFTNLLITVLLLLSPLKYESDVATASDDEDFFKTCSSQRCSKHGPEIRYPFRLSTQPPSCGAPGMQLSCSGQDTILDHPVLGSCKVTMIYYRHVIMNAIPLVDSLPHCPLQKLVSVNQSTAVYKPHTSEVASVVGCSRDSIDTNQYGIVGPTSCPSLANNASQFWYLAYPYTYMSILPLGCTIVSKDIPMPYSYDKNGPNFDISIFTETAKRVISTGETVFTWYTSNVTSICQQCEREGRRCGFSSQRESSILPASYVNRVETRTYPSYTTLVRKLCTCIFPAMLCKIIESGPRVTIIAATSSVGTFIVLSLIVATALYISLKSRYNEEIHLKVEMFLKTYGTSKPTRYTFSEVKKIARRFKDKLGHGAFGTVYKGELPNGVPVAVKMLENSVGEGQEFINEVATIGRIHHANIVRLLGFCSEGTRRALIYELMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTDPPAENQNEFYFPEWVFERVMNGQDLVLTMETTQGEKEMVRQLAIVALALWCIQWNPKDRPSMTKVVNMLTGRLQNLQVPPKPFISSQNQLVI

SEQ ID NO: 41470 - protein, 386 aa, Escherichia coli CFT073
MTNNPLIPQSKLPQLGTTIFTRMSALAQQHQAINLSQGFPDFDGPRYLQERLAYHVAQGANQYAPMTGVQALREAIAQKTERLYGYQPDVDSNITVTAGATEALYAAITALVRNGDEVICFDPSYDSYAPAIALSGGIVKRIALQPPHFRVDWQEFAALLSERTRLVILNTPHNPSATVWQQTDFAALWQAIAGHEIFVISDEVYEHINFSQQGHASVLAHPQLRERAVAVSSFGKTYHMTGWKVGYCVAPAPISAEIRKVHQYLTFSVNTPAQLALADMLRAEPEHYLALPDFYRQKRDILVNALNESRLEILPCEGTYFLLVDYSAVSTLDDVEFCQWLTREHGVAAIPLSVFCADPFPHKLIRLCFAKKESTLLAAAERLRQL

SEQ ID NO: 41471 - protein, 269 aa, Aspergillus oryzae
MPLDTSTTYPLTKLRLDGRRWNELRLLQAQISTNPASSGSSYLAMGNTTIMCSVHGPAEGRRGDATGGAAGSSGAVVEVDVNVAGFAGVDRKRRAGGSDKQSSRIATTLRAAFQSHLHTYLYPHSTISIHVSVLSADGSLLAAAINACTLALVDAGIPMPGLLCGCTAGMSGSASTPRDPRNDELDPLLDLSLPEEQELPFLTVGTTTSVPVGENAMDDDEEDMKVSMLNMDSKVHCTYVETMLAVGIDGCNQIREILEGVIKGSNKLR

SEQ ID NO: 41472 - protein, 144 aa, Prochlorococcus marinus str. NATL2A
MISAFHRLSIRLVRAALAICLGFCLMLFQFASEVNAAKTLMTGDFAKDTIAVSSTLKETITLPKEDKGLSEAEKEAVFLISDYISRYRNRSQVNTSTTFTTMQTALNALSGHYKTFANRPVPENLKERLNKELSKAEKLAARDS

SEQ ID NO: 41473 - protein, 457 aa, Lactobacillus acidophilus NCFM
MAKKAPELKRSMTAGQMEMISLGGAIGVGLFMGASSTIKWTGPSVLLAYIFVGVILYIVMRALGEMLYIDPGTGSFADYASEHVHPIAGYLAEWANVFQYIVVGISEVVATTEYLRFWWKGTSDWIAGIIIILFLLIANLASAKAYATLEFWFAMIKVVTITLMILLGLAVILFGFGNGGHPVGFSNLWSHGGFFTGGIKGFFFSMAIIVGSYEGIELIGISAGEVSDPHKAIIKSVKSVLWRILIFYVGAIFVIVTIYPWNKLDSIGSPFVTTFAKVGITAAASVINFVVLTAALSGANSGIYSSSRMLYKLAHEGEAPKTFGYISKRIVPSHAIIGITSGILIGFMLNVLAQFLNKSLANIFVIVYSSSVLPGMVAWFVILLAELRFRRKNPDLMEDHPFKLPLYPYSNYFALIMLVVIVIFMFINPETQISVSVGALVLIVAAIVYVIKHRKEN

SEQ ID NO: 41474 - protein, 334 aa, Bordetella petrii
MPEARLPAIAVLATGGTIAGAQAESASHAYRAGALQVGQLLDAVPGLARLARIQAEQVASIGSQNMSHAVWASLARRIEALCDDPAVDGIVVTHGTDTLEETAYFLSLVIRHDKPLVLTGAMRPATAPGADGPANVFHAVALAGCADARGRGPLVVMNEDIHYAREVQKTACAGINAFASPNRGRAGVMRGAQTNFFSRNDTVHSKASAFSLGALETAGWPRVDVVHAGVDLGADLIDFLAERARGIVLAGVGDGNATDAALQALQRAAAGGVAVVRASRTGSGRVGRNVEVDDDAAGFIAAGELSPQKARILLMLGLSLTRDPASLQDFFDRY

SEQ ID NO: 41475 - protein, 449 aa, Lactobacillus acidophilus NCFM
MNENTKLKRGLKSRHVTMIAIGGAIGTGLFLGSGSAIHSAGPSIILSYLIVGIITFFMMRALGELILADPDSHSFLESIKKYLGKRAEFVAGWTYWACWLSLAMADLTATGIYLRYWFPWLPQWVGPLVIVVLLMLINMVNVGLFGELESWFSMIKVIAIIALIVVGAVMIIFHTPVKGGTVSLTNLVSYGGFFPTGVWGFLLSFQMVVFAFVGVEIVGQTASETANPHQDIPKAINTLPVRIGLFYVGSMMAIMSVYPWNQIKTTSSPFVQVFTGIGVTAAAGILNFVVLTAALSATNSAIFSTSRSLYSLARNGHAPKKLGNLTKKAIPMNALITSSLILFVVVILNYVMPAEIFAVVSTVSTICFVIVWIMIMFTHIVYRRHNKNNLGEFRMPGYPLTSWLTIVFYIAILILLFFIESTKLALIISIVFVLILTVSYNFVSKNTNN

SEQ ID NO: 41476 - protein, 504 aa, Kluyveromyces lactis NRRL Y-1140
MITRTQNGSMLLNRINHEPSNDSAEGSCNSLFKPKTLKRKNLKHLTLESSCSSSSSSPDEIPKGFSNGNGPTLSLMLEKLPVREEISPISRDTSFQTVSFLQGSSSTSDISSIVSGTTPTTRDAPMSLTPTGVSMMQQETDETATLTTQIARLSLTPENGIQLENLVRLSKIGAGNSGTVVKTLHVPDSRIIAKKTIPVENKEVLKNQLVRELTIMKNVSAHDNIVGFYGAFYNPSTTNEIVILMEYMDCGSLDKILSVYRSDCHRKNVSISCKTSWFNEMPLSRISFCVLNGLIYLYDCYKIIHRDIKPSNILINSKGDVKICDFGVSTTLINSLADTFVGTSTYMSPERIQGGRYTTKGDVWSLGLMIIELSSGEFPLGGHHDTPEGILDLLQRIVNEPAPKLSKNEHYSIEMTDFVNRCCIKEERGRSSLKELICHDFICKYNNRDTIAKEFRHWCKKVKKRIKEDKMIRREETERSKIEKRQLEKAALAVTAARSSSTRR

SEQ ID NO: 41477 - protein, 160 aa, Synechococcus elongatus PCC 6301
MSRFRIGNGYDIHRLVEGRPLILGGIQLEHSLGLDGHSDADVLTHAIMDALLGALSLGDIGHYFPPTDPQWKGADSLKLLAQVNQLIRDRGWTIGNLDSVVVAEQPKLKPHIAAMRDRLAKVLELEPDQIGIKATTNEKLGPTGREEGICAYAVALLVRD

SEQ ID NO: 41478 - protein, 357 aa, Triticum aestivum
  misc_feature (114)..(114): Xaa can be any naturally occurring amino acid
  misc_feature (205)..(205): Xaa can be any naturally occurring amino acid
  misc_feature (218)..(218): Xaa can be any naturally occurring amino acid
  misc_feature (224)..(224): Xaa can be any naturally occurring amino acid
  misc_feature (295)..(295): Xaa can be any naturally occurring amino acid
MERMVMRLVRNKQSLRQLQGAAAGGLASSSSASSTAGAAASSFSTLQQQQEDHPGVLNIRDTAAHLIGRTPLVYLNKVTEGCGARVAAKLEFLQPSFSVKDRPAISMIEDAEKXGLITPGKTTLIEPTSGNMGIGLAFMAALKGYELVLTMPSYTSLERRVVMKAFGAQLVLTDPAKGMGGTVRKATQLYENHPSAFMLQQFENXPANVQVHYETTGXPEIWEXDTLGQVDIFVMGIGSGGTVTGVGKYLKEKNPNAKIYGVEPAEANVLNGGKPGPHLITGNGVGFKPDILDHXVRLVGISSGANTVAAIELAKRPENKGKLIVTVHPSAGERYLSSALFEGLRKEAEAMQPVPVD

SEQ ID NO: 41479 - protein, 154 aa, Staphylococcus aureus subsp. aureus N315
MNFEGKLIGKDLKVAIVVSRFNDFITGRLLEGAKDTLIRHDVNEDNIDVAFVPGAFEIPLVAKKLASSGNYDAIITLGCVIRGATSHYDYVCNEVAKGVSKVNDQTNVPVIFGILTTESIEQAVERAGTKAGNKGAEAAVSAIEMANLLKSIKA

SEQ ID NO: 41480 - protein, 429 aa, Silene latifolia
  misc_feature (277)..(277): Xaa can be any naturally occurring amino acid
  misc_feature (418)..(418): Xaa can be any naturally occurring amino acid
RWGPLIEEATYKNRQRLYLSEQQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDXRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVAACXPTPTKDVNHSA

SEQ ID NO: 41481 - protein, 191 aa, Zea mays
  misc_feature (171)..(171): Xaa can be any naturally occurring amino acid
  misc_feature (179)..(179): Xaa can be any naturally occurring amino acid
MQYQPIQNYCRCFLTVKKKKKKKKKKKKKKKKKAAKSNLEAPLSLSLSLFAVRSSAPQSNRHLAEMGRKFFVGGNWKCNGTTDQVEKIVKTLNEGQVPPSNVVEVVVSPPYVFLPVVKSQLRQEFHVAAQNCWVKKGGAFTGEVSAEMLVNLGVPWVILGHSERRALLGEXNEFVGDKXAYALSQGLKVIA

SEQ ID NO: 41482 - protein, 532 aa, Yarrowia lipolytica CLIB122
MGKRDRTEDDEVVTKKVKLDKKDKKEKKEKKDKKDKKDKKDKKDKKDKKEKKEKKEKKEKKEEVSDEEEVAEEKPKMTYTASANTIKSSGEYTQCDDLTNVSQSTIDNYFKEHTITIEGEQMRPTMEFSHVTLDPRITKVLTKFPRPTPIQAVSWPYLLAGKDMVGVAETGSGKTFTFAVPALEHVLSTSGGKGVRVLVVSPTRELAMQIYDNIKELCDVVGLHAVCVYGGVPKEQQRSDLKRASFVIATPGRLCDLIDEGSCDLSKVSYLVLDEADRMLEKGFEEDIKKIIGSTRPTGRQTVMFSATWPPEVRKLAEGFMKTPTKVMIGERDELAANKRITQSVEVLDPRAKEGRLLDLLRQYANDDFKILIFALYKKEATRVENTLTRRGYGVAAIHGDLSQQQRTKALDEFKKGEKNILLATDVAARGLDIPNVKLVINLTFPLTVEDYVHRIGRTGRAGKTGQAITLFTEHEKHLSGALINVLRGADQPVPDELLKFGGHTKKKEHGAYGAFFKDVDMTKKAKKITFD

SEQ ID NO: 41483 - protein, 147 aa, Brassica napus
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEAAMENPKGPSRCSTCRKRVGLTGFNCRCGNLYCATHRYSDKHECKFDYR

SEQ ID NO: 41484 - protein, 217 aa, Desulfitobacterium hafniense DCB-2
MVKLIFTRHGETLWNIEGRVQGAMDSPLTEKGILQARKVGQRLRKEGITRIYSSDLPRARATADEIRKAVGIEEILLDPALRELSFGEWEGKNWWDLRQLHPELFSLWDTGPHQVQIPGAESMWEVSERAWQFVQELPRLHDGETLCVVTHGMTLQLIVKKALGIPVEQWNDVPWQHNTAVNIFEFYEDGRIYPILLADHTHLDDDIKPTSGFTSKK

SEQ ID NO: 41485 - protein, 376 aa, Coccidioides immitis RS
MAVEILEDPQFEIPKTCKAGVVHNEGPEFVLKVEDVSVPEPGPDEVLIKLNITGLCYSDIHFMLGDLGGPTMAGNNVRSPGHEGAGVVVKVGSNVKGWRVGDRAGVKPMWDTCGACELCWGDKETYCPKSISTGLQVSGTYQQYITSPARYTTPIPDGVPDEIAAPIMCSASTVLRSLEESKLRPGDWAVFPGGGGGVGIQGVQLAQAMGIRAIAIDTGDAKRALCLEMGAEHFVDFRESKDVAKEVVELCDGIGAHAVFVTAPQAYRDAISFTGRRVGSKVMCIGLRGWVEFCSRTASASEYVFGAHPAQFVFKNMSVVGTLVGSMRDTARALDFAKRGLLKPIYEKWPIARMPEAVEKLRRGQVAGRYVVDFNA

SEQ ID NO: 41486 - protein, 458 aa, Glycine max
MVRENAVMGGASEERGVRVTRAMARAVLGGVSASSRPSFKKQHKNNKGFGRVALADVTNISKKGCATSKSQARGGYKKTNTKGASNVSIQVLSTQEDVRAKLAKDLPSISMVQSHDANVAERQEGTEVVQPSMSVMAGPLLSMQDSMKSDEILRSPNKDVDMMITEKLKLSDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKVSYVELEFLANYLAELTLVEYSFLQFLPSLIAASAVLLARWTLNQSEHPWNSTMEHYTNYKVSELKTTVLALADLQHDMKGCSLNSIREKYKQQKFRSVANLSPKPVQSLFKAQV

SEQ ID NO: 41487 - protein, 307 aa, Bacillus cereus G9241
MEIKNSITELIGKTPVVKLNHIVKGNVADIYLKLEFMNPGSSVKDRIALAMIEDAEKKGVLKKGDTIIEATSGNTGISLAMIAAAKNYKSILVMPDTMSVERRNLLSAYGAKLILTPGHEGMSGAIQKANELAKINGYFIPQQFKNQTNPEIHRLTTGPEIVEQMGNQLDVFIAGVGTGGTITGAGSFLKEVYKDIKICAVEPADSPVLSGGKPKKHQLQGIGAGFVPETLDVRVYDEVIQVRADQAFEYARKVACKEGILLGISAGAAIYASVKIAKKIGRGKKILTIIPSNGERYLSTMLYRFEQ

SEQ ID NO: 41488 - protein, 446 aa, Methanosarcina mazei Go1
MLSPIAWSTPPKKYGPWEAMVSLLTEGLVKRGIDVTLFATADSHTSGKLHAVCPRPYEEDKNIHVKVYECLHISEVFERADEFDIIHNHFDYLPLTYSRLVDTPVVTTVHGISSRRILPVYKKYNNSTFYVSISDAYRCDELEYIATVHHGIDTGSFPFNESPEDYLLYISRIHRDKGTKEAIEVAKRTGMRLKIAGFIADPEYFENEVAPHIDSEQIIYEGHVSHQHKKDLLSHARALLHMINYEEAFGLGVVEALTCGTPVIAINKGAMPELIIDGETGFLVNGVEEAVDAVQKLGSISRKKCRESVEIRFSVERMVEDYIKVYETILEKYRREEKRPWGFYEILTEKPGYKVKRITVLPQEEISLQRHAHRQEHWYIVSGEGLVTKNTDQIRVFSGDSVDLGVKEIHRVKNTGGQNLVFIEIAQGDYLGEDDIERFEDKYGRA

SEQ ID NO: 41489 - protein, 266 aa, Yarrowia lipolytica CLIB122
MSLLQTFPLPNKGETQTDEQKLMSLYDKGDFYCLEFHSPPDNRLTCTFIDAFVEALNWLLLKKSGAPKPLVTTSAIPKFYSNGLDLEAAIRTPQFFQRYLGRMQRALIEFPWPTIAYVNGHAFAGGFILANSHDFKVQNSKKGWLCMNEIEFDAPLIGQLMSIHAHQYGPVLARKITMMGHRFPAAESLKDGLVDAIGGWPEVEEIVQKCKKYAGKNYYNQMRMTIFAPVLDHCINYYDEEARDIARQEAAQQFIDDRQAEIKAKL

SEQ ID NO: 41490 - protein, 410 aa, Brassica napus
MRGMKSLTIWAIFAAVLSQQLFASVASIKFEDEKTYYSPPDPNAGSPPSGTPPSHGGYTPTPSTPSHTPPSNCGSPPYDPSPPSHTPTPSTPSHTPSTPSHTPSTPSHTPTPSTPSHTPTPSHTSPPCHCGTPPSHPSTPSRPSRPSHPSRPSRPSTPSNPPSGGYYSSPPPSTPVVVTPPTPIVDPGTPSTGGTPPSSGGYYSSPPPSTPVVETPPTPIVDPGTPIIGETPPTPSSGGYYSSPPPSTPVIETPPTPIVDPGTPIIGGTPPTPFIDPGTPGTPFLPAPFPPITGTCDYWRNHPTLIWGLLGWWGTVGGAFGAVSIPSSIPGFDPHMNLLQALSNTRTDAIGSLYREGTASWLNSMVNNQFPFTTSQVRDQFLAGLSSTKAATKQAQTFKLANEGRLKPRI

SEQ ID NO: 41491 - protein, 391 aa, Oryza sativa Japonica Group
MDTTASCSLPDAWPEPVVPVQSLSEAGVSAVPPQYIKPPQDRPVLPAPSLDVPTVDVAAFLDLDGAAAACAAAEQLKNLAEACSKHGFFQVVNHGVQASTVERMRGAWRRFFALEMEEKKACSNSPSAPEGYGSRAGVEKGALLDWGDYYFLNILPREIKRRNKWPKSPHDLREITEDYGRDLMNLCEVLLKAMSLSLGLGENQLHAAFGSDDGISACMRVNYYPKCPQPELTLGISSHSDAGGIAVLLADDRVKGTQVLKGDTWYTVQPIPNAFLVNVGDQIQIISNDKYKSVEHRAVASSDDARFTVAFFCNPSGNLPIGPAAQLVSSQSPALYTPIVFDEYRRFSRRRGLKGKSQLEAMKNSKIAQVELIAYRDAQINLRNLFTSDKN

SEQ ID NO: 41492 - protein, 393 aa, Gibberella zeae PH-1
MATRTIEARFERMSVNDENDPIGDGSKLYSKSKVQTISSTSSHGANRPNLFKVALQSQSSNANAAVMLPSQAAQRKVNNPPPSPTRKALPSSSRTSDEVSEDRKSVTLPEQMSVPKQFHLGMFEIGRPLGKGKFGRVYLARERTTGFICALKVLHKNELQAGRVEKQVRREIEIQSNLRHPNILQLYGHFHDSKRVFLILEFAGKGELYKHLRKENRFPEWKAAQYIAQMASALRYLHRKHVIHRDIKPENILVGIHGEIKISDFGWSVHAPNNRRKTMCGTLDYLPPEMIKPGTSDNFYNEKVDLWSLGVLTYEFLVGEAPFEDTPVMTQRRIARADMSIPTWVSPEATDLIKKLLVLDPEKRIPLEQIQQHPWIIKHCVKGERASNREKGL

SEQ ID NO: 41493 - protein, 524 aa, Arabidopsis thaliana
MDSFSYSSMKSMLIQARGSLNSRLSEFEPLVLLLVPLVSLFLAQIIGSVFGVVHEKGLKACLIGFIMGLLKMIPGVQNYIDAEKQKVVDQLQSGSSSKKKNKTEVLPVKGLGVEVLEKMENEKRNDAIWQGKCSGTVFAHTNPLHIDVFQSVVRFESEVVAMTAALLGSKETASGGQICGNMTSGGTESIVLAVKSSRDYMKYKKGITRPEMIIPESGHSAYDKAAQYFKIKLWRVPVDKDFRADVKATRRHINRNTIMIVGSAPGFPHGIIDPIEELGQLALSYGICFHVDLCLGGFVLPFARKLGYQIPPFDFSVQGVTSISVDVHKYGLAPKGTSTVLYRNHEIRKHQFVAVTEWSGGLYVSPTIAGSRPGSLVAGAWAAMMSLGEEGYLQNTSKIMEASKRLEEGVREIHELFVIGKPDMTIVAFGSKALDIFEVNDIMSSKGWHLNALQRPNSIHICITLQHVPVVDDFLRDLREAVETVKANPGPITGGLAPIYGAAGKMPDRGMVNELLVSFMDSQY

SEQ ID NO: 41494 - protein, 567 aa, Prochlorococcus marinus str. MIT 9303
MSHPSESSAAPCITTVDEFEKLADYSLMNSLNTDPDSRVDGDDHLARQVFSGHFVPVTPTPLKNPEYVTHSSTFFNELGLNNELAFNEKFCKLFSGDLSATREPMRQVGWATGYALSIYGREYTQQCPFGTGNGYGDGRAISVFEGIINGKRWEMQLKGGGPTPYCRGADGRAVLRSSVREFLAQEYMQALGVPTSRSLTLYVSKSETITRPWYSQHSQSIDPDILVENPVAISTRVAPSFLRVGQLELFARRARSNTHPRALEELRMIVSHLIEREYKNDINQSLAFTVQLVELARLFRERLTLLVANWQRVGYCQGNFNSDNCAAGGFTLDYGPFGFCEIFDPAFQPWTGGGEHFSYFNQPIAAEANYHMFWKALRPLLEEDAKALKEFDQVRDGFEQAMNKQIQKMWAAKLGLKEYNSNLFEELLQLMLNSKVDYTIFFRELSYIPNDLLALKKSFYIQTSQQIDEQWQSWLQSWRDLVLNNGNSTEISKIMKLTNPKYTWREWLIAPAYQQAEEGDYSLVKELQEALSHPYDEQSKEIEDKYYRLKPKAFFNAGGISHYSCSS

SEQ ID NO: 41495 - protein, 101 aa, Brassica napus
  misc_feature (6)..(6): Xaa can be any naturally occurring amino acid
  misc_feature (11)..(11): Xaa can be any naturally occurring amino acid
  misc_feature (21)..(21): Xaa can be any naturally occurring amino acid
  misc_feature (51)..(51): Xaa can be any naturally occurring amino acid
  misc_feature (58)..(58): Xaa can be any naturally occurring amino acid
  misc_feature (62)..(62): Xaa can be any naturally occurring amino acid
  misc_feature (75)..(75): Xaa can be any naturally occurring amino acid
  misc_feature (88)..(89): Xaa can be any naturally occurring amino acid
  misc_feature (92)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (98)..(99): Xaa can be any naturally occurring amino acid
EKEEVXAYSMXSSATVVTSPXQATMVVPFTGLKSSSAFPVTRKANNDITSXVSNGGRXNCMXAWPPIGKKKFETXSYLPDLTEAELPXXVDXLXRXKXXPC

SEQ ID NO: 41496 - protein, 370 aa, Cryptococcus neoformans var. neoformans B-3501A
MANILKRSALKLGMIPADGIGKEVLPAAQRVIEALGSSIPKTTFVPLVAGWEEFNKNGKALPDDTVSALRECDGAMFGAVSSPSHKVAGYSSPIVALRKHLDLYANVRPVSSVPIPGQPSAKAVDLVIVRENTECLYIKQEEISGEGEDRVALATRKISAKASSRIGRMAFEIALRRGQEREAARAAGKDVWWKGEPKVTIVHKSNVLSVTDGLFRETVRAVKEGKGGEKYAGVKLEEQIVDSMVYRMFREPEFFDVCVAPNLYGDIISDGAAALVGSLGLVPSINAGDNFIMGEPVHGSAPDIEGKNIANPIASIRSAALLLSSLGYIEPAAKINAAVNAVLVEGQYLTPDLGGKSSTTEVTEAVLKRL

SEQ ID NO: 41497 - protein, 477 aa, Oryza sativa Japonica Group
MPHSGVVDAAAKGVKLGGGGGGALMVRRVASGKLLSASSHLLFRATILATLCLVCLFTVHYPSLLSHSFHLSSAAAAANGKHRAASRSSHRSLLGSSAAVAYGGAAWEKEVRRSAAPRRDGGLSVLVTGAAGFVGAHCSLALRARGDGVVGLDNFNSYYDPSLKRARQRLLASRGVAVLDADINDAALLERLFDAARFTHVLHLAAQAGVRYAMRAPQTYVASNVAGLVSVFEVAAKHADPQPAIVWASSSSVYGLNTDAPFSEEHRTDRPASLYAATKKAGEAIAHAYNHIYGLSITGLRFFTVYGPWGRPDMAYFSFARSIVAGEPITLFRTADGADARRDFTYIDDVVKGCLGALDTAGESTGTKSGKKRGPAPLRVYNLGNTSPVPVTRMVAILEKLLGRKANKRVVTMPSNGDVPFTHANVSHAARDFGYRPATPLDAGLRRFVDWFVHYYKLDTAKIAKGKRKSMAMSAAS

SEQ ID NO: 41498 - protein, 291 aa, Xanthomonas axonopodis pv. citri str. 306
MSSALFDHWIARTERSLEAGLPSATHAPQRLHAAMRHAVLGGGKRMRPLLVYASGALFGAAEDQLDTPAVAVELIHAYSLVHDDLPAMDDDALRRGQPTVHIAFDEATAILAGDALQTRAFELLAAASASAELRVGWMQSLATAAGAAGMCGGQALDIDATGQLQSLQHLQRMHALKTGALIRAAVRMGALTGGAALADQQRLDEFADALGLAFQVRDDILDVESSSAQLGKTAGKDAAQSKSTYPALLGMDGAKAKLAELAARMHDVLQPYGQPGETLATLARFAVNRAH

SEQ ID NO: 41499 - protein, 654 aa, Oryza sativa Indica Group
MAATATAAAAHTLLHLAAPRKPSAGPPLPPTTLRLPGRRLARLTASCSSGSGNNSAADFPNPNGILVAPPSAAASAAAASSHIDVDVATEADLRENGFRSTRRTKLVCTVGPATCGADELEALAVGGMNVARVNMCHGDREWHRGVIRAVRRLNEEKGFAVAVMMDTEGSEIHMGDLGGAAAAKAEVSLAAAGFCLWHCRLANLLSCVRWNSASTACVVLATPNIPWSGDTSLDFAQLYRKLGDNMNPDSTAENIRDAQDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 41500 - protein, 297 aa, Agrobacterium tumefaciens str. C58
MMTTEKTAVISIGRIYCDLIFTGLEELPVLGRELFARDMEIAAGGGAFIAAAHFAHIGRPVALLARLGTDTFSRDIGEKMAQSGVDLQFLEHATDAGPQVTVATVVGQDRAFLTRRAGAARPSTLDAAFAWDKARHLHIAEFATLQEIPDLVSRAKASGLSVSLDPSWDAALIYDKGLLKACAGVDVFLPNLEEAEAITGRSEPEAAIRTLAEAFPIVALKGGAEGAWVSSAAGLHHRAAQKVPVIDTTGAGDAFNAGFLDAWLQRQDEQQCLKAGIAAGSLAVQAAGGAPRVTAAA

SEQ ID NO: 41501 - protein, 241 aa, Methylobacillus flagellatus KT
MKNGRIMDTIGKRWQAIKARIRAAALDAGRAPDSVSLLAVSKAHPASAMRELFLAGQRQFGENYLQEALAKQEQLQDLAIEWHFIGPIQSNKTQPIAQHFHWVHSVDRAKIADRLNAAREPGQTALQVCIQVNVSGESSKSGTSAADAIALADHIRQLPKLRLRGLMAIPAPTDDPQEQRSQFRAVRNIYDRLQSAGHDLDTLSMGMSEDFPAAIQEGATIVRVGSAIFGARIKPTAEQSI

SEQ ID NO: 41502 - protein, 97 aa, Zea mays
MAGRSFLIRSPKEEESDAAVREAVLLGAKNAAIAGTVVAVPTLVGCRVLPWAKANLNYTAQALIISAACIAGFFITADKTILRNARQNTIGKLDKST

SEQ ID NO: 41503 - protein, 359 aa, Oryza sativa
  misc_feature (97)..(97): Xaa can be any naturally occurring amino acid
MSAYCGKYKDELIKNAAYIGTPGKGILAADESTGTIGKRFASINVENVEDNRRAFRELLFCTPGALQYISGVILFDETLYQKTKDGKPFVDVLKEGXGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 41504 - protein, 269 aa, Methylobacillus flagellatus KT
MKISFIGGGNMARAIIGGLKQKGYSMATISVIELDAAKREQLTEEFGIHATEHLPSVANADIIVLAVKPQQLRDLAIFLASFLNQQLVISIAAGIPCAALSRWLNGYRAIVRAMPNTPAQIQVGISGLYAADGVSIEQREQADLLLSAAGSTLWVDDEQKIDAVTAISGSGPAYVFYFIEALEQAALELGFAPYQARALSLQTFLGASKLASQSDAPAATLRAQVTSKGGTTERAILSMEQAGIKQAIIQAAQAAAKRARELGEQLGKD

SEQ ID NO: 41505 - protein, 341 aa, Coprinopsis cinerea okayama7#130
MAELRKISLDDAQHLIQAGDVPVLRIKLEEDVEKWKTTQSYQDYGIFLRRLSDSVVNYQLPWSPTEPTERSQSLLEDLLGPEYSSLTDLVRPYFLTSFGSFTRMDYGTGHETSFALFLLCLTLVRYFQPIPEVEREIVLVIFLRYLRLCWRLQDTYRLEPAGSHGVWGLDDSHFLPYIFGSAQLRDQTDIPVNAVLQKPLPETNLYFLSISRIHEVKHGPFHEHSSSLHSIAVGVPNWGKVHSGLFKMYEAEVLGKRVVVQHIPLGGLLKWDPKASSTDEASSRHPQAPAHYSTATAAPTTWTPLPTIAPRTSHPSRRPDATTFPAPTGMPPPTSFPRGPT

SEQ ID NO: 41506 - protein, 175 aa, Prochlorococcus marinus str. NATL2A
MDLSDLPPSPSPGLVNLVVEIPAGSRNKYEYFSSAGIMALDRVLHSSVKYPFDYGFVPNTLAEDGAPLDAMVVMEEPTFAGCLIQARPIGVLDMHDSGAYDGKLLCVPTADPRQREINTIKQIAQDQLEDVAEFFRTYKSLEGRVIEIDGWRDYDAVDELLKSCIEAHHLEITQK

SEQ ID NO: 41507 - protein, 452 aa, Arabidopsis thaliana
MDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGQTHQQCLRRYSGTTMSEIDKHIEVLKHRKKSTKRSENCRSRRTAISVAEFEELLFRYQVEKETNFLHHSEFLVLFFSSLASQTQKREVYFYFKNSYIR

SEQ ID NO: 41508 - protein, 575 aa, Salmonella typhimurium LT2
MISGILASPGIAFGKALLLKEDEIVIDRKKISADKVDQEVERFLSGRAKASAQLEAIKTKAGETFGEEKEAIFEGHIMLLEDEELEQEIIALIKDKHMTADAAAHEVIEGQATALEELDDEYLKERAADVRDIGKRLLRNILGLAIIDLSAIQEEVILVAADLTPSETAQLNLQKVLGFITDAGGRTSHTSIMARSLELPAIVGTGSVTAQVKNGDYLILDAVNNQVYVNPTNDVIEQLRAVQEQVATEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAVRIAMDRKEILRDQVRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 41509 - protein, 660 aa, Zea mays
  misc_feature (306)..(306): Xaa can be any naturally occurring amino acid
MGKSSKKAAAVAAAPAAVPKGKKREAEEEIEKAVSAKKQKAAPPAKAVPTSKKDAKKSKKQPPPKKAESSSSDSEEDSESEEEVKKVQPKKAPAPKIAKQESSDDDTSDETSESDEEPAKKPAAKPLAAVAKNGSKTVKQESSSDEDSSEDESDDDSDDEPAKKAAAKPLGAVAKNGLKKGKQESSSDGSSSDDESDDDVKPAAPLKKTSVTVAQKKKGDSSESDSDDDSDEEVPPKSKAPAATIKKEDSSESESESDSEVEDASKTQPAKRAASKMKDESSDDSDTDEDEEPPQKKQKEALSAAXKKESSSEDEDDSSEESSDDEPTKVEEKKAPKVSENSGSEDESSEDESDKDSEEPANTPKKAAVHASEKKTATKEPKTPTGSQSESTEVNTLFMGNVPWKAEFDDVKEFFEDVGEVVDVRFPTHDDGNRKGFCYVEFVSAEAAAKAYKEKQSKELHGREVRLDFAKGRSTQTPRSGNDGSFQKAARGNSSSIFIRGFDKNLSEDEIRSSLEQHFSDCGEMTRVSIPTDHESGAIKGMAYIDFKDQDSVSKALELSGSDIGGGYELYVDEAKPRGDGQRGGGRSGGRSGGRFGDRSGGRRGGGRFGERSGGRDGGGRFGGRRGGRDGGRGRGGRGFGNKHSAGTPSAGKKTTFGDD

SEQ ID NO: 41510 - protein, 473 aa, Silene latifolia
EMTEKGKGGKKALSVDEKYSQWKSLVPILYDWLANHNLVWPSLSCRWGPLIEEATYKNRQRLYLSEQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDRRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVAACSPTPTKDVNHSA

SEQ ID NO: 41511 - protein, 487 aa, Escherichia coli CFT073
MSLAKDNIWKLLAPLVVMGVMFLIPVPDGMPPQAWHYFAVFVAMIVGMILEPIPATAISFIAVTICVIGSNYLLFDAKELADPAFNAQKQALKWGLAGFSSTTVWLVFGAFIFALGYEVSGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGIQISWLQWFLCFLPVGVILLIIAPWLSYVLYKPEITHSEEVATWAGDELKTMGALTRREWTLIGLVLLSLGLWVFGSEVINATAVGLLAVSLMLALHVVPWKDITRYNSAWNTLVNLATLVVMANGLTRSGFIDWFANTMSTHLEGFSPNATVIVLVLVFYFAHYLFASLSAHTATMLPVILAVGKGIPGVPMEQLCILLVLSIGIMGCLTPYATGPGVIIYGCGYVKSKDYWRLGAIFGVIYISMLLLVGWPILAMWN

SEQ ID NO: 41512 - protein, 487 aa, Myxococcus xanthus DK 1622
MCGRPPGQGLEFMGTSEPVEPDHALSKPPPVAPVGAQALPRGPAMPGIAQLMMLFLRPTEFLDRCAARYGDTFTLKIPGTPPFIQTSDPALIEVIFKGDPDLFLGGKANNGLKPVVGENSLLVLDGKRHRRDRKLIMPTFLGERMHAYGSVIRDIVNAALDRWPVGKPFAVHEETQQIMLEVILRVIFGLEDARTIAQFRHHVHQVLKLALFLFPNGEGKPAAEGFARAVGKAFPSLDVFASLKAIDDIIYQEIQDRRSQDISGRQDVLSLMMQSHYDDGSVMTPQELRDELMTLLMAGHETSATIAAWCVYHLCRHPDAMGKLREEIAAHTVDGVLPLAKINELKFLDAVVKETMRITPVFSLVARVLKEPQTIGGTTYPANVVLSPNIYGTHHRADLWGDPKVFRPERFLEERVNPFHYFPFGGGIRKCIGTSFAYYEMKIFVSETVRRMRFDTRPGYHAKVVRRSNTLAPSQGVPIIVESRLPS

SEQ ID NO: 41513 - protein, 525 aa, Oryza sativa Japonica Group
MATATASSLSLLFAHPHSSNPRPFAGGPHLRRPLRAAPHRARCASDAATTATRHRRPAEENIREEAARLRGPGNDFSAWYVPFPPTPEDDPDERYSLDEVVYRSSSGGLLDVCHDMEALARFPGSYWRDLFDSRVGRTAWPYGSGVWSKKEFVLPEIDSDHIVSLFEGNSNLFWAERLGREHLGGMTDLWVKHCGISHTGSFKDLGMTVLVSQVNRLRRAPLSRPINGVGCASTGDTSAALSAYCAAAGIPAIVFLPADRISLQQLIQPIANGATVLSLDTDFDGCMRLIREVTAELPIYLANSLNSLRLEGQKTAAIEILQQFDWQVPDWVIVPGGNLGNIYAFYKGFEMCRVLGLVDRVPRLVCAQAANANPLYRFYKSGWTDFQPRVAETTFASAIQIGDPVSVDRAVVALKATDGIVEEATEEELMDAMSLADRTGMFACPHTGVALAALFKLRDQRIIGPNDRTVVVSTAHGLKFTQSKIDYHDRNIKDMLCQYANPPINVKADFASVMDVLQNKLNGKI

SEQ ID NO: 41514 - protein, 384 aa, Oryza sativa Indica Group
MEEHLLPVVHRDQVYSSRQDRRKSSDVPNRFVTSFHPSTNSKGNPNTPNHPLPTSGNGNIVTAQNFQRVHSSPSMFTSIKETPCADEFNEQSHAAQHVPSFARQAIVSVILYISIGVLVYITNVEGFKGRSTLKLVDGLYFTIISLCTIGYGDIVPCTTFTKVFTCLFLLIGVRFVDIVLNELLTNVLDKQRTVLLSTMDDNKLNRVFDTYMIDAEKKRSRGRMKVLLALGVVVGTISICTIIVHEVEGLNWIDSFYLSVISVTTVGYGDYGFSTPAGRLSATVCLLVSTLAVAKAFLFLTDLRMDRRNRKTTKWILQKKMDNEPLAADLDHDASVSKSDFLIYKLKEIGKIDDKDIAMISDQFDQLGLAKCGKITLADIIGKL

SEQ ID NO: 41515 - protein, 261 aa, Pseudomonas aeruginosa PAO1
MTVTIKTPDDIEKMRIAGRLAAEVLEMIGEHIKPGVTTEELDRICHDYIVNEQKAIPAPLNYKGFPKSICTSINHVVCHGIPNEKPLKEGDILNVDITVIKDGYHGDTSKMFLVGKTPEWADRLCQITQECMYKGISVVRPGAHLGDIGEIIQKHAEKNGFSVVREYCGHGIGKVFHEEPQVLHYGRAGTGIELKEGMIFTIEPMINQGRPETRLLGDGWTAITKDRKLSAQWEHTVLVTADGYEILTLRNDETFPRTSAA

SEQ ID NO: 41516 - protein, 421 aa, Oryza sativa
RARASRRSRARRRRRRRRKRRSGRRDATPRRAAVCSTWTYEGGGPSRETSLAAVRSRAAVVRACSGGGGSVPTVGGAAGRRSCLCFDDKSENAWKSRVGVLYVMHPITFFTNIIGVVTIVLISIVSILGLICLCHSLNFQLLIKRRRRNYYQANDEQLSYFNGPWLTRITLILVALWWGVGDVLRLTFVNGEGRFISDQTWQANVCKFYIVSNLGFAEPGLFLLLAFLLSAALQNQEVGALNRKWNQRTICAVFMLCSPSLIWEACVVFIGPHIASNDGQTSKVAKYWYSASSVHDGDVACTYPLLSSIFLGTFYTVLTLYVIFVGGQILSLVINKGLRRRIYMLIFATGILLPRAMFLGFSVLPWPGEIVHESLVFVSFLVLMIAAMLGIVILVYFPVAETFEVRNQEHIELQTSHSIAL

SEQ ID NO: 41517 - protein, 167 aa, Vibrio vulnificus CMCP6
MAKEQQVQANDLQEKLIAVNRVSKTVKGGRIMSFTALTVVGDGNGRVGFGYGKAREVPAAIQKAMEKARRNMVTIALNEGTLHHPVKGRHSGSKVYMQPAAEGTGVIAGGAMRAVLEVAGVHNVLSKAYGSTNPINIVRATIDALVDVKSPEMVAAKRGLTVEAISE

SEQ ID NO: 41518 - protein, 237 aa, Triticum aestivum
MLPSRFLLTPHCPTAPAPTPTPTPPGGARSPSSVALRFGSPGGVRLRRGRGSAAVAMASDGRVERIASSIRAIPNFPKPGILFQDITTLLLDPQAFRDTTDLFVERYKDKDITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDMPVFVLVQADESV

SEQ ID NO: 41519 - protein, 410 aa, Hordeum vulgare subsp. vulgare
MAAMWSPIIGLLLLLLPLGPSSAIKFPLEGNVYPVGHFYATLNIGEPAKPYFLDVDTGSNLTWLECHHPVHGCKGCHPRPPHPYYTPADGNLKVVCGSPLCVAVRRDVPGIPECSRNDPHRCHYEIQYVTGKSEGDLATDIISVNGRDKKRIAFGCGYKQEEPADSPPSPVDGILGLGMGKAGFAAQLKGHKMIKENVIGHCLSSKGKGVLYVGDFNPPTRGVTWAPMRESLFYYSPGLAEVFIDKQPIRGNPTFEAVFDSGSTYTHVPAQIYNEIVSKVRGTLSESSLEEVKGRALPLCWKGKKPFGSVNDVKNQFKALSLKITHARGTNNLDIPPQNYLFVKEDGETCLAILDASLDPVLKELNFILIGAVTMQDLFVIYDNEKKQLGWVRAQCDRVQELESVIDSRL

SEQ ID NO: 41520 - protein, 175 aa, Triticum aestivum
MAPTVMAASATSVAPFQGLKSTGGLPISRRSSSAGLRSVSNGGRIRCMQVWPIEGIKKFETLSYLPPLSTEALLKQVDYLIRSKWVPCLEFSKVGFVFREHNSSPGYYDGRYWTMWKLPMCGCTDATQVLNEVEEVKKEYPDAYVRVIGFDNLRQVQCVSFIDFRPPGCEESGKD

SEQ ID NO: 41521 - protein, 505 aa, Ehrlichia chaffeensis str. Arkansas
MGCIAHFLCYHSTMSFALKYRPSNFKDLIGQEVLVRVLHNAFHLNKIPESILLTGISGVGKTTAARIISMCLNCISGPTSDPCNTCQNCISIKNFNHPDVIEIDAASNTSIEDVKVILENSRYMPISSKFKVYIIDEVHMLSNSAFNALLKVLEEPAPYVKFILATTEVKKIPVTIISRCQRFDFQRISTDKLVDHLKVVAKKENVSFDEESIKLIAYNADGSIRNALSLLEQAAIYSNKILSENITKEMLGYVSRHTLLEIIEPLIIGNATEALNKFEEACNSYNSVIILDNMLQIIYEICYFSITKKDNSTSDNSIITYIKNEKILSPTFLSRLWQMLFKGIQEVKSSSCIKQAANMLIIRLCYLSSLPSPKQIIDKIQGKINNTSDINRKALLELLKSNNMQDLYNQIYESESEVKNYKDEALNIETNQALSKDFHEDSLNFFNNSTNKKCNVPIEQNFDINKSSNPCYNQHLDPTVCNILQEFDGAKVINIENIKKNNNKE

SEQ ID NO: 41522 - protein, 173 aa, Oryza sativa Japonica Group
MEHKEAGCQQPEGPILCINNCGFFGSAATMNMCSKCHKEMIMKEEQAKLAASSIDSIVNGCDGGKEHIVAASGSTAVAVAQVEAKTLVVQPTDVAGTSEEVAVVPKVKEGPNRCATCRKRVGLTGFNCRCGNMYCALHRYSDKHECQFDYRTAARDAIAKANPVVKAEKLDKI

SEQ ID NO: 41523 - protein, 366 aa, Triticum aestivum
MVIGQKNAEGSIQRSCLPRLLCAREQYSALLLFVAVAAVCLLVVVGSGTYALSSPADVGGEMEQRFFNIFPRQAAAGASDDELEAALRGAADANRTLIVSVLNKAYAEEGGLLDLFIESLKQGEGTGHLIGHVLLVAMDEPAFRRCSGLGGVRCYLLPPAAATNSTNLSSEQLYMSGGFIRMMWRRIRLLGDILKHGYSFIFTDMDVMWLRNPFPSLNRTEEEDLLISTDGFKGRPEDYLGHELNTRFFFVAASNRTAAMFDEWHAAREASEGMKEQDVLNQMKQQGAFRRLGVRVRVLDTARFSGFCQDSQDARQVVTVHANCCRTMRAKVADLKAVLGAAKQLNGTTGRLKWPRHSACLGSWRK

SEQ ID NO: 41524 - protein, 303 aa, Salmonella typhimurium LT2
MNTLEQTIGNTPLVKLQRLGPDNGSEIWVKLEGNNPAGSVKDRAALSMIVEAEKRGEIKPGDVLIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKPVTIVGLQPEEGSSIPGIRRWPAEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 41525 - protein, 163 aa, Methylobacillus flagellatus KT
MKHIISILMENEAGALSRVAGLFSARAYNIESLTVAPTEDATLSRMTIVTSGSDEVIEQIIKQLNKLVDVVKVLDLNDGRFIERELMLVKVKATGSFREEMKRMCDIFRGRIIDVADSSYTIEMTGSGSKLDAFLEALDKGAILETVRTGASGIGRGDRILKL

SEQ ID NO: 41526 - protein, 592 aa, Aloe arborescens
MESMMKSLRGDDVSVLDLDPKTAVGGGVGDVYGEDRATEEQQVTPWTVSVASGYSLLRDPHHNKGLAFSEKERDAHYLRGLLPPTCISQEIQVKKMLHNLRQYQVPLQRYMAMMDLQEMNERLFYKLLIDHVEELLPVVYTPTVGEACQKYGCIFRRPQGLYISLKEKGKILEVLKNWPERNIQVIVVTDGERILGLGDLGCQGMGIPVGKLSLYTALGGIRPSACLPVTIDVGTNNEQLLKDEFYIGLRQKRATGQEYAELLHEFMAAVKQNYGEKVLIQFEDFANHNAFELLAKYSTSHLVFNDDIQGTASVVLAGLVAALKLVGGTLAEHTFLFLGAGEAGTGIAELIALEMSKQTKAPVEETRKKIWLVDSKGLIVSSRKDTLQHFKKPWAHEHEPVDTLLGAVKTIKPTVLIGSSGVGRTFTKEVIEAMSSFTEKPVILALSNPTSQSECTAEEAYTWSKGRAIFASGSPFDPVLYNGKLFVPGQANNAYIFPGLGLGLVISGAIRVHDDMLLAASEALAQQVTQENFANGLIYPPFSIIRKISAQIAANVAAKAYELGLATRLPRPADLVKYAESCMYTPAYRSYR

SEQ ID NO: 41527 - protein, 713 aa, Xanthobacter autotrophicus Py2
MLALVLIIACGLLAVAYGVWAIRELMAADPGTARMQEIAAAIAEGAQAYLKRQYTTIGVVGVVIFVLVGVFLGWLVAVGFAVGAILSALAGFIGMNVSVRANVRTAQAATLSLAGGLDLAFKAGAVTGLLVAGLALLGVTVYFLVLTQILGFAGNSRTVVDALVALGFGASLISIFARLGGGIFTKGADVGGDLVGKVEAGIPEDDPRNPATIADNVGDNVGDCAGMAADLFETYAVTVVATMVLAAIFFAAAPASLATMMVYPLAIGGACIITSIAGTFFVRLGANSSIMGALYKGLMATAGFSIIALAAVTWLLPGFGPIAGADFTGTSLFLCGLVGLAVTGAIVVITEYYTGTGYRPVVSIAQASVTGHGTNIIQGLAVSLESTALPTLVIIAGILFAYGLAGLFGIAIAATTMLALAGMIVALDAFGPVTDNAGGIAEMAGLPKEVRQSTDALDAVGNTTKAVTKGYAIGSAGLGALVLFAAYSQDLKYFIAQAGQGTYFYGVTPNFSLENPYVVVGLLFGGLLPFLFAAMGMTAVGRAAGAIVEEVRRQFREKPGIMAGTEKPDYSRAVDMLTKAAIKEMIIPSLLPVLSPIVCYFVIYFVAGGGAAGKSAAFSAVGAMLLGVIVTGLFVAISMTSGGGAWDNAKKSFEDGFVDKDGVRHMKGSEAHKASVTGDTVGDPYKDTAGPAVNPMIKITNIVALLLLAVLGH

SEQ ID NO: 41528 - protein, 131 aa, Zea mays
  misc_feature (28)..(28): Xaa can be any naturally occurring amino acid
  misc_feature (45)..(45): Xaa can be any naturally occurring amino acid
  misc_feature (62)..(62): Xaa can be any naturally occurring amino acid
  misc_feature (89)..(89): Xaa can be any naturally occurring amino acid
  misc_feature (99)..(99): Xaa can be any naturally occurring amino acid
  misc_feature (122)..(122): Xaa can be any naturally occurring amino acid
CLTWIASSIGVIPDFTKSWIMFQEISTXMLLDPKVFRDTIDLFVXRHKDTMITAVAGDKLHXGFIFETPITLDIVAKIVSLRKSKKMPXEEISEKYALXYVTDQIQMHVGAVQVNYRALVVXELIATGATL

SEQ ID NO: 41529 - protein, 822 aa, Ustilago maydis 521
MSLAEALLSRAQTKRSALTDKALSNTADAAKGGLATFLAKAGDSSKNAVAFSVASSGARAPASIQITSFHPEKTLPPANYASLATAQLIRSVRLILVSTWRRPDTSAARQPLQQLYSTANVLVMYCSAEELDHLYDSVKIEIERAVGNWVATLHSSASITDLLQDKVGWLVELRSIWFEWSDNLALVRNILYSLDRYVLNRRTADGYYRSKSFVSHDDRISIRDLGLKEFGHHILKDATLFRTFLKCIVGAIDGKRKLLLTYGKLHHDLLTMLGQLQAEDALDDAVSKATDVFYQAESTASIASLSPTEYVEYAWGRMSEERDRSQWALSTGTGQHKMIAAARKQLVTQHADTILAALPDLVTSGNCDGLDKMYQLANCSDRLADLRKAFAEFIKTHGAAIVEDRERDDKMIEGLLAFKSSIDRVVHHSFGGDDDFVLAQKQGFEFCINKRETKVAELIAKYLDAKLRSGNKTMSDLELENSLDEALILFRYTQAKDMFEEFYKRHFAKRLLLNRSASSDAERSMLLKLKAECGPEFTAKLETMIKDVEVSKDLMDEYVRFAAKQRKDEPSPKDDFDLSVSVLTQAHWPTYPNIDVALPVELAAAAERFAAFYQNRNSGRRLHWQHSLGTLTMTAKFEKAGVKELHVSTFQAIILMLFNTLEPGQKLSYADIRTHTGLNDQELKRTLQSLACGLIPTRVLRKHPQGKEVNDDDHFTFNDNFKNDRHRIRINQIQMKETAEEQKSTEQRVFLDRELILQAATVRVLKAKKTIKHSELITEVVDQIKNRFTVDVAEIKKEFEILIEKEYMERVEGQRGMYRYLA

SEQ ID NO: 41530 - protein, 214 aa, Triticum aestivum
  misc_feature (120)..(120): Xaa can be any naturally occurring amino acid
  misc_feature (136)..(136): Xaa can be any naturally occurring amino acid
  misc_feature (141)..(141): Xaa can be any naturally occurring amino acid
  misc_feature (152)..(152): Xaa can be any naturally occurring amino acid
  misc_feature (174)..(174): Xaa can be any naturally occurring amino acid
  misc_feature (178)..(178): Xaa can be any naturally occurring amino acid
  misc_feature (197)..(197): Xaa can be any naturally occurring amino acid
MSEEDSTSAAAHQPTSRPAPKLIERILSSLSRRAVAAHPWHDLEIGPGAPAVFNVVVEITNASTVKYELDKKTGLIKVDRVLYSSVVYPHNYGCIPRTLCEDNDPMDVLVLMQEPVIPDXFSRARAIDLMPMIDQXRKDDXIIAVCADDPEXRHYNDINELSHHPPREIRRFLXDYPXDENMYSAVDAFLSATPARXEPFRYPIDLYAQLILQS

SEQ ID NO: 41531 - protein, 438 aa, Desulfovibrio desulfuricans G20
MALFTKEEALHYHEAPRHGKVEVIPVKPCRNQKDLSMAYSPGVAEACKAIKEDPSKAEIYTGRSNLVAVVSDGTAVLGLGNIGPLAGKPVMEGKGVLFKTFADIDVFDINLDVSSADQLIGVVKALEPTFGGINLEDIKAPECFYIEDTLKKEMNIPVFHDDQHGTAVISGAGLLNALEITNRKAENMKVVVVGAGAAGIACAKFYVSLGVDPANIYMFDSRGLIHKGRKDLNEYKALFAQPSDAGTLAEVMKGADMFLGLSTKNLVSQDMVRSMAKDPVLFAMANPDPEITYPDAKQASPNCIMGTGRSDFPNQVNNVSGFPYIFRGALDVGATEINEEMKVAAARSLAALAKEPVPSEICDMYGVKELTFGVDYVIPKPLDPRVLVWETPAVAKAAMDSGVARKPIADMEAYKKQLTTRFDESRKRIARVVDSYGL

SEQ ID NO: 41532 - protein, 435 aa, Agrobacterium tumefaciens str. C58
MSLNNEQSFWNQANRHLTRYGPSFESIIVERASGSYVYDANDRPILDFTSGQMSALLGHTHPDIVATVDRQMRSVAHLFSGMLSRPVVELASRLAALAPGLDRVQLLTTGAESNEAAIRMAKLVTGGHEVVAFAQSWHGMTGAAAAATYSAGRRGYGPVAAGSLVIPAPNSYRPRFAKPDGTNDWQTELDDAFALIDNQSTGSLAAFIAEPILSSGGILELPAGYLAALKLKCEERGMLLILDEAQTGVGRTGHMFAFQRDGVTPDILTLSKTLGAGLPLAAVMTTEAIEQKAFEKGYLFYTTHVSDPLLAAVGVTVLDVVEREGLLAAAIGRGARLRAGLVSLQQRFECVGDVRGRGLLMGLEIVADRQTKAPGFALGAKIMEEAMRRGLSMNIVKLPGMGGVFRIAPPLTVSDEEIDHGIEIMSDSIQAASGA

SEQ ID NO: 41533 - protein, 401 aa, Pseudomonas aeruginosa PAO1
MSLPSPWRADFPAFSAFAAEGLTYLDSAATAQKPQAVLDALNGYYLGGAANVHRAQHVPGERATRAFEAARSRVAHWLHAGNPAEVLFTRGTTEAINLVAYGLERHFRPGDELLVSALEHHANLLPWQQLALRRGLVLRVLPLDERGVIDLEQARHIIGERTRLLAISQLSNVLGTWQPVVELIQLARERGAWTLVDGAQGSVHGRHDLPGLGCDFYAFSGHKLYGPDGIGVLWGRPQALEQLAHWQFGGEMVRHTGFHEASFHAAPLGFEAGTPAVSAAIGLGATIDWLATLDEAEVAAHEGALHARLLAGLLARDGVSLLGEPQAALASFCVDGVHVADLAHLLGEQGIAVRAGHHCAMPLLQRLEVPGALRVSLGLYNDADDLERFFLALDRSLELLR

SEQ ID NO: 41534 - protein, 218 aa, Vibrio parahaemolyticus RIMD 2210633
MTQDEMKKAAGWAALKYVEKGSIVGVGTGSTVNHFIDALGTIKDDIKGAVSSSVASTERLKELGIEVFECNDVIKLDVYVDGADEINHAREMIKGGGAALTREKIVAAISEKFVCIVDDTKAVDVLGQFPLPVEVIPMARSYVARELVKLGGDPAYREGVVTDNGNIILDVHNMQITNPKEMEDKINGIAGVVTVGLFAHRGADVVITGTPEGAKIEE

SEQ ID NO: 41535 - protein, 693 aa, Gibberella zeae PH-1
MNVYEISSSGAPSPAPEGVSTPPAPDMPVKGKNRHRLIQRIQRISSTPSLSGLRRSKSVGSRGSPYGTRSTLSCVSLAATGPPQSQAPYSARSSTPQPSPLGLPSTSGSSPQSSGEFPFVTPGSELAIRRVENVTPITAPITAPLPSEFRSKQDVQLRVRPGVKPIQKPPFRFWEKMPNELQIHIFSFFQPKELVQASRVSRAFYKTCFDGQLWTSLDASEFYREIPAESLARIIIAAGPFIKDLNLRGCVQVEHYKRTEAIVKACKNLMNATLEGCQNFQKSTLHSLLRSNEKLVSLNLTGLTAVSNTSCKIIAESCPQLEAFNISWCGKVDARGIKGVVEACPRLKDLRAGEVSGFDNVATAEAIFKTNNLERLVLSGCAELNDEALKIMMHGVEPEIDILTDRPVVPARKLRHLDLSRCVQLTDAGVKTIGHLVPDLEGLQLSGCKLLSDDALESILASTPRLTHLELEDLENLTNSILSEHLAKAPCATSIEHLSLSYCESLGDTGMIPVMQTCTNLQNVDLDNTRVSDLVLAEAAAMVMKRSRRSTENGTRPKLSLQMVVYDCQNVTWTGVREVLFRNTQVKAVSGQPGRVSYPTEMIGLKCFYGFQMTVDEHQKRVMRGDLASAGRLERKWADYMQATEEAGMTGAGHRRRRRRAREAQALHLDEEDGGFGPTGRRRARTLGSCTVM

SEQ ID NO: 41536 - protein, 510 aa, Arabidopsis thaliana
MPLGERGGWGRTESRYCGVETDFSNDVTHLLNFNISTGGFDYVLAPLVDPSYRPSLVEGNGVDTQVLPVCGSDLVLSPSQWSSHVVGKISSWIDLDSEDEVLRMDSETTLKQEIAWATHLSLQACLLPTPKGKSCANYARCVNQILQGLTTLQLWLRVPLVKSEGDSMDDTSEGLNDSWELWNSFRLLCEHDSKLSVALDVLSTLPSETSLGRWMGESVRAAILSTDAFLTNARGYPCLSKRHQKLIAGFFDHAAQVVICGKPVHNLQKPLDSSSEGTEKNPLRIYLDYVAYLFQKMESLSEQERIELGYRDFLQAPLQPLMDNLEAQTYETFERDSVKYIQYQRAVEKALVDRVPDEKASELTTVLMVVGAGRGPLVRASLQAAEETDRKLKVYAVEKNPNAVVTLHNLVKMEGWEDVVTIISCDMRFWNAPEQADILVSELLGSFGDNELSPECLDGAQRFLKPDGISIPSSYTSFIQPITASKLYNDVRLIKILRTLKLLMLSSCIV

SEQ ID NO: 41537 - protein, 342 aa, Oceanobacillus iheyensis HTE831
MKAVFVEDAEKIIVKDIEVPELKPNEVQIKVNVAGICGSDIHTYKGLHPFRKPPVVIGHEVAGEVVEVGSSVTKFKVGDRVTVEPQIGTGESEGVMTGNVNYSDTRLAPGMGDWLGTMAEYFASPEEQVIKLPDSVSYDQGVLVEPLAVGVHAAFKGDVQPTDRVAILGAGPIGLLTLIAVKAKGVKDIVVTDVLDYSLQVAKEMGASEVINIKDNSNWIHDAKQSLDKGSFDKVFITAGVPGIVNDSLNLLRKGGRVVTVAMFHGQQSVDIEQLQQNEKEIIGCMTYNRPDTEEALEIIASGKLDVEKVISHKLHYEEAAKGFTIVDKKKDKSVKVLVSFE

SEQ ID NO: 41538 - protein, 152 aa, Glycine max
AVPLFIESDKLSSSSKAFIGKPAPNFMADAVVNGDFKTISLEQFKGQYVVLFFYPLDFTFVCPTEIIAFSDKAGEFKKIGVQLIACSTDSKFCHLEWINKPRKQGGLGEMNIPVLADTSHKISRDSRVLMEEAGIAYRGLFIIDDQGVLRQI

SEQ ID NO: 41539 - protein, 111 aa, Glycine max
MREATASGGGAAAGPNDPRQPGTARPYAPPKLSSQDLPVDYAGFLAVVFGVVGVMLHYKVCSWIAIIFCAQSLANMKNFENDLKQLSMAFMFAVMGLVTNYFGPRPGAAKR

SEQ ID NO: 41540 - protein, 522 aa, Vitis vinifera
MVSSTVFQSPRFSFSSATKSTAKPITTTTAAVHFPIRACSSTEAAGSIKTHHRRPADENIRDEARRQSSGNHHGFSAVYVPFNADPSSTESYSLDEIVYRSRSGGLLDVSHDLDALKKYDGQYWRSLFDSRVGKTTWPYGSGVWSKKEWVLPEIDSDDIVSAFEGNSNLFWAERFGKQFLGMNDLWVKHCGISHTGSFKDLGMTVLVSQVNRLRKMNRPVVGVGCASTGDTSAALSAYCAAAGIPSIVFLPANRISIAQLVQPIANGAFVLSLDTDFDGCMQLIREVTAELPIYLANSLNSLRLEGQKTAAIEILQQFDWEVPDWVIVPGGNLGNIYAFYKGFHMCKELGLVDRIPRLVCAQAANANPLYLHYKSGWGEFKPVKANTTFASAIQIGDPVSIDRAVYALKNSDGIVEEATEEELMDATAKADSTGMFICPHTGVALTALFKLRESGVIRPTDRTVVVSTAHGLKFTQSKIDYHSKDIPDIACRFANPPVQVKADFGSVMDVLKKYLLSRDPRC

SEQ ID NO: 41541 - protein, 416 aa, Geobacillus thermoleovorans
MKCCRVMFVLLGLWLVFGLSVSGGRAEAAASRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFATERTYRGALTGNYYPELGMNAFSAVVCAPFLGSYRNPTLGIDDRWLENDGIVNTVSMNGPKRGSSDRIVPYDGALKKGVWNDMGTYNVDHLEIIGVDPNPSFDIRAFYLRLAEQLASLRP

SEQ ID NO: 41542 - protein, 196 aa, Triticum aestivum
MSTKLLNSLSLTRLLGLRRNPIDLYTASRAWISSTSFSGVHEKNGMGVEADGDLADSWKDADFRGVYRAIICGSVGQVPVQKKLRNGHTVTVFTVGTGGMFDQRRAGAENLPMPAQWHRIAVHNEQLGAYAVQKLVKNAAVYVEGEIETRVYNDDINNLVKIVPEICVRYDGKIHLVQSGGSDVSKSLEELREGLF

SEQ ID NO: 41543 - protein, 338 aa, Clostridium perfringens ATCC 13124
MNILLTGGIGYIGSHTVIELLKDDNNSVVVIDNLINSKKEVKDIVEKITGKSIKFYEGDLVNFEDIDKVFKNEKIDAVIHFASLKAVGESVEKPLEYYNNNIIGTLNLLTSMRNHNVKKFIFSSSATVYGESEIVPVHEGLQAGFATNPYGRCKAIIEEILRDIYISDNSWDIVLLRYFNPVGAHESGLIGELPNGIPNNLMPYVSKVADGELDYVRVFGDDYNTPDGTGVRDYIHVVDLARGHVAAMKKLKDGSGISTYNLGTGQGYSVLDIIKAFSKASGKEIPYKIVDRRAGDIAISFADPSKAEKELGWKAEKNLEDMCKDFWKWQCVGMKNFK

SEQ ID NO: 41544 - protein, 296 aa, Methylobacillus flagellatus KT
MTDFQSWARHTQQRMEHTLDNLLPASYIAPTRLHEAMRYAVLGGGKRVRALLAHAAGELCGAAPEKVDIAAAAVELIHAYSLVHDDMPCMDDDDLRRGKPSCHKQYDDATALLVGDALQTLAFQSLATPGLCTDPGRQLEMVSLLAIASGSRGMAGGQAIDLDSVGKALEQSELEYMHIHKTGALIRAAALLGAHCANDLDQERLHAIDHYAQAIGLAFQVVDDILDAEADSETLGKTAGKDAQSDKPTYVTILGIDHAKQLAKELLDGALAQLAPFGEAAHRLEQVAHFITQRSF

SEQ ID NO: 41545 - protein, 389 aa, Lactobacillus acidophilus NCFM
MHFLGELILILLTTVLLGQLFARFNMPAVIGQLLSGILLGPAILNWIHPNEIISLFSEFGVILLMFLAGLESDLDLLKKYFKLSFTVASVGVILPVIFMGLASYFFGMRPLEALFIGIVFAATSVSISVVVLQEANQLHTRAGTAILGAAVVDDILAVVVLSLFTTFSHEGGKSGLTNNFFLNILIEIVYFVVVWIIFKFIAPYFMKVSEKISVDYSVVIGSLVLALTMAWAADFVGLSAVVGAFFGGLAIRQTPQHKEVQSSVSAIGYSIFIPVFFADIGLSMTFASFIKDIWFIIVMTVLAVLSKFWAGKYSSEVFGFTKNEGNIVGAGMVSRGEVALIVAQIGITHNLFPEDIYSSLILVIIVTTVASPFILNHYIKKSKQDTEFM

SEQ ID NO: 41546 - protein, 614 aa, Methylobacillus flagellatus KT
MYELLESINSPEDLRRLDRKELHELARQLRAFLINSVAQTGGHLSSNLGVVELTIALHYVFNTPEDRVVWDVGHQTYPHKILTGRRKDMGNLRRPGGIAGFPRRDESIYDTFGTGHSSTSISAALGMAVAAQKTGSDRHSIAVIGDGAMTAGMAFEALNNAGAMDANILVILNDNDMSISPNVGALTNYLAKLLSGPLYTTVRRSGEKVLGVVPPVREFAKRAEEHVKGMVTPGTLFEEFGFNYIGPIDGHDIDVLITTLRNIRELKGPQFLHIATQKGHGYQPAEDNPGKFHGVGKFDPSNGCSIAQAGKKTYTQVFSDWLVDMAARDERLVGITPAMCDGSGLNAFAEQFPDRFFDVGIAEQHALTFAAGMACDGLKPVVAIYSTFLQRAYDQFIHDIALQNLPVMFAIDRAGLVGADGPTHAGSFDLSYLRCIPNIIIMAPSDENECRQMLYTAYLHDGPSAVRYPRGGGPGATITRDMQLLPIGKGELRRQGSWVAILAFGSMLAPALEAAETLDATVANMRFVKPLDANLINQLASSHTLIVTVEENAVMGGAGAAVMECMQAADIHTPVLCLGLPDMFIEHGVHETMLAECGLNAAGIIAAIEKKLTK

SEQ ID NO: 41547 - protein, 339 aa, Oryza sativa Indica Group
MARDFTATFLLLLSVASLLVISPCAAQQIKTTDTRWSYHLPLPDGVSGAESLAFDGKDGLYTGVSDGRVLKWGGSAAGWTTFAYNANYRKIPLCSSSEVPPEERESICGRPLGIRLFRKTGELYIADAYKGLMKVGPDGGEAQVVATEADGVPFHFLNGLDVDQATGDAYFTDSSSTYTRRFNGEITMNADATGRLLKYDARTRRVTVLKTDLPYPNGVAVSRDRTHLVVAHTVPCQAFRYWLRGTKAGEYELFADLPGYPDNVRRDTKGGYWVALNQERMRLGAAPAAKHLVGVRLNPDGVEVEELTATKGVTLSEVAEQKGKLWLGSVELDYIGMFA

SEQ ID NO: 41548 - protein, 166 aa, Bacillus cereus ATCC 10987
MCVGIYNYIHNSEVERFFMEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 41549 - protein, 258 aa, Zea mays
MLAIFWLTRNKVLFQIVIKKKKKKKKKKKKKKKIPSLPVLHPVPVRAGRRRLFVPASASRAPLSVRVTGGRQGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 41550 - protein, 329 aa, Pseudomonas putida KT2440
MSEHSSLPRLSIATLGGTVSMRAGAVGDGVTPSLDCERQLLQVPQLREMAQLNVASLCLLPSASLGFATLLEVLAWARGEVERGAQALVLSQGTDSLEETAYFLDLLWPFDVPLVMTGAMRSASQPGNDGPANLLAAAQVALAQDSRGRGVLVVMNDQVHCAARVRKTASLAMAAFESPGCGPLGDVVEGVVLYRHPPGRRKVLPLPYRTDQRVALLEACLDADTALLQAVATLGYEGLVIAGFGAGHVSASWSEVLEHLAPTLPVMVATRTGRGLTARATYGFAGAEIDLQKKGVYMAGQLCPRKCRILLWLLIGTDRQHELQDWLQP

SEQ ID NO: 41551 - protein, 386 aa, Vibrio parahaemolyticus RIMD 2210633
MSVIKMTDLDLAGKRVFIRADLNVPVKDGKVTSDARIIASLPTIKHCLEAGAKVMVTSHLGRPTEGEYAEEFSLQPVVNYLNDALDCEVKLAKDYLDGLELNAGELVVLENVRFNKGEKKNEEELSKKYAALCDVFVMDAFGTAHRAQASTHGVGMHAPVACAGPLLANELEALGKAMDKPARPMVAIVGGSKVSTKLTVLESLSKIADQLVVGGGIANTFIAAAGHNVGKSLYEADLVDTAKKLMDECAIPVATDVACAKAFDENAEAEIKHVSEVQDDDMIFDLGPESTAALAEILKNAKTILWNGPVGVFEFKNFEAGTKGISEAIAASEGFSVAGGGDTLAAIDKFGIKADVSYISTGGGAFLEFVEGKVLPAVEMLEARAK

SEQ ID NO: 41552 - protein, 537 aa, Oceanobacillus iheyensis HTE831
MNFFHTETYPYTNPRHATYAKNGMVATSQPLASEAGLSILKKGGNAIDAAIATAACLTVVEPTSNGIGGDAFALVWTKGKLHGLNASGRSPQSISIDKVKETGKDHIPKYGWIPVTVPGAPSAWAALSKRFGKLSLQEVLQPAINYARDGYPLSPTLSKFWKKAYTVFKKELSDDMFHEWFETFAPNGRAPETGEMWRSPNHANTLQEIADTDGESFYRGELAAKISAFSEANDGFLTAEDLAAHQPEWVDPIKVNYRGYDVWEIPPNGQGIIALQALNILKGYTFDTKEVTDTYHKQMEAIKLAFADGQEHVTEKDHMKHSVEELLSDSYGEYRRGLIGDEAIQPKAGEPALSGTVYLATADNEGNMVSFIQSNYMGFGSGLVVPGTGIALQNRGHNFSMDPNHVNALAGNKRTYHTIIPGFLTKDAEPIGPFGVMGGFMQPQGHVQVIMNTIDFQLNPQAALDAPRWQWMKDKQVEVENTFPHHIAMDLAKKGHNIRIQLEPNSFGRGQIIWRNPETGVLVGGTESRTDGTVAAW

SEQ ID NO: 41553 - protein, 345 aa, Vibrio parahaemolyticus RIMD 2210633
MLKVAINGFGRIGRNVLRAVYESGKHQQIKVVAVNELAQPEAMAHLLQYDTSHGRFGKKISHDQEHLNVHHESGEYDAIRILHLSEIELLPWRDLEVDIVLDCTGVYGSKADGLAHIEAGAKKVLFSHPGANDLDNTIIYGVNHETLKDEHRVVSNGSCTTNCIVPIIKVLDEAFGIESGTITTIHSSMNDQQVIDAYHNDLRRTRAASQSIIPVDTKLHKGIERIFPKFSNKFEAISVRVPTVNVTAMDLSVTINTNVKVNDVNQTIVNASQCTLRNIVDYTESPLVSIDFNHDPHSAIVDGTQTRVSNGQLVKMLVWCDNEWGFANRMLDTALAMKASSQVEL

SEQ ID NO: 41554 - protein, 534 aa, Bordetella bronchiseptica RB50
MTAPTLAPIDPPARAQLLADLQGAPDWDVIVIGGGATGLGTAVDAAARGYRTLLVEAADFAKGTSSKATKLVHGGVRYLAQGNISLVREALHERGLLNRNAPHLVWPLGFVVPAYSLLDQPFYGVGLKMYDMLAGKLNLAPSRWLSRGETLRHAATVAERVNGRALRGGILYYDGQFDDARLAIALMRTLYDLGGVALNYARAVGLTRTDGRVDGVTVADALGELRVTLRAKCVVNATGVWVDAVRRMDDPAAQTMVAPSQGVHLTLPRDFLPGEDAILIPKTDDGRVLFVVPWNGHTIVGTTDTPRTDLPLDPQAGQNEIDFILATAARYLSRKPTRADVTSVWAGLRPLVKATGEASTKSLSREHTIVVSKGGLVTVTGGKWTTYRKMAQDVVDTAIQHKLLAAAPCRTSELPLHGAPTDGQPNGAPHGTPDSYYGTDLATLRALPGADRMLVKASALTEAHVRYAARHELARTVEDVLARRNRALFLDAEAALLAAPEVARILAQELGHDEAWSRATLAEFEAVAAHYRLA

SEQ ID NO: 41555 - protein, 290 aa, Gibberella zeae PH-1
MADNAAREDALLDVEDKVHDKHSKPRGGKGRGKSGGGGGHGREVQVSKALSRLLRHQAANAGIQLDDEGFARLDTVLAWNPLRSLKVTFDDVQTAVSTDGKQRFTLKPNPDTNPSLDTKSTSPADYLIRANQGHSIKLESANLLTPVTVEAGNVPNRVLHGSFFYFWSAIVETGGLKPMNRNHVHCSAGTPEEGILSGMRRDAELIIEIDMEESLKDGIKWWLSDNGVLLTEGDEQGILSTKYFKLVTGRNIDVGVLWQDGQWVSDLPRGTKISPPFGKRGGRGGRQGGS

SEQ ID NO: 41556 - protein, 410 aa, Vitis vinifera
MAIAVNTSRFEGVTMAPPDPILGVSEAFRADNSEMKLNLGVGAYRTEELQPYVLNVVKKAENLMLERGENKEYLPIEGLAAFNKVTAELLFGAGNPVIEQQRVATVQGLSGTGSLRLAAALIERYFPGAKVLISSPTWGNHKNIFNDARVPWSEYRYYDPKTVGLDFDGMISDIKAAPEGSFVLLHGCAHNPTGIDPTPEQWEKIADVIQEKNHIPFFDVAYQGFASGSLDADASSVRLFAARGMELLVAQSYSKNLGLYAERIGAINVVCSSADAAARVKSQLKRIARPMYSNPPIHGARIVANVVGDPALFNEWKEEMELMAGRIKNVRQKLFDSLSAKDKCGKDWSFILKQIGMFSFTGLSKVQSENMTNKWHVYMTKDGRISLAGLSLAKCEYLADAIIDSFHCVS

SEQ ID NO: 41557 - protein, 303 aa, Triticum aestivum
HASDLHMQFLRSAAYCSGDLASSARKAFLRMDEMMKGQRGWRELAELGEKGPKFTGMLESIIWSPKAGDADKLGDGWHSEEGPHSDFSGPTCGSTACVAIIRNDQLVVANAGDSRCVISRKGRDHELSRDHKPELQSEKERIENAGGYIVAGRVNGSLNLTRAIGDMEMKENKLLPAEKQTVSAEPEVNTVTLSEDDEFIVLACDGIWDCMSSQQVVDFVHEKLKTEDSLSAVCEKVLDRCLAPESGGEGCDNMTMILVVLKKPTDSAATSSSEQSPVTPTKSAATASSEQSAVTDEEMRPRI

SEQ ID NO: 41558 - protein, 522 aa, Oryza sativa Japonica Group
MAISLITSLLFSLPQQWQPVVLTGLLPVIVSLVLLARKGRLKMPPGPEQVPLLGNLHQLAGPQPHRALRDLARVHGPVMRLRLGKASAVVLTSAEAAWEALRGHDLDCCTRPVSAGTRRVTYGMKNVAFAPYGAYWREVRKLLMVELLSARRVKAAWYARHEQVEKLLSTLRRAEGKPVALDEHILSLSDGIIGTVAFGNIYGSDKFSQNKNFQHALDDVMEMLSGEGSSAEDLQLPAAVGRLVDRLTGFAARRERIFRQLDSFFEMVIEQHLDPNRAPPENGGDLVDVLIGHWKKNEPRGTFSFTKDNVKAIIFSTFVAGIDTNAATILWAMSELARKPRVLKKVQAEIRAAVGVNGRVQPDDITKLSYLRKVVKETLRLHPPTPLLLPRETMRHIQISGYDVPAKTRIYVNAWAIGRDPASWPDEPEEFNPERFEANEIDFKGEHPELMPFGTGRRICPGMAMAMANVEFTLANLLFAFQWSLPEGTTPDNVCLEEEGRLVCHRKTPLVLVPTVYRHGLE

SEQ ID NO: 41559 - protein, 947 aa, Neptuniibacter caesariensis
MKRMLINATQPEELRVALVDGQRLYDLDIESGSREQKKANIYKGKITRIEPSLEAAFVDYGAERHGFLPLKEISREYFTQPPTRGSRPNIKEVLKEGTEVIVQVDKEERGNKGAALTTFISLAGRYLVLMPNNPRAGGISRRIEGEDRAQLKEALSGVNIPKQMGIIVRTAGVGRSSEELQWDFEYLQTLWTAIKQASEEKPAPFLIYQESNVVIRAVRDYLRSDIGEVLIDDPQVFEDAKNFVKQVMPTYESKIKHYSEQTPLFNRFQIETQIETAFQREVTLPSGGSIVIDPTEALVSIDINSARATRGGDIEETALHTNLEAADEIARQLRLRDIGGLVVIDFIDMTPIKNQREVENRLRDALKLDRARVQMGRISRFGLLEMSRQRLRPSLAETRGVVCPRCNGQGTIRDTESLALSILRLIEEESGKDRTAQIRAILPVTVATYLLNEKRHAVHDIELRQDVRVVIVPNPNMETPHYEVVRLRDDHTVATTNDASYTMQPEPEDDDPIEASSTQAAPAREQAAVRSVAPKTPAPEAAQAEQQPAAEKAKAAPAPAPSASLGSKVLGLFKGIFGGSEQQPEEKVEEKTEEKDKKKRPKRQRNERNDSGRKRRRRDNDRKQRNKQNDEIITVQPEPDQPLTSNEEKPKRRRRKRKSDTDKAESKSTENLNQSQDSAEEKEEAPRNPRRRGRRRRTTERSAKRSNESQATQTEKTEAHSEAPSDTANTVSMENQEQSPAAEVKDAVATTDTATPEPTAENNKQETTLADSTATEKPEAEAVEATTQEEKAESATAEAPAVETTPTPEISNDAESKPAENQGDTEGKETKEAKKASEIEQPSVAEAEIQPKPEIMAEAAEDNSTEDTVKAEAPVAEQSPEAQTEKPVAEDKPLEADAPSTEKAESDNTQQATQQDAPVRKRRTRRAPNDPREVRRRSATTETSDDK

SEQ ID NO: 41560 - protein, 212 aa, Cryptococcus neoformans var. neoformans B-3501A
MANKPPPQPLVQVPALFSIVEPGVYRSASPTPSQVPFLAGLNLKTIISLTPEHPIKPLLQFVRTTGISFVHLGLTHWRRPGTDWRPVRYEIIKTALEAYILDTRAHPVLLIDPLGVHQTGCLVGALRMMQGWNFASALMEYRAHAGSKHRYVDEQYIELFDSDLINLPAPQYRPSWWLACDEADPQQVEALASASGGAGLLADTNGRTQSIV

SEQ ID NO: 41561 - protein, 539 aa, Malus x domestica
MASINPYCSSTALSPSPGHTILYPGTSLAANGRLSGFVTPSVSWKLFFHSKGSIKARALLGEDGLLSYPNGNPTGSEIQPDALGFGTVSAETTPTFSGFSSENDEGDLDHPIHGFSSIPEAIEDIRQGKMVIVVDDEDRENEGDLIMAASLATPEAMAFIVKHGTGIVCVSMKGEDLERLQLPLMVTQNEEKLCTAFTVSVDAKRGTTTGVSARDRAATVLALASRDSTPEDFNRPGHIFPLKYREGGVLKRAGHTEASVDLAMLAGLDPVAVLCEIVDDDGSMARLPKLLEFARAENLKIVSIADLIRYRRKRDKLVERAGVARIPTMWGPFEAYCYKSLLDGIEHIAMVKGEIADGQEILVRVHSECLTGDIFGSARCDCGNQLALAMKQIEAAGRGVLVYLRGHEGRGIGLGHKLRAYTLQDAGRDTVEANEELGLPVDSREYGIGAQILRDLGVRTMKLMTNNPAKYIGLKGYGLAIAGRVPLLAPITMENRKYLETKRAKMGHIYGSKSNGHVNGTIDESSSKIDNQSNDVSET

SEQ ID NO: 41562 - protein, 149 aa, Ehrlichia chaffeensis str. Arkansas
MSNDHINILIVVSQFYSDVADLLLNGAVDQLKKYSKPVKYDIVYVPGSFEIPAAIVFAIMSDRHHYDGYIALGCVIKGQTDHYYYVCKGVTTALSEIATHHAVPMGFGVITAGSLEIAMARADINKRNVGGNAAKAALTMIELHNKFLS

SEQ ID NO: 41563 - protein, 413 aa, Methylobacillus flagellatus KT
MSTKIKVPTTGEKISVNADNSLNVPDHPIIPFIEGDGIGVDITPPMRHVVDSAVAKAYGGKRAIAWMEVYAGEKAVKTYGDNTWLPDETLKAVKDYVISIKGPLTTPVGGGIRSLNVTLRQELDLYVCLRPIQYFQGVPSPVKHPEKTNMVIFRENTEDIYAGIEWAAGTDEVKKVVDFLSDMGVRKKIRFPEASAIGIKPVSIDGSKRLVRKAIQYAIDNNRKSVTIAHKGNIMKFTEGGFKTWGYEVAKEEFGAVEIDGGPWCKLPNGIIIKDCIADAFLQEILLHPADYDVVATLNLNGDYISDALAAQVGGIGIAPGANISDTVAMFEATHGTAPKIAGKDIANPSSLILSAEMMLRHLGWTEAADLVINGVAKAIQAKRVTHDFSSQMEGATQVGSAEFGAEIVKHMS

SEQ ID NO: 41564 - protein, 513 aa, Myxococcus xanthus DK 1622
MTPAHKVLLCILDGWGIRQERDNNAIVLAGTPHLDKLASPYPFTELQTAGLAVGLPEGQMGNSEVGHTNIGAGRIVYQDLVRINRAAESGELAQNPVLRAALDGVKADGKALHLLGLVSPGGVHSSMDHLFALLKAAKERNVAHVYVHAFLDGRDTPPQSALGYVEELERFLHETHTGRIATVTGRFYAMDRDKRWDRVHQAYEALVFGRGPKAPDALSAIRASYAEKVTDEFVKPTVLAAGDGTPVGRIQDGDAVIFFNFRADRARELTQALAFPEFKEFDRGGLRLGRYVCMTQYDETFKLPALFEPDQPQDIFPELLSRQGLRQFRTAETEKYAHVTFFFNGGREVVYAGEDRHLVPSPRDVKTYDLKPEMSAYEVTAELVKRLDSGKYDFALVNFANPDMVGHSGRLDAAMKAVKAVDECLGALGKACERNGWVLAISADHGNCEQMVDLETGEPHTAHTLNPVPFHLIHPDFRGQKLRPGILADIAPTLCKVMGLPQSKEMNRQGLLP

SEQ ID NO: 41565 - protein, 411 aa, Medicago truncatula
  misc_feature (368)..(368): Xaa can be any naturally occurring amino acid
  misc_feature (377)..(378): Xaa can be any naturally occurring amino acid
  misc_feature (382)..(383): Xaa can be any naturally occurring amino acid
  misc_feature (386)..(386): Xaa can be any naturally occurring amino acid
MRQHKQVASAARPKILYLVFAAAFFSLLLLFFIQSSFFSGSVFSDRRNSESIRDLFQFQSTVKQCVANRGLGLTADIIDHCTLVLKYPEGTNSTWYNQQFKKFEPLEYTYDVCEAILLWEQYRNMTTVLTREYLDVRPGGWVDYAPLRIAQLGAKKCYNKTLCEEQLNILLPAKPPFHPRQFRTCAVVGNSGDLLKTEFGKEIDSHDAVFRDNEAPVNEKYAKYVGLKRDFRLVVRGAARNMVPILNGSDDEVLIIKSLTHREINAVIKTLPNPVYLFQGIVLRRGAKGTGMKSIELALSMCDIVDIYGFTVDPGYTEWTRYFSAPRKGHNPLQGRAYYQLLECLGVIRIHSPMRSKRRQDWSDVPSXEMISQAHAXXWHLXXSSXDKAGGKGQFGNCKVWGNVDPNKGGP

SEQ ID NO: 41566 - protein, 211 aa, Brassica napus
MSLILRFRQHLSTRLSQTSRSPLASLLNRSFGQPARKQDEEEEEEEIDQRKLPTDYDPATFDPTEHRSPPTDRVFRLVDEISSLTLSEISELGAIILKKRGITETPTVAVMKPGAVGAAGIAQGGGGGGGGGASEEAKVEKTVFEIKLEGFEASGKIKIIKEVRSFTDLGLKEAKELVEKTPSVLKAGVSKDEGEKIVEKLKALGAKVVLE

SEQ ID NO: 41567 - protein, 397 aa, Bacillus pumilus SAFR-032
MKKSYLSETVQSIQPSGIRKFFDLAATMEGVISLGVGEPDFVTAWNVREASIMSLEQGLTSYTANAGLLSLRKELSDYLYKRFHIDYSPEEELIITVGGSQALDLAFRAILNSGDEVIIPEPCFVAYGALTTLAGGVPVYLSTSAEKDFKADSADLRTKLTPKTKAILLCSPSNPTGSVYSKEELEDIAQFAKEHDLLVITDEIYAELTYDEAFTSVAAIQDMKERTILISGFSKGFAMTGWRLGYVAAPPVLRDAMLKIHQYSMMCAPAMAQYAAEEALKNGLEDVEKMKKSYRRRRNLFVGSLNELGLACHQPNGAFYAFPSIKSTGMTSEQFAEELLLSEKVAVVPGNVFGPSGEGHIRCSYASSLDHLQESLSRIQRFLQERQVKAEAPVIIK

SEQ ID NO: 41568 - protein, 387 aa, Malus x domestica
MRSHKAASSNNHLNRRPTILYLVCAVAFFSLFLFAIQSSLFAGNQKLHLHTQHDVRVLSEFRSTVKQCVANRGLGLTAHIIDHCNLTLKFPEGTNSTWYNEQFKTFEALEYHYNVCEALLLWEQYRNMTTVLTREYLDVRPKGWEEYAAQRIAQLGTKKCYNKTLCEEHLNVILPAKPPFHPRQFRTCAVVGNSGDLLKTEFGKEIDSHDAVIRDNEAPVNEKYAKYVGMKRDFRLVVRGAARNMVAILNGSADEVLIIKSVTHKDFNAMIKSITNPVYLFQGIVLRRGAKGTGMKSIELALSMCDIVDIYGFTVDPGYTEWTRYFSTPRKGHNPLQGRAYYQLLQCLGVIRIHSPMRSKRKQDWTDVPSREMIRRAHASALRLHMG

SEQ ID NO: 41569 - protein, 338 aa, Salmonella typhimurium LT2
MIIERARELAVRAPARVVFPDALDERVLKAAHYLQQYGLARPVLVASPFALRQFALSHRMAMDGIQVIDPHSNLSMRQRFAQRWLARAGEKTPPDAVEKLSDPLMFAAAMVSAGEADVCIAGNLSSTANVLRAGLRVIGLQPGCKTLSSIFLMLPQYAGPALGFADCSVVPQPTAAQLADIALASADTWRAITGEEPRVAMLSFSSNGSARHPNVANVQQATELVRERAPQLLVDGELQFDAAFVPEVAAQKAPDSPLQGRANVMIFPSLEAGNIGYKITQRLGGYRAVGPLIQGLAAPLHDLSRGCSVQEIIELALVAAVPRQADVSRERSLHTLVE

SEQ ID NO: 41570 - protein, 153 aa, Streptococcus pneumoniae
EHFIRGQYRSGKIDGMKYISYRSEPNVNPESTTETFASGAFFVNSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 41571 - protein, 858 aa, Arabidopsis thaliana
MKSIHGFLLFLITAYVILESVQAQDQLGFISLDCGLVPKNATYTEKTTNITYKSDANYIDSGLVGRISAEYKAQLQQQTWTVRSFPEGERNCYNFNLTAKSRYLIRATFTYGNYDGLRQVPKFDIHIGPSKWTSVKLDGVGNGAVLEMIHVLTQDRLQICLVKTGKGIPFISSLELRPLNNNTYLTQSGSLIGYDEDIHDRVWVRQFGNGLKSISTDLLVDTSNPYDVPQAVAKTACVPSNASQPLIFDWTLDNITSQSYVYMHFAEIQTLKDNDIREFNITYNGGQNVYSYLRPEKFEISTLFDSKPLSSPDGSFSLSFTKTGNSTLPPLINGLEIYKVLDLLELETDQDEVSAMINIKATYDLSKKVSWQGDPCAPKSYQWEGLNCSYPNSDQPRIISLNLAENKLTGTITPEISKLTQLIELDLSKNDLSGEIPEFFADMKLLKLINLSGNLGLNSTIPDSIQQRLDSKSLILILSKTVTKTVTLKGKSKKVPMIPIVASVAGVFALLVILAIFFVVRRKNGESNKGTNPSIITKERRITYPEVLKMTNNFERVLGKGGFGTVYHGNLEDTQVAVKMLSHSSAQGYKEFKAEVELLLRVHHRNLVGLVGYCDDGDNLALIYEYMANGDLKENMSGKRGGNVLTWENRMQIAVEAAQGLEYLHNGCTPPMVHRDVKTTNILLNERYGAKLADFGLSRSFPVDGESHVSTVVAGTPGYLDPEYYRTNWLSEKSDVYSFGVVLLEIVTNQPVTDKTRERTHINEWVGSMLTKGDIKSILDPKLMGDYDTNGAWKIVELALACVNPSSNRRPTMAHVVTELNECVALENARRQGREEMHTSGYVDFSRSSASEFSPGAR

SEQ ID NO: 41572 - protein, 527 aa, Oryza sativa Indica Group
MAPANVLYAALLVPMVLYLAVTRRRSRRLPPGPAGLPLVGSLPFIDPNLHTYFAGLAAKHGPILSIRLGSKVDIVVTSPELAREVLRDQDSVFANRVMPDAGNAVSFGGVQNIVGNPVGPMWRLLRRLCVHEMLSPSGLANVHDLRRREFRSTLRYLHTKSGEPVDLGAQMFLNTMNVITSAMWGGTIGSESERAAVGSEFRGLVAEVTELLGTPNVSDFFPALAPFDLQGIRGKMERFRSRFDLMFAKIIQQRMKAQQDGGETATDFLECMLKMEKEGGDGKAPFTMDNVKALLLDMVVGGTETTSNTVEWAMAEMLQNPQVLKKAQQELDSVVGRDEVVEEWHLPQLHYLRMVIKETLRLHPALPLMVPHSPSAASTVSGYHVPEGSRVFVNVWAIQRNPLVWNEPLEFNPERFAGDEGHKWDFTGSQFDYFPFGSGRRICAGIAMAEKMTAYSVAMLLQAFDWKLPQGVQPDLSEKFGIVMKKAAPLVAIPTPGYLSLSCTISEASFYLAKKRKKHVQPAQPNS

SEQ ID NO: 41573 - protein, 665 aa, Oryza sativa Japonica Group
MKINLWRAVHDCLPTGFQLRKRHIKALDGCFFCGRDDQVEHIFIQCHFAVAVWQDVKENQPQPHRRRPAATATVATSSASLPAPREPQCHSRQCRRPATVLSPPTSRCCHHRYEICAVATVAVAPCSRAVVADDVAASSAVPPPPRVCSATAGYRYPKYSPRCYYLAHWEARNNAKNNNESIHPKRVAQKFFAYVDMIVQHCYKAQAAPRGDSSPSIPRWTPPPVGTVMINCDAALFQSSCQMGIGFLIRDHDGRCLLALNERVQNVTQPELAEAVAIRRALSLAKEEGYQKAPVVASSSSRPPPPPPFPSRRGVAVAVAPPLRASHPDTARRVSVSPAAVEPPPKPRALLDAIKRSLLDSLAALKKPALALLLAGALLAAAGPHHGAALAASGGRVGGSAFSSRSSSPPSSYGYTAPAPRGGYSAAPFYSPSPFVSVGPAVGIGFGGSSFFFVLMGFAAFLYLAGFLSDSSGGSVLTETDKTTVLKLQVGLLGMARSFQKELDQIAEKADTSTPAGLSYVLTETTLALLRHPDCCISAYSSVDVKRSIDDGEKRFNQLSIEERGKFDEETLVNVNSIKRQKAGSQRSSGFSNEYIVITILVAAEGVHKLPSINGSGDLKTALQKLGAIPSRKILAVEVLWTPQNENDTLSERELLEDYPLLRPL

SEQ ID NO: 41574 - protein, 454 aa, Zea mays
GDLVELEALDLSSNTLSGSVPHSLDKLSKLTSFNVSMNFLTGAIPSSGSLVNFNETSFVGNLGLCGKQINLVCKDALQSPSNGLQSPSPDDMINKRNGKNSTRLVISAVATVGALLLVALMCFWGCFLYKNFGKKDMRGFRVELCGGSSVVMFHGDLPYSSKDILKKLETIDEENIIGAGGFGTVYKLAMDDGNVFALKRIVKTNEGLDRFFDRELEILGSVKHRYLVNLRGYCNSPSSKLLIYDYLQGGSLDEVLHEKSEQLDWDARINIILGAAKGLSYLHHDCSPRIIHRDIKSSNILLDGSFEARVSDFGLAKLLEDEESHITTIVAGTFGYLAPEYMQFGRATEKTDVYSFGVLVLEILSGKRPTDASFIEKGLNIVGWLNFLASENREREIVDLNCEGVQTETLDALLSLAKQCVSSSPEERPTMHRVVQMLESDVITPCPSDFYDSE

SEQ ID NO: 41575 - protein, 465 aa, Acidithiobacillus ferrooxidans
MSHFSFIEDPRQDPKKLDVEERREAFREIYQSFDLGSAQLQADRCLHCGNPYCEWKCPVHNYIPNWLQLIVENRLEEAATLSHQTNTLPEICGRICPQDRLCEGACTLNATGGAVTIGNLERFVTEEALARAWQPDMPDILPNGKRVAVVGGGPAGLGCADILNRAGTEVVVFDRYPAVGGLLTFGIPSFKLEKAVVARRANLLQEMGIRFQLDTEVGRDISLGKLLEDFDAVFLGMGTYTAKTGDFPGEKLPGVLKALSYLIANTRHLMQLPDPTLPYISLSGKRVVVLGGGDTAMDCLRTAIRQGARQVTCVYRRDEENMPGSRREVANAREEGVHFLFHRQPVEVVGDAASGSPGRASGGDPSGEPDARGRRHPEIIPGSEQVLDADVVIIAFGFDPSPAPWFAEHHITTDSRGRISTNAQFQTSNPRIFAGGDMRRGSDLVVTAVDEGRRAAQGILDYLGV

SEQ ID NO: 41576 - protein, 568 aa, Zea mays
MAAAAEIGGFAAARVAVATLRPAAHPAPAAAPQQPRRAVAAQSLRTTATEALTADLAGTTNGAVHARMNSKATSEITSQAVTANSRRKTKIVCTIGPSTNTREMIWKLAETGMNVARLNMSHGDHQSHQKVIDLVKEYNAQNTDGNVIAIMLDTKGPEVRSGDVPEPIMLKEGQEFNFTIKRGVSTEDTVSVNYDDFINDVEAGDILLVDGGMMSLAVKSKTTDTVKCKVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEDVPLLQAEIVQTCRSMEKPVIVATNMLESMIDHPTPTRAEVSDIAIAVREGADAIMLSGETAHGKYPLKAVKVMHTVALRTESSLYNPTTSPSLVASAQGLQNEDFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 41577 - protein, 242 aa, Zea mays
  misc_feature (212)..(212): Xaa can be any naturally occurring amino acid
MKLNIANPATGQQKSIEIDDERRTRIFYEKRMGQDVEADALGDEFKGYTFRISGGNDKQGFPMKQGVLTPKRVRLLLGEGHSCFRARRVGERKRKSARGCIVASDIAALSLIVIKQGENDIPGLTDTVLPRRLGPKRATKIRRFFNLTKEDDVRKFVVRREVKSAKNPDAKPYTKAPKIQRLVTPIRLQRRRHLRSLNRRRNEAQKAQLAEXQEVVAKRQAERKAKLAAVKSRKHAAAAAQH

SEQ ID NO: 41578 - protein, 398 aa, Streptococcus pyogenes
MSLKNQLGQLALEQAKTFGGKLEVQPKVDIKTKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLKKSLDEVSIVVNGGGSAGLSITRKLLAAGATKVTVVDKFGIINEQEAAQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPDDALSTTNIIPDAFKEGVAEIVAKSVRSVVLKSEGHHHHHH

SEQ ID NO: 41579 - protein, 40 aa, Oryza sativa
VAPVQGLALLHLHGAKCMLHEARVVKKNIKYVLRSDVVFA

SEQ ID NO: 41580 - protein, 212 aa, Thermoplasma acidophilum
  misc_feature (1)..(1): Xaa can be any naturally occurring amino acid
  misc_feature (13)..(13): Xaa can be any naturally occurring amino acid
  misc_feature (122)..(122): Xaa can be any naturally occurring amino acid
XGSDKIHHHHHHXLKIYVVDNGGQWTHREWRVLRELGVDTKIVPNDIDSSELDGLDGLVLSGGAPNIDEELDKLGSVGKYIDDHNYPILGICVGAQFIALHFGASVVKAKHPEFGKTKVSVXHSENIFGGLPSEITVWENHNDEIINLPDDFTLAASSATCQVQGFYHKTRPIYATQFHPEVEHTQYGRDIFRNFIGICASYREIQKENFQH

SEQ ID NO: 41581 - protein, 354 aa, Oryza sativa
MMVYAWGAVGGLLNATCGNATELIIALFALLKGKIEVVKCSLLGSVLSNLLLVLGTSLFCGGVVNLGARQPYDRNQSDVSTALLFLAVLCHSAPLLLRYAVAAGEHSVSATSAAASLDLSRACSFVMLASYVAYLFFQLKTHRQLFEPQEVDGGDAGDDDEEPALGFASALFWLALMTAVISVLSEYVVGTIEPTSQSWGLSVSFISIILLPIVGNAAEHAGAIIFALKNKLDITLGVALGSATQISMFVVPLSVLVAWIMGVQMDLDFKLLETGSLFMAVLVTAFTLQDGTSHYLKGILLLLCYIVIGACFFVARQPAASGTAVSLYVDYHIFVMISSIWCDRVANLSDSWNA

SEQ ID NO: 41582 - protein, 542 aa, Fusobacterium nucleatum subsp. vincentii ATCC 49256
MAKKSYEVLNDPFLNKGTAFTKEERKELELTGLLPPQIQTIEEQAEQVYAQYKSKEPLINKRRFLMEIFDTNRTLFYYLFSQHVVEFMPIVYDPVIAENIENYSELFVNPQNAVYLSIDSPETIEESLRNATKDREIRLIVATDAEGILGIGDWGTNGVDISVGKLMVYTAAAGIDPKSVLPVVLDAGTNRETLLEDKLYLGNRHKRVYGDEYYDFVDRFVQTAEKLFPRLYLHFEDFGRSNAANVLHKYWKTYPVFNDDIQGTGIITLAGILGALKISGEKLTDQRYMCFGAGTAGAGIADRIYQEMLQQGLSENEARSRFYLVDKQGLLFDDMNDLTPEQKPFARKRTEFNNANELTNLEAAVKAVRPTILVGTSTQPNTFTETIVKEMASYTARPIIFPLSNPTKLAEATAENLIKWTEGKALVATGIPADPVEYNGVTYEIGQANNALIYPALGLGAIASTAKLMTNEMISKAAHSLGGIVDTTKPGAATLPPVSKLTEFSQRVAEAVGQCALDQKLNREDITDIKEAIEKIKWTPKY

SEQ ID NO: 41583 - protein, 434 aa, Zea mays
  misc_feature (162)..(162): Xaa can be any naturally occurring amino acid
  misc_feature (175)..(175): Xaa can be any naturally occurring amino acid
  misc_feature (203)..(203): Xaa can be any naturally occurring amino acid
  misc_feature (252)..(252): Xaa can be any naturally occurring amino acid
  misc_feature (267)..(267): Xaa can be any naturally occurring amino acid
MRRKRSRGRERRLRSGRARGLRWAGGRISPVTAGGRAGGSRRSRLVGGRADLAGHIAAVLRIATVEACTERSRRGGWMADGRAARSRRFCGERADRAVAACTGGQARRLPSSAFISHRRRVFFSYTFRTAAENAPLPQIVVVGSADIYVEVHRSPLIGETAXAGGKGANLAACGXPTYLVARVGDDANGRLLEDALADAGGVXTDRVARAADAPSGHAIVMLMPHDHNSVIIVGGANMESWAAGIGSEDLDXIRKEGVLMQREIPDXVNPQAAQAAKSAGVPVIMDAGGMDTPLPRELLSLVDIFSPNETELARLTGMPTETFEQISMAAGKCHKMGVQEVLVKLGSQGSALFVEGEEPIRQPIVPATEVIDTTGAGDTFTSAFAVALVEGKPKRECMRFAAAAASLCVRVKGAIPSMPDRKSVMKLLESVGVE

SEQ ID NO: 41584 - protein, 187 aa, Xanthobacter autotrophicus Py2
MSLVNTPVKPFKTTAFKQGKFIDVSEADLAGKWSVFFFYPADFTFVCPTELGDLADHYEDFKKLGVEIYSVSTDTHFTHKAWHDSSETIGKVQYAMLGDASGAITNNFEVMRAGQGLADRGTFIVDPNGIIQAVEVTAEGIGRDASELLRKIKAAQYVASHPGEVCPAKWQEGEATLAPSLDLVGKI

SEQ ID NO: 41585 - protein, 387 aa, Saccharum officinarum
MAPRAAPALRVLPLALAAAIFSGLTAILVYLSGVSSSHGGARLSEADLAALAALRGGFSKCVDANGLGLKAVTGEDYCRVVIQYPSDTVSKWRDPITHKVEGLSFEFNLCEAVASWEQVRNSTTVLTKEYIDALPNGWEEYAWRRINKGILLNKCQNRSLCMEKLSLVLPETSPYVPHQFGRCAGVGNSGDLLKTKFGDEIDSYDAVFRENGAPTQNYTEYVGTKSTFRLLNRGSAKALDKVVELEETKKEILIVKTTIHDIMNQMIRELPITNPVYLMLGTTIGSSAKGTGLKALEFALSICDSVDMYGFTVDPGYKEWKRYFSEVRKGHTPLHGRAYYQMMECLGLVKIHSPMRGDPRRTVKWLPTRATIEAARVASEKLLNLQD

SEQ ID NO: 41586 - protein, 759 aa, Salmonella typhimurium LT2
MDEQLKQSALDFHEFPVPGKIQVSPTKPLATQRDLALAYSPGVAAPCLEIEKDPLAAYKYTARGNLVAVISNGTAVLGLGNIGALAGKPVMEGKGVLFKKFAGIDVFDIEVDELDPDKFINVVAALEPTFGGINLEDIKAPECFYIEQKLRERMNIPVFHDDQHGTAIISTAAILNGLRVVEKNISDVRMVVSGAGAAAIACMNLLVALGMQKHNIVVCDSKGVIYKGREPNMAETKAAYAVDDSGKRTLDEVIDGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMDSGVATRPIADFDAYIDKLTEFVYKTNLFMKPIFSQARKDPKRVVLPEGEEARVLHATQELITLGLAKPILIGRPSVIEMRIQKLGLQIKAGVDFEIVNNESDPRFKEYWSEYYQIMKRRGITQEQAQRAMIGNHTAIGAIMVQRGEADAMICGTIGDYHEHFSVVKAVFGYRDGVHTAGAMNALLLPSGNTFIADTYVNEDPTPEQLAEIAVMAAETVRRFGIEPKVALLSHSNFGSSNSLSASKMRETLERVRERAPDLMIDGEMHGDAALVESIRNDRMPDSPLKGAANILVMPNMEAARISYNLLRVSSSEGVTVGPVLMGVSKPVHVLTPIASVRRIVNMVALAVVEAQTTPL

SEQ ID NO: 41587 - protein, 253 aa, Myxococcus xanthus DK 1622
MDMDKVIVITGASSGIGAELARQAAAKGARLVLAARRKAELKVVAGQCGHEALAVVTDATRRADMERLRDAALARFGRIDVWVNNAGRGITRSVAELTDEDLETMWRDNVNSALYGMQAVLPHFQSRDAGQLVNVSSTLGRLPIVPHRSAYSAAKHALNALSACLRQELRETYPGITVTVVMPGVVATAFGDNALGGGPDSRGLPGAQRVEDAATVILDSIERPRAEVYTQAATQAQVERYYQDVEAFERGGT

SEQ ID NO: 41588 - protein, 515 aa, Coprinopsis cinerea okayama7#130
MLSVQTAVAKASLNRIPPLLSSVNVNNVAAKPSTSTLSNREALANATTKRRSHSMALAVNSPTEFFTSTIPSVTQRVKPIGFDEEPCTLGLQDGYSYARVEIGDRFGAQDRYEVVRKLGWGLYATTWLIKDRRDDAYHALKILNHYGTLLEAGEVDDPRRPRFFEREILARVSASDVAPGAKYCMKLLESFHIERETGKHLCLVMELGGMSVEDMRPLIGTNYSMPTAFVKTIVKQMCKALDYLHEECRVVHTDLKPSNILVTFSPKDTQELIDMTLKHRPVERYPPRRVLGETIRAMRSQPLPLPGFDQRNPLTWVFKLTDFGSAQWIGKRSATVVQPIRLRAPEVVLGHEWNEKIDIWSLGCLTFEFLTGRTLFRAQGGPHWRPEDDLLANQLELLSLTHFPSYFSQNSRYALYHLKEDGSLKNIPERMMYPKTLSEALARHKEAPINLDDTNKERDLALAFITRCLTLDPRDRPSAAQLLKHPWLRDFELGKPQPIPARMVLNSKRSRTVKF

SEQ ID NO: 41589 - protein, 414 aa, Methanococcus maripaludis
MFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 41590 - protein, 653 aa, Salmonella typhimurium LT2
MNRFIMANSQQCLGCHACEVACVMAHNDERHVLTSQRYQPRITVIKHQHQRSAVTCHHCEDAPCARSCPNGAIAHINDSVQVNAQKCIGCKSCVVACPFGTMQMVLTPVAPNQFKASAHKCDLCQGREQGPACVENCPADALQLVTEDSLTRLAKTRRLRTARQEIRPWHTVDTQHSGAASSKAERMQATPPRGEPDKLAIEARKTTFEEIYLPFRAAQAEREASRCLTCGEHSICEWTCPLHNHIPQWIELVKAGDIDAAVELSHQTNCLPEITGRVCPQDRLCEGACTLRDEYGAVTIGNIERYISDRALSKGWRPDLSDVQKSDKRVAIIGAGPAGLACADVLARHGVSATVYDRHPEIGGLLTFGIPAFKLDKSLLARRREIFSAMGIRFELNCEVGKDISLETLLESYDAVFVGVGTYRSMKADLPNEDAPGVYDALPFLIANTKQVMGLPALPDEPFIDTAGLNVVVLGGGDTAMDCVRTALRHGAANVTCAYRRDEANMPGSKKEVKNAREEGANFEFNVQPVELVLDTHGRASGIRFLRTRLGEPDGQGRRRPVPVPDSEFVMPADAVIMAFGFHPHGMSWLESHGVKVDNWGRIAASVESEFRYQTSNPKIFAGGDAVRGADLVVTAMAEGRHAAQGILDWLAK

SEQ ID NO: 41591 - protein, 414 aa, Myxococcus xanthus DK 1622
MTALSQSEPSLSASSDSSTDALVQKAKRHLLQNYKQPPFVLARGQGARVWDMDGREYLDLIGGIATCALGHCHPEVVAAAKAQLDSLWHVSNVFYSQPQIDLAAQLTEWSGLSRAFFCNSGAEANEALLKLTRKVMKDRGTPERFEVISFDSSFHGRTLATVTATGQAKYQKGFEPLPAGFTHVPYGDLEAVRKAVGPATAAILVEPIQGEGGVRMAPLGFLVGLRALCDEHGLLLLVDEVQTGMGRTGKPFGFMHEGIVPDGISVAKALGNGLPIGAMLCKEELGASLTPGTHGSTFGGNPVAAAAANAVVRILRRPGFLDEVQEKGAYLLARARELQGRLPAGRIQAVRGQGLLVGVELDREVAPVIAQLRGEGLLVNAAGDRTLRFAPPFIVTVRELDEGLSILERVLAAN

SEQ ID NO: 41592 - protein, 133 aa, Glycine max
MHQAISHRSFIPIGARGMPHAGGIKESNGTYPSKAATMVSENAVVIIGKRGCCMCHVVKRLLQGLGVNPPVYEVDEDHEAAVALHLSPQGAETVQFPAVFLAGKLFGGLERVMATHISGELVPILKDAGALWL

SEQ ID NO: 41593 - protein, 501 aa, Candida glabrata CBS 138
MDSRHNVIDLVGNTPLIELKKLPKAYGIRPRVFAKLELYNPGGSIKDRIAKSMIEYAEEQGIIHPSRSTLIEPTSGNTGIGLALIGAVKGYRTIITLPEKMSNEKVSVLKALGAEIIRTPTEAAWDSPESHIGVARRLEKEIPGAIILDQYNNMKNPEAHYFGTGREIQKQLEDLKLFSHLNAVVAGAGTGGTISGISKYLKEQNPEIKIVGADPVGSILAQPENLNETEITSYKVEGIGYDFIPEVLDRSLVDVWYKTDDKPAFKYARQLISNEGVLIGGSSGSAFTALVEYCNDHPELSEDDVLVAIFPDSIRSYLTKFVDDEWLKTNDLWDDEILKRVDFDEKKKPATDDVFKGATVKDLHLKPVVAVKDNALVSDVISILRDNAFDQLPVLTQDGKLTGLVTLSQLLKKLSTGKVNNTDTIKNLYLDFRKLNNFDEVSSYNENKSGKKKFVQFTSESTLAELNKFFEKNSSAVITDGLKPVHIVTKMDLLSYLASTA

SEQ ID NO: 41594 - protein, 428 aa, Xanthobacter autotrophicus Py2
MSENAALQARRTKAIPRGIATAYPVFAQKAEGSEVWDADGTRYIDFAGGIAVLNTGHRHPRVLAAVRAQLDAYTHTAFQIVPYEPYVALCERLNAIAPFTGAAKSILFSTGAEAVENAVKIAKAATGRTGVISFSGGFHGRTALTMALTGKVLPYKKKFGISPPGIFHLPFPCADHGVSVADTLKALDYLFRADIGPQDVAAIIIEPVQGEGGFLPAPTELLVALRQTCDAHGIVLIADEVQTGFARTGRMFGIEHSGVEPDLVTVAKSLAGGFPLSGVIGREAIMDAAEPGGLGGTYAGNPIACAAALAVLDVIAEEKLVERANAIGARIKDALTRMALRNDAVAIGSIRGPGAMVAFDVVKKRGTVEPDADAARRVTQAALADGLILITCGVYGNTIRLLNPLTIPDALLDEGLGKLERALVAGAA

SEQ ID NO: 41595 - protein, 182 aa, Ustilago maydis 521
MGSSLSRAMGKIFGNKEMRILMLGLDAAGKTTILYKLKLNQSVTTIPTVGFNVETVQYKNVKFNVWDVGGQDKIRPLWRHYYTGTQGLVFVVDSQDRDRIDEARQELHRIIGDREMRDCLLLVFANKQDLPGAMSPAEVTEKLGLHRMRDRSWFVHPSCATSGEGLYEGLSWLSQNVSTTKS

SEQ ID NO: 41596 - protein, 237 aa, Vibrio parahaemolyticus RIMD 2210633
MSSIQQNIEHITSQIRRDEQKCGRSPESVQLLAVSKTKPVEAILEAYQAGQTAFGENYVQEGVSKVQHFAEHYPDNRIEWHFIGPIQSNKSRLVAEHFDWVHTIDRAKIAQRLNEQRPQELKPLQVLIQVNTSGEDSKSGVSDAEIFELAELISRLPNLTLRGLMSIPANVSDYDAQLREFEKLATLKQTLEQQYPEIDTLSMGMSGDMTAAIEAGSTMVRIGTAIFGARDYSTKSE

SEQ ID NO: 41597 - protein, 272 aa, Vibrio parahaemolyticus RIMD 2210633
MEHKKIAFIGAGNMVRAIVSGLVANGYPAQNIVATAPSEARRLPLEQDFGIRTTSDNMLAASEADVVVLSVKPQMMADVCKPLQSIDFSNKLVISIAAGINCSRLDEMLATKLNLVRVMPNTPSQLGLGMSGLFAPEHVKEQDRAFAAELMQAVGKVCWVEQESGINNVIAAAGSAPAYFFLFMEAMQAEAIAQGFDKETARLLVQQAALGAASMVVSNPDTELSTLRENVTSKGGTTAEALRTFNEHQLTDIVAKAMQAAVARAEEMEKLF

SEQ ID NO: 41598 - protein, 213 aa, Zea mays
MEWLSWRTVCCLSVLCTVLFLRPVEGIRFVIDREECFSHNVEYEGDTVHVSFVVIKADTPWHYSEEGVDLVVKDPNGAQVRDSRDKTSDKFEFIVQKRGVHRFCFTNKSPYHETIDFDVHVGHFSYFEQHAKDEHFAPLFEQIAKLDEALYNIQFEQHWLEAQTDRQAILNENMSRRAVHKALFESAALIAASVIQVYLLRRLFERKLGTSRV

SEQ ID NO: 41599 - protein, 487 aa, Arabidopsis thaliana
MQPWRRKFPLFETGVTMKQRKNSNLSIFVVVFSVFLFGIFMYNEDVKSIAEFPFSTSKPHDVHDEATPITEITTLPVQESIKNSDPIQESIKNADSVQDSVKDVAEPVQEEVSKTEEVKKIELFAATEDEEDVELPPEECDLFTGEWVFDNETHPLYKEDQCEFLTAQVTCMRNGRRDSLYQNWRWQPRDCSLPKFKAKLLLEKLRNKRMMFVGDSLNRNQWESMVCLVQSVVPPGRKSLNKTGSLSVFRVEDYNATVEFYWAPFLVESNSDDPNMHSILNRIIMPESIEKHGVNWKGVDFLVFNTYIWWMNTFAMKVLRGSFDKGDTEYEEIERPVAYRRVIRTWGDWVERNIDPLRTTVFFASMSPLHIKSLDWENPDGIKCALETTPILNMSMPFSVGTDYRLFSVAENVTHSLNVPVYFLNITKLSEYRKDAHTSVHTIRQGKMLTPEQQADPNTYADCIHWCLPGLPDTWNEFLYTRIISRS

SEQ ID NO: 41600 - protein, 241 aa, Methanosarcina mazei Go1
MIITGHLILVRHGEPGLKPGERLSGWIDIPLSRKGIEEALECAKALENIEIDIAFASDLVRTQETLFIILSGQKKTGVVVHEKTEDKVPPEKLDWYSYPEKLGEDLIPVYTTPALNERYYGKLQGRKKQKMEEKYGAEQVANWRWNFEPGPPEGESLKAVYERTVPYFRKKVMPALEGGKNVLICAHQSSLRALVKYIEDISDKDIREVRLSTGELAIYHFSEGKLVRENEELGPELKRNI

SEQ ID NO: 41601 - protein, 272 aa, Arabidopsis thaliana
MRARLVVFPIKGKKWCFSRSVDPFAAQSPSGVTPTTVRGLWKKISSESKPINANAELLVDFISDKMNKAWVGLEKAPDGSIKNKIHGFGLKLLARVKPSEIFLKSISKEVTSVQVTYPPSLDPRLVRRRLRHIAMSGTILHKKYLVGSVTLLPLTSAFMVLPLPNIPFFWVLFRTYPHWRALQGSEKLLKLISNEANPDKPDSTDDADESKNSNTKPEQKSQSPTCILLPSEELYQLIREASEEGLDEATIIEICKSFDLNKNDVLKYRNLV

SEQ ID NO: 41602 - protein, 306 aa, Vibrio parahaemolyticus RIMD 2210633
MKPTAEILTDILAEVRPLIGQGKVADYIPALAKVPNNKLAIAVYTNEGEVIKAGDADESFSIQSISKALSLTLAMCLYKQEEIWARVGKEPSGQAFNSLIQLEMEQGIPRNPFINAGAIVVADLLQSRLSAPRQRLLEFVRQLSGDTHIVYDKVVAASEMMHGDRNAAIAYLMRSFGNFENEVIPVLQNYFHACALKMSCVDLAKTFSYLANKGTSVQTGKPVVSPTQTKQLNALLATCGLYDGAGEFAYRVGMPGKSGVGGGIIAVVPGEMTIAVWSPELDASGNSLAGTKALELLSERIGRSIF

SEQ ID NO: 41603 - protein, 471 aa, Salmonella enterica subsp. enterica serovar Montevideo
MITPIIMAGGNGSRLWPLSRTLYPKQFLCLDGSQSMLQTTITRINNLNASDPIVICNEQHRFIVAEQLKELSKSSGDIILEPVGRNTAPAVALAALKCLKKNALLLVLAADHIIKDEETFCKTIQDARKYAEAGKLVTFGIVPTMPETGYGYIRRGQALFSAENDCSLAFRVAEFVEKPNLETAQSYLDSGEYYWNSGMFLFRADRYIEELKIRPDIYKACSLAMESAVTDLDFIRVDEDSFCACPDESIDYAVMEKTNDAVVVPLNAGWSDVGSWSSLWEISDKDSNGNVTKGDVLSHNADNCYLHAETGLVTAVGVKDLIVVQTKDAVLVANTNCVQDVKKIVEKIKLENRHEHITHREVYRPWGKYDSIDFGERYQVKRITVKPGEGISEQQHYHRAEHWIIVAGTAKITIKGEVKILTENESVYIPVGVKHCLENPGKIALELIEVRSGAYLGEDDIVRFSDKYGRN

SEQ ID NO: 41604 - protein, 312 aa, Fusobacterium nucleatum subsp. vincentii ATCC 49256
MIFKKNKELYIFFNEFFYFFSFSYTIKLKIKFNRRVFMLANSVIDLIGNTPLVKINNIDTFGNEIYVKLEGSNPGRSTKDRIALKMIEEAEKEGLIDKDTVIMEATSGNTGIGLAMICAVKNYKLKIVMPDTMSVERIQLMRAYGTEVILTDGSLGMKACLEKLEELKKKEKKYFIPDQFTNVNNPKAHYETTAEEILKDMNNKVDVFICGTGTGGSFSGTAKKLKERLPNIKTFPVEPASSPLLSKGYIGPHKIQGMGMSIGGIPAVYDGSLADNILVCEDDDAFKMMRELSFKEGILGGISTGATFQSCS

SEQ ID NO: 41605 - protein, 509 aa, Cryptococcus neoformans var. neoformans JEC21
MHPQNSSTPSTNSPSTFSLPKSSISRKKPPGLDISKSILRPTRTAPVLPANGSSPSNFVSEADRLRDDIANLQLSSRSTGSNHSPEALDSPRAFQSDSSVASGLAKKEKSRDGKERGDKEKRKKKHKDKDGEDLVKDEDLEILHDLGAGNGGTVTKVWNKKRKCVMARKLILVDAKPSIRKQILRELQIMNDCDSPYIVGYYGCFPVDVHVGIVMEFMDAGSLDYIYRHHGAIDIDIVGKVAQAVLEGLIYLYDKHRIIHRDIKPSNVLANTRGEIKICDFGVSGELINSIANTFVGTSTYMSPERIQGAPYTIKSDIWSLGISLIELAVGRFPFSDSPDSEELSPSVSDFDPDPTLPRSVRRPKIESNSRHNGVSQSGGPHAMSILDLLQHIVNEPAPRLASRRRRFPQEAVAFVEGCLIKDPDQRRSPKELLSSSWITNLKTTKEDLQTWAQSMIIFRLRIFFNVDTLLCISLITISHIPVHHMPCVYLLLMTISSADEEMMHVWLM

SEQ ID NO: 41606 - protein, 322 aa, Bacillus anthracis str. Ames
MNILVTGGAGFIGSNFVHYMLQSYETYKIINFDALTYSGNLNNVKSIQDHPNYYFVKGEIQNGELLEHVIKERDVQVIVNFAAESHVDRSIENPIPFYDTNVIGTVTLLELVKKYPHIKLVQVSTDEVYGSLGKTGRFTEETPLAPNSPYSSSKASADMIALAYYKTYQLPVIVTRCSNNYGPYQYPEKLIPLMVTNALEGKKLPLYGDGLNVRDWLHVTDHCSAIDVVLHKGRVGEVYNIGGNNEKTNVEVVEQIITLLGKTKKDIEYVTDRLGHDRRYAINAEKMKNEFDWEPKYTFEQGLQETVQWYEKNEEWWKPLKK

SEQ ID NO: 41607 - protein, 469 aa, Oryza sativa
GPTWRATRRARGRSTSRCCVASTPPSPTSSSSPRTSSSTASTTTSTNGFWGNTQPRFQFIVMNRKNTENLTEDLLGGFEYQVQVPYIMYHNAADEITGIWFYDPQECEQVGYLFSRIQKAFSRVSPKAKVSVTESEYEKPEVVPAVPSNEDTLKQPTSSIMLLDNAKYDFLSALLKGAACVGATMDEASAVQSNKSVGMVHSSTHASPHAIPPQSPAIQSNKSFGMVHSSTQAPLAIPPQSPAIRSNKSVGMIHSSTHASPFDIPPQSPAVQSNKSVGMIHSLTHASHLAIPPQSPALHGLHPSQISAVPVMPHDAHRSSSTSTIQPTSLANPLFFPPMPSLQTASHAASSLCSAAPLHPPITVQQLQSAPLHQPFSLPTASSIQPPYGMPLLQPFPPPNPSPFLTSGVSYGRPVITRDQLKDVLLSLCQPCKLAPIFAQPLLGPHDSGVLYPLNDFMVSSVNHSFLLA

SEQ ID NO: 41608 - protein, 212 aa, Nicotiana tabacum
MGKVKLEPQESKNTINHFSHPHPLELITNQNFASSSSQLCSGCKIQAIGSIYTCKSCNFFLHTECSQMPQQITHPFDKEHHFTLLPKPIYPDGKFNCDACGENGDGFSYHCKTCGTDLHILCAVFPQCVTHWSHHHQLDLKFSPPYPGKSFCCDICKKVGTNHWLYRCQTCGFDAHLNCTTLQAPPHQSHIHQNPTTSRSAPQQQQHFTGNM

SEQ ID NO: 41609 - protein, 431 aa, Pantoea endophytica
  misc_feature (91)..(91): Xaa can be any naturally occurring amino acid
  misc_feature (228)..(228): Xaa can be any naturally occurring amino acid
  misc_feature (230)..(230): Xaa can be any naturally occurring amino acid
  misc_feature (367)..(367): Xaa can be any naturally occurring amino acid
  misc_feature (399)..(399): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGXNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDXFXKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRASSCRKITDXYAENAGIANLLLAPYFKKIADEYQQALRDVVXYAVQNGIPVPTFSAAVAYYDSYRAAVLPANLI

SEQ ID NO: 41610 - protein, 431 aa, Pantoea endophytica
  misc_feature (7)..(7): Xaa can be any naturally occurring amino acid
  misc_feature (424)..(424): Xaa can be any naturally occurring amino acid
MAVMGRXLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVRYAVQNGIPVPTFSAAVAYYDSYRAXVQPANLI

SEQ ID NO: 41611 - protein, 431 aa, Pantoea endophytica
  misc_feature (32)..(32): Xaa can be any naturally occurring amino acid
  misc_feature (46)..(46): Xaa can be any naturally occurring amino acid
  misc_feature (149)..(149): Xaa can be any naturally occurring amino acid
  misc_feature (419)..(419): Xaa can be any naturally occurring amino acid
MAVMGRNLALNIESRGYTVSVFNRSRDKTEEXIAENPGKKLVPFYXVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKXAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAVAYYXSYRAAVLPANLI

SEQ ID NO: 41612 - protein, 409 aa, Solanum lycopersicum
IGINYPGTKAELRGCINDVRRMYNCLLNRYGFAEEDITVLIDTDDSYTQPTGRNIRKALSDLVGSAESGDCLFVHYSGHGTRLPAETGEEDDTGFDECIVPCDMNLITDDDFRELVDKVPEGCQITIVSDSCHSGGLIDKAKEQIGESHKQGDDDEGHGSGFGFKNFLRRNVEDAFESRGIHLPGRHHRREEEEENFAESSVIETEDGDQVHVKSKSLPLSTLIEILKQKTGKDDIDVGKLRPTLFDVFGEDASPKVKKFMKIIFNKLQKNNEQGGGGGFMGMVGNLAQEFLKQKLDENDESYAKPAMETHVEGKQEVYAGSGNRGLPDSGILVSGCQTDQTSADATPAGGESYGALSNAIQEILAESDGPVTNEELVSKARKKMQKQGFTQRPGLYCDDHHVDAPFVC

SEQ ID NO: 41613 - protein, 149 aa, Glycine max
  misc_feature (82)..(82): Xaa can be any naturally occurring amino acid
  misc_feature (117)..(117): Xaa can be any naturally occurring amino acid
MIKSPRPTRAEATDVANAVLDGTDCVMLSGETAAGAYPELAVQTMAKICLQAESCVDYSAVFKSIMSSAPIPMSPLESLASXAVRTANSAKATLILVLTRGGTTARLVAKYRPSMPXLSVVVPELKTVEFDWICSDEGPARQSLIVRGV

SEQ ID NO: 41614 - protein, 431 aa, Pantoea endophytica
  misc_feature (40)..(40): Xaa can be any naturally occurring amino acid
MAVMGRNLALNIESRGYTVSVFNRSRDKTEEVIAENPGKXLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAVAYYDSYRAAVLPANLI

SEQ ID NO: 41615 - protein, 431 aa, Pantoea endophytica
  misc_feature (418)..(418): Xaa can be any naturally occurring amino acid
  misc_feature (427)..(427): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVVYAVQNGIPVPTFSAAGGYXNSYRAAVLXANLI

SEQ ID NO: 41616 - protein, 189 aa, Campylobacter upsaliensis RM3195
MLIKFQGKTPQVGDKVFIAQGAKVIGEVELGEDSSIWFNCVLRADFNFIKIGKRTNIQDLTTIHIWHREFDEKGVLKDRGYPTIIGDDVSIGHNCVIHACEIKNRVLVGMNSTIMDGVCIEEDSIVGAGSVVTKHKKFPPRSLILGNPAKFVRELNQEEVDFLKISAQNYVEFKNAFLKENSVTQKPIL

SEQ ID NO: 41617 - protein, 371 aa, Triticum aestivum
  misc_feature (72)..(72): Xaa can be any naturally occurring amino acid
MPISAPELSRRLLWAALLVAPLAAVLYQFPIHALYTKAVPATAAMDAGAELELEYDMPGVLRVHKSGRVRAXSDGVETVPPSPSGDPANGVASKDVVLDPAANISARLYLPSAVAAAAEPGKKLPVVVFFHGGAFFVHTAASPLYHRYCASLAAAVPAVVVSVDYRLAPEHPLPAAYDDAFAALKAVVSACRPNGAEPWLAAHGDASRVVLAGDSAGANMAHATAIRLGKERIDGYGDKVSGVALLNPYFWGKEPVGGEPTDAGYRGGFERAWEVICSGKFGPDHPYINPAASPEEWRQLGSGRVLVTTAEHCWFVERARAYAEGIKACGWDGELQFHEAKGEAHVYFLPKYDSDNAVKELAMVADFVRRC

SEQ ID NO: 41618 - protein, 473 aa, Zea mays
  misc_feature (450)..(450): Xaa can be any naturally occurring amino acid
MEAADHGKLFVGGISWETSEDRLREYFGRFGEVTEAVIMRDRSTGRARGFGFVVFADAAVAERVTTEKHMIDGRMVEAKKAVPRDDHSIVTKSNASSIGSPGPGRTRKIFVGGLPSNVTEADFRRYFEQFGVITDVVVMYDHNTQRPRGFGFITFDSEDAVDKALHKSFHELNGKMVEVKRAVPKEQSPGPAARSPVGVGQNYAMNRVHSFLNGFNQGYNPNPIGGYGIRVDGRYGLISGARNGFSSFGPGYGMGMNVEGGLGGTFGASSGFISNSNGRQMGSYFNASSNRLGSPIGYLGLNDVPGSMLSSMSRNVWGNGSLNYPSNPTNMSAFASPRNGGQVSLPSDNWGGLPSAHGMDNISSLGSGNLGRGTGDNNFGLPSGSYGRNNSTGTIGEPFSAAGNTYEVNNRDTYGSSSIYGGTAWRFASSEVDMPSFVHDIGNVDPTIKXYMSASHMGNYPVNNNQPSRGISS

SEQ ID NO: 41619 - protein, 93 aa, Brassica napus
MAAGMGTRAGASLVGGNRILPGINDRLNLNFFGVEKAAFGAGQCQMLDLTFPGVGPMPKVNFVAKTESVLIQNSKVLQDGFNRFQITKPLGIN

SEQ ID NO: 41620 - protein, 502 aa, Arabidopsis thaliana
MAISLLCLFLITLVSLIFVVKKIKHSKWDLPPSPPTFPVIGNLHQVGELPHRSFQRLAERTGHVMLLHFGFVPVTVISSREAAEEVLRTHDLKCCTRPKLVGSRLISRGFKDISFTPYGEEWRERRKFLVRELFCFKKVQYFGYIVEEECNLLVKKLTESAVGRPPVDLSKSLFWLAASILFRIAFGQSFHDNKFIDEDKIDELIFETETAQASFTCSDFFPIAGLGWLADWISGKHRWLNNVFFKLDALFQRVIDDHSDPGRWKDHKDIVDVMLDVMHKQGKDDSLRLTIDHIKGFLTNIIIAGIDTGALTMIWAMTELARNPELMKNVQGEIRDSFGNNKERITKEDLNKVPFLNMVIKETFRLHPVAPLLLPRETMTHIKVQGYDIPPKRRILVNTWAIGRDPTLWINPEEFNPERFINNPVDYRGQHFELLPFGSGRRICPGMGLGITIVELGLLNLLYFFDWRAPDGMTHKDIDTEEAGILTVVKKVPLKLVPVRVQ

SEQ ID NO: 41621 - protein, 618 aa, Magnaporthe grisea 70-15
MRLSAFASVGLSSLAVVTNAAIVTYDWTIDWVRAAPDGFSRPVIGVNNQWPCPAIRANVGDTVVVNIKNNLGNQTTGIHFHGIHQIGSNEMDGPTGVTQCPVPPGNTLTYSFYADAPGTYWYHSHSPGQYPDGLRGPLIIDDPNDPYKGKYDEEVIFSVSDWYHSETLPLVRAMLTPANDRFLPPFPDSIIVNDGQNTNFSFVKGKTYRFRMISYAAFASAMIQFDSHTMQIIAADGAYTTQTQAYQIRLSPAQRYDVLISAIDRDNRNYPILVNLDINRDYEVAPVWTKNYTAQLVMDPAKPFTTYTVNQWRPQDDSTIKPYDVVGDAILPPADKVITLDFTFCKDENNYPRACFNNQTFIMPHTPTLYTAATVGEANTDAIVYGNVLPEIVSYGQVVDIVINNIDAAIHPFHLHGHHFQLLERPKSNTGVWPGRSGGYNTLPALRDVVHVNAHSYAVLRFKATNPGVFLFHCHIEWHVEMGLTATIIEAPERIRGKTFPPDHMAACKVMGMPTAGNAAGNTVNVYDTSGYKEVPDTVYHGAMYYPLGIPGPTPPDSPVPPTNAAPTSTTGATVQSTTTAAASATSSINVDDLVESLALDDPLPVRRSIRQSRPARL

SEQ ID NO: 41622 - protein, 270 aa, Zea mays
MSNVNLQRHTKSPVRSGILRHDRNGKRCKKNYHIDTEPNCTERKRFSQQASLTHLNEMEHVWLIVLVDVESDDEDLDDEDLDDGAEHEVEDAPAELAVKTVEALAAPPKDTERQLSKKELKKRELAELDAVLAELGLSGNSTSAAQDAEKEGANQAGDAEKKEDATVPSESKTSKKKKKKDKSSKEGRKETQEAAEGSEETASAGPDEEDTTAVDVKERLKKMASMKKKRSSKETDTGAKIAAAEATARSARLAAAKKKEKSHYNQQPVR

SEQ ID NO: 41623 - protein, 173 aa, Oryza sativa Japonica Group
MRGGAALAPGAEGGGIRGPRPRSPAAAQGRLESLSQVAGVLGTQWGDEGKGKLVDILAQRFDIVARCQLEMLEKQYHDELRMEYEGKTFSNRTADNQPDVVDKSDTKEADDHMEDSHKQAEKDAADISKTLMSRKQRGLLQAIEINQERKKDKVNLLKKRKKNADSSASAKGR

SEQ ID NO: 41624 - protein, 431 aa, Pantoea endophytica
  misc_feature (415)..(415): Xaa can be any naturally occurring amino acid
  misc_feature (419)..(419): Xaa can be any naturally occurring amino acid
  misc_feature (431)..(431): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAXAYYXSYRAAVLPANLX

SEQ ID NO: 41625 - protein, 233 aa, Salinibacter ruber DSM 13855
MTSLPSSIFQGGLGDQPQSGLVPKVVEQTTRGERAYDIFSRLLKERIVFIGTPINDQIANLTVAQLLYLESEGSSQPINIYINSPGGVIYSGLGVYDTMQYVEAPISTTCVGLAASMGSVLLAGGEDGQRACLPNSRVMMHQPMGGTEGQASDIEIQAKEMAWLKKRLYQILSFHTGKDIDQIEEDADRNHWLSAEEAQEYGLVDQVMNEGNLDALKSIHANGEASDADSDEE

SEQ ID NO: 41626 - protein, 426 aa, Pantoea endophytica
  misc_feature (9)..(9): Xaa can be any naturally occurring amino acid
  misc_feature (13)..(13): Xaa can be any naturally occurring amino acid
  misc_feature (32)..(32): Xaa can be any naturally occurring amino acid
  misc_feature (35)..(35): Xaa can be any naturally occurring amino acid
  misc_feature (279)..(279): Xaa can be any naturally occurring amino acid
  misc_feature (330)..(331): Xaa can be any naturally occurring amino acid
  misc_feature (346)..(347): Xaa can be any naturally occurring amino acid
  misc_feature (372)..(372): Xaa can be any naturally occurring amino acid
  misc_feature (408)..(408): Xaa can be any naturally occurring amino acid
  misc_feature (418)..(418): Xaa can be any naturally occurring amino acid
  misc_feature (425)..(425): Xaa can be any naturally occurring amino acid
RNLALNIEXRGYXVSVFNRSRDKTEEVIAENXGKXLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELBSYLIDITKDIFTKKDEEGKYLVDVILDEAANKGTGKWTSQSSLDLGEPLSLITESVFARYISSLKXQRVAASKVLSGPQAKPAGDKSVFVEKVRRALYLGKIVSYAQGFSQLRAASXXNNWDLNYGEIAKIFXXGCIICREFLQKITDAYAENAGIANXLLAPYFKKIADEYQQALRDVVAYAVQNGIPVPTFSXAVAYYDSYRXAVLPANXI

SEQ ID NO: 41627 - protein, 431 aa, Pantoea endophytica
  misc_feature (346)..(346): Xaa can be any naturally occurring amino acid
  misc_feature (388)..(388): Xaa can be any naturally occurring amino acid
MAVMGRNLALNLESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEXAKIFRAGCIIRAEFLQKITDAYAEKRRIANLLLAPYFKKIAXEYQQALRDVVAYAVQNGIPVPTFSAAVAYYDSYRAAVLPANLI

SEQ ID NO: 41628 - protein, 1144 aa, Vitis vinifera
  misc_feature (522)..(522): Xaa can be any naturally occurring amino acid
MEESRLTNNNRSGTAGGTAGHRAGGRADCHMHMEVVVLLDMPMEVVVLVDRAAAVEVVVLVDMHILFPCVTVAEGFGLGFSWDPTLANSIILRSARYSERAKIDIRGNTDSSNFQMSGRKEENIGRRGRAAVVVLGDIGRSPRMQYHALSLARQASLEVDIVAYGVSTPKVILVPWLPRYLSSTRICKQWPTIPRIVSKIFYPLVLLFKALFQFFTLFWFLCVKIPSPDVFIVQNPPSVPTLVAVKWASWLRNSAFIVDWHNFGYTLLGLSLGRSSRFVALYHWFEKYYGKAANGSLCVTRAMQHELAQNWGIKLHKDLCHPRGGQDCVTAGTMELWNQDTDETLFTAKMDTDIFLKSNRPALVVSSTSCLLGSIIVVIYGASRSGQVNGMMVVSWMQAVEECIQNCTGLKGLDIVMDCEGIVLKGAKAHLRHKSLLRLRCKVQHEVCAGAKTPDEDFGMLLEAAVMYDRRVAAILNEDDSTKEEVLWKETNSGKQFLYPRLLFIITGKGPNKEKYEEKIRXLKLNRVAFRTMWLSAEDYPLLLGSADLGICLHTSSSGLDLPMKVVDMFGCGLPVCAVSYSCIEELVKVEKNGLLFSSSSELANELLMLFKGFPDNCDALKLLRNGVVEAGFSARFNAAVHNKNEYKFVPKAMLLPCGTLGLKSSEKEKVGKSVLGKRNLHNWGLLLPIMVQNIGRVRYDSAESEKSGVKIFHLWCVAGAATVTERRLDNLPSEFGSREELCAMKERGFDNTIDGTNVEGSEVEIMDEGVANRDTPLVLDEVAVAIQPSQTTLIPNLHNEEHENGKKHYPSPPSPQHAPQRARLCDGLIDSVASHLLCEAIGEIAAMEDARSKYPSLPSNYVSILQLQQRWIKEQQRIQEEEEKGRKQDRESHSPTEDNDPTQNDTRPKFKGRRKFRPNGDKHRRTTDECSQKPKWSEVNGDRQRDGLRRQKPRAAKVKADRWTDQVESQNPEQAEVGCQKPESLKVKKDGRTVEDYCQKSEMEAMVVVGEEIKDDEQTTAGLKKKKKKNRKTKSRAEEELAGGTVQPVSKNGNEDKFPGRVNQIDGIQRRMEKLSVDPGKVGGSHRSTSPHMNDGYRRKPGVSGRWRSHKATGAGLVWVRKGETSDGNVARTSCSGGSGSQR

SEQ ID NO: 41629 - protein, 426 aa, Pantoea agglomerans
  misc_feature (23)..(23): Xaa can be any naturally occurring amino acid
  misc_feature (25)..(25): Xaa can be any naturally occurring amino acid
  misc_feature (166)..(166): Xaa can be any naturally occurring amino acid
  misc_feature (227)..(227): Xaa can be any naturally occurring amino acid
  misc_feature (334)..(334): Xaa can be any naturally occurring amino acid
  misc_feature (362)..(362): Xaa can be any naturally occurring amino acid
  misc_feature (398)..(398): Xaa can be any naturally occurring amino acid
  misc_feature (426)..(426): Xaa can be any naturally occurring amino acid
RNLALNIESRGYTVSIFNRSREXTXEVIAENQGKKLAPFYTVEEFVESLEKPRRILLMVQAGEATDKTIASLTPHLDKGDILIDGGNTFYKDTIRRNKELSDQGFNFIGTGVSGGEEGALKGPSIMPGGQKEAYELVAPILDKIAARAEDGEACVAYIGPDGAGHXVKMVHNGIEYGDMQLIAEAYALLKGALGLNNEELAETFTEWNNGELSSYLIDITKDIFTKXDEEGKYLVDVILDEAANKGTGKWTSQSSLDLGEPLSLITESVFARYLSSLKTQRVAASKVLSGPQAKPSGDKAEFIEKVRRALYLGKIVSYAQGFSQLRAASEENNXDLHYGEIAKIFRAGCIIRAQFLQKITDXYAEDAGIANLLLAPYFKDIADQYQQALRDVVSYAIXNGIPTPTFSAAIAYYDSYRSEVLPANLX

SEQ ID NO: 41630 - protein, 401 aa, Desulfovibrio desulfuricans G20
MSNTGCGQTAGAQAQGLQELNPEEMRLQRTLKRIRHKVVVMSGKGGVGKSTFAVNLAAGLALAGKRVGLIDVDVHGPSVPRLLGLHNARVTIENDYIEPVRWSAGLSVMSLGFLLPDMDQAVVWRGPVKMGFIRQLLADVVWGDLDYLIADCPPGTGDEPLSVLQLLGADAQGLIVTTPQAVAVDDVRRSISFCRDLGNPVLGLVENMSGIACPQCGHLEALFGKGGGKDLAEETGVPFLGAVPLDPQVVRSGDKGLVFVQARPEAAAAQAVMHVVQTVLALSENDRPQAPSLHGPVTVAVTAAGGTLCRHAGYCEEIILAQADGKSRQVQEVRTVPAPADSTTLPEWLAGQGVNVLITGGLSAEMENRLRREGITWVTGAPDCPPQEAVSAWLEGRLTAG

SEQ ID NO: 41631 - protein, 439 aa, Brassica napus
MFFFFSFLSISQTQTLIFSIDTQIFTAPFLFLHRGREMESDQGKLFIGGISWDTDENLLKEYFANYGEVLQVTVMREKATGRPRGFGFVAFSDPAVIDRVLQEKHHIDNRDVDVKRAMSREEQSPGGRPGGFNASRSFDSGANVRTKKIFVGGLPPALTSDEFRAYFETYGPVSDAVIMIDQATQRPRGFGFVSFDSEDSVDLVLHKTYHDLSGKQVEVKRALPKDANPGMAGGGGRSGGGFPGYGGSGGSGYESRVDSNRYMPPQNAGSGYPPYGAASGYGTGYGYGSNGAGYGGFGGGYGNPSGAPYGNPGGPGAGFGSGPRPSWEGQAPSGYGNNVGYGNAAAAPPWGGSGPGSAGMGQGGASAGYGSQGYGYGGNDSSYGTQSGYGAVGGRPNSHGGGYADGSDGSGGHGNLNHQGNGQAGYGGGYGNVRQAQQQ

SEQ ID NO: 41632 - protein, 244 aa, Oceanobacillus iheyensis HTE831
MKLQDKVAVITGGVSGIGAATAKLFASEGAKLILVDMNEEKGASIEAELKSQGSEAIFIKADVTNEEQVKNIYTTAIDTFGKVDILFNNAGIGAVKPTEELTYAEWRKTVEVDLDGVFLVAQAAIKEFLKAGSGVIVNTASMYGWVGSPGSAAYNAAKAGVVNLTRSLGLEYAARNIRVNALCPGFIDTAILGDSDREALINTTPMNRLGKSEEMAKAVLFMASDDSSFMTGNSLIVDGGYTAQ

SEQ ID NO: 41633 - protein, 257 aa, Oceanobacillus iheyensis HTE831
MSKFQDKVIIVTGAAGGIGKEVVRKVANAQAKVVLVDLNEDAIKSVQAELGLTEENSFVVKADVSNEENVKNYVDQTIAKFGRIDGFVNNAGVEGPAKSIEEITEKEFDFVYGINVKGVLFGLKYVLPVMKAQKSGSIVNTASVAGLIGSPSMALYNSSKHAVMGLNKVAALESAAFNVRVNTVNPGVINTQMMRNIESNVAPGSAEQAQTAYNDAVPMKRYGEPDEVANVIAFLLSDEASYVSSSSFTIDGALYNV

SEQ ID NO: 41634 - protein, 551 aa, Methylococcus capsulatus str. Bath
MSHPPSNTPPVKPGGLPLLGHILEFGKNPHAFLMALRHEFGDVAEFRMFHQRMVLLTGSQASEAFYRAPDEVLDQGPAYRIMTPIFGRGVVFDARIERKNQQLQMLMPALRDKPMRTYSEIIVAEVEAMLRDWKDAGTIDLLELTKELTIYTSSHCLLGAEFRHELNTEFAGIYRDLEMGIQPIAYVFPNLPLPVFKRRDQARVRLQELVTQIMERRARSQERSTNVFQMLIDASYDDGSKLTPHEITGMLIATIFAGHHTSSGTTAWVLIELLRRPEYLRRVRAEIDALFETHGRVTFESLRQMPQLENVIKEVLRLHPPLILLMRKVMKDFEVQGMRIEAGKFVCAAPSVTHRIPELFPNPELFDPDRYTPERAEDKDLYGWQAFGGGRHKCSGNAFAMFQIKAIVCVLLRNYEFELAAAPESYRDDYRKMVVEPASPCLIRYRRRDAPAAVDAKASAGEAPAETLRGAFRVTVDRDLCKGHGNCMAEAPEIFRVDEDGRLTLLSETPDPVLVGAALAAERFCPARAIKILPQRDPATRDRSLSPSGED

SEQ ID NO: 41635 - protein, 552 aa, Vitis vinifera
MAEQTQNHKPTRSYWRWSKQDFFPEESFQNLASYKTALSHTCFRLKDRLLNRSSVANEMLLFQESENAMKKCLTWWDLETRYDAGPAIILSYAVSGFSALLSVLCYTEFAVEIPVAGGSFSYLRVELGDFVAFIAAGNILLEAIVGAAGLARSWSSYFASMINTDTDFLRIRVSYFADGFNLLDPIAAVVLLIADGIAMSGTRRTSILNWISSVLSFMVILFIIVIGFIRGKTSNLVPFFPYGARGVFRAAAVVYWSYTGFDMVATMAEETKNPTRDIPLGLVGSMSMITVVYCLMALVLSMMQKYNEVDANAAYSVVFEKIGMTWAKYLVSICALKGMTTSMLIGGLGQARYMTQIARAHMIPPWFALVHPRTGTPINATLLMAIPGATIALFSSLDVLSSIFSFSTLLIFMLVAVALLVRRYYVKDTTAKRDLVKFLACLIVIIGSSIGIAVLWNSNTTEWVGYAVGAFLWFLGTLGMGLLPKQRVTNVWGVPLVPWLPSLSIGMNLFLIGSLGYQAFLRFFICSAVMLIYYFLVGLHATYDMARQNQQA

SEQ ID NO: 41636 - protein, 471 aa, Lentisphaera araneosa HTCC2155
MEIAGKATKLKLTDIKSPQIRTFWITAIAFFMCFFAWFGIVPFMPAVKKSLGMSGDQANLSVIVAVSGTIFARLLLGKLCDKYGPRLCYTWMLLLGSLPVMGIAFVQTYEQFLFCRLLIGFIGASFVITQVHTSLMFAPNCVGTANATSAGWGNLGGGANRMIMPIIALGVVACGVAEADAWRWSMGVAGVICFLMGLVYYKFTQDTPEGNFKDLKAAGKIKTDAQSKKEGGFLTAAKDYRSWILFLVYAGCFGIELTVYGKMDDYLQAQFSLSRGQAGTLVACFALMNIFARTTGGFLGDKFGIKKGLKGRVQFLMLIMVIEGLILASFSQITYFPLAIVVLILFSLSVQMAEGATFTVVPFINKKCVGSVSGIVGAGGNAGAVLAAWLIREKCKTSHASVDPSQITEASTKAAEAAGISNSFLILGGIIVFAGIATALVRFSAKDEEVAAAATKKAQEEAAALKGALPA

SEQ ID NO: 41637 - protein, 618 aa, Magnaporthe grisea 70-15
MAAPSDLEVTATKINGSSCQETVTNGDGINGPNGCSVAPATPATPTTPVMTVTRPSRTPSLTGLSLTEYSANPSPPAESKRRKAKKVIPDDYILPSGHPDYLRLILTSKVYEVCKETSLTHAVNLSNRLECKVLLKREDEQPVFSFKLRGAYNKMAHLDRAQSWRGVVCCSAGNHAQGVAFSARKLKIPATIVMPEGTPSIKHLAVARMGGHVVLHGPDFDAAKEECARREKHDGLINIPPFDDPYVIAGQGTIGMELLRQTNLQKLEAIFCCVGGGGLIAGIGVYVKRIAPHIKIIGVETHDANAMTQSLAKGERVLLKDVGLFADGAAVRTVGEENFRICQEVIDEMVQVTTDEACAAIKDIFEDTRSVVEPAGALALAGLKKWVAANPSTDSSRSLVAITSGANMNFDRLRFVAERANVGEGREALLAARIPEKPGSFAKLIEAIMPNNVTEFTYRYTDGEVANIMLGLSLTAPVAQRAHQLQLLMGRIAEAGMEVTDLSGDELAKSHVRYLVGGRAKVPNERLYMFEFPERPGALEKFLATLRPRYNISLFQYRNYGSDVGKILAGIQCPDGEMPELVKFLKEIGYPWFDCTQSEVAKTFLGGPGVNEEGAVPL

SEQ ID NO: 41638 - protein, 789 aa, Neptuniibacter caesariensis
MQNYVLRLDQVGMNDVERVGGKNASLGEMLQELTGANVKVPNGFATTADAYRDFLAHGGLEEKINAKLHELDTNDIQALTDAGKTIRNWVMEADFQPELDAAIETYWAEISADNANLAVAVRSSATAEDLPDASFAGQQETFLNVRGLANVKHAIKEVFASLYNDRAISYRVHHGFEHSEVALSAGIQRMVRSETGSSGVMFTLDTESGFNHVVFITSAYGLGETVVQGAVNPDEFYVYKPTLKMNAPAIIRKTLGSKAIKMVYSEPGSENPVATVDVDMAQRNEFSINDDDVQQLARIALEIEAHYGRPMDIEWAKDGDTGELFVVQARPETVKSRSNQAVIERYLLKETSEVLVEGRSIGHKIGSGHVRIVHDLSEMETVQPGEVLVTDMTDPDWEPVMKRASAIVTNRGGRTCHAAIIARELGIPAIVGCGDATEQFVNGQLVTVSCAEGDTGRVYAGKLDYEHQSNSVEQMPDLPFEIMMNVGNPDRAFDFQALPNAGVGLARLEFIINRMIGVHPKALLNFDTQPPALQQTISRRIAGYDSPVDFYVDRLVEGISTLAAAFYPKKVIVRMSDFKSNEYGHLIGGESFEPSEENPMLGFRGAARYISESFRDCFELECRALKRVRDEMMLTNVEVMIPFVRTPGEAKQVVDLLAQNGLKRGENGLRVIMMCEIPSNALLADEFLEHFDGFSIGSNDLTQLTLGLDRDSGVIAHLFDERNEAVKKLLSMAINACKKQGKYIGICGQGPSDHPDLARWLMEQGISTVSLNPDSVLDTWFFLANNDEE

SEQ ID NO: 41639 - protein, 363 aa, Legionella pneumophila str. Paris
MGFKCGIVGLPNVGKSTLFNALTKAGIEAANYPFCTIEPNVGIVTVPDSRLDNLSNIVKPQQVVHATMQFVDIAGLVKGASSGEGLGNQFLANIRETDAIAHVVRCFDNSDVVHVEGRVDPLSDIEVINTELALADMETLEKSLLKVGKNSKSGNKEAIFELKTLEKIKAHLDAGYPVRTLELTPEEEQVSKRLFLLTAKPVLYIANVDDNGYENNPLLDKVQALASQENASIVALCAATEAELVELDEEDRQEFMVDLGLSEPGLNKVIRAGYELLGLQTYFTAGVKEVRAWTIRKGATAPQAAGVIHTDFEKGFIRAEVISYDDFIRFGGEQGAKEAGKLRLEGKEYIVCDGDVMHFRFNV

SEQ ID NO: 41640 - protein, 195 aa, Bacillus anthracis str. Ames
MIVLIDNYDSFTYNLYQLLGEYEEEIVVVRNDQITIEQLEEMNPKGIVLSPGPGKPEEAGICIEVIRHFYKNVPILGICLGHQAIISAFGGEIVRAERIKHGKTSRAKHNGTSIFSYVTQPLTAMRYHSLVAAQTSLPQCFDILATAMDDGEIMAVRHNYYPLFGLQFHPESIATEEGGKLIRAFLGEVKEEERV

SEQ ID NO: 41641 - protein, 330 aa, Xanthobacter autotrophicus Py2
MMQSQPFRFSVAPMMDWTDRHCRAFHRTLSRRARLYTEMVTAPAILHGDRARLLGFSPEEHPVAVQLGGSDPAELAQAARICADYGYDEINLNVGCPSDRVQGGNFGACLMREPDLVADCVAAMKAVVAIPVTVKCRIGVDDQDPEEALDRLADAVVAAGTDALIVHARKAWLKGLSPRENRDIPPLDYDRVRRLKARLPHVPIAVNGGIASIAQGLEEARGLDGMMLGRAAYQDPELLLGVDPLLFGTPAPHADGFAAVEAFEPYVAHHLEAGGRLSDITRHMLGLFTGRKGARIFRRHLSTEAIRPGAGLDVLRAAVDEVRRRQPLAA

SEQ ID NO: 41642 - protein, 413 aa, Novosphingobium aromaticivorans DSM 12444
MRRSCRVHSTSNQTVDEEFYRMKRLPPYVIAEVNGMRAAARAAGRDIIDLGMGNPDLPPPQHVIDKLCEVAQKPDAHGYSASSGIPGVRKAQANYYGRRFNVDLDPETEVVMTMGSKEGLASLATAITAPGDVVLAPNPSYPIHTFGFIIAGATIRSVPTTPDERYWDSLDRAMKYSVPRPSILIVNYPSNPTAETVDLAFYERLVAWAKENKVWILSDLAYSELYYDGNPTRSILEVPGAKDVAVEFTSMSKTFSMAGWRVGFAVGNQRLIAALKRVKSYLDYGAFTPIQAAACAALNGPQDIVVKNRELYQKRRDVMVEAFGRAGWEIPSPSASMFAWAPLPPALTHLGSLEFSKQLLTHAEVAVAPGVGYGEDGEGFVRIAMVENEQRLRQAARNIKRYLQSMGVNASAA

SEQ ID NO: 41643 - protein, 298 aa, Cryptococcus neoformans var. neoformans JEC21
MSLDNYQKIEKVGEGTYGVVYKAKDINTGHIVALKKIRLEAEDEGVPSTSIREISLLKELSKDDNIVKLLDIVHSEAKLYLVFEFLDMDLKKYMDTIGEKDGLGPDMVKKFSYQLVKGLYYCHGHRILHRDLKPQNLLINKSGDLKIGDFGLARAFGIPLRTYTHEVVTLWYRAPEVLLGSRHYSTAIDMWSVGCIVAEMATRQPLFPGDSEIDEIFRIFRVLGTPDEDVWPGVRGLPDYKPTFPQWHPVELADVVKGFEADGLDLIAQTLVYDPAHRISAKRALQHPYFDTVNLSAA

SEQ ID NO: 41644 - protein, 233 aa, Salinibacter ruber DSM 13855
MTSLPGGIYDGDLGDQPMSGLVPMVVEQTTRGERAYDIFSRLLKERIVFIGTPINDQIANLTVAQLLYLASESSEKPINLYINSPGGVIYSGLGVYDTMQYIGAPVSTICVGLAASMGSVLLAAGEDDSRACLPNSRVMIHQPMGGAEGQASDIEIQAEEIMWLKERLYEILALHTGQDIDQIEADADRNYWMSAEEAEEYGLVDNVLNPDNLEGLKSIQPNGEAADDSEDDA

SEQ ID NO: 41645 - protein, 472 aa, Rhodococcus sp. RHA1
MVDRPQLGPTIFVLFGATGDLSKRMVLPAFFQLAQSGLLNSEWMLIGTGRGNVSDDQFRDHVRDVLNQFAVPHDDTDWEAFARRLRFAGGGFTPDNPGTLPATVRQAREDLDASDAQLVHYLALPPSTFAETTRALGTHDLARGARVVYEKPFGTSREAFAELDEAVHHVLDEKQIYRIDHFLGKESTQNLHILRFANGLIEGVWNREHVEQVQIDVPETLEIDDRARFYDATGAVLDMLVTHLFQVAAEIAMEPPETLGADDLQSARESVIGAFRPLDTADVVLGQYEGYRDVDGVADDSTTETFVAARLWVDTDRWRGVPFLLRTGKMLGVSRQRVSLVFRSPRGPLTDIPPDGAVLTFDLSGDGEIDISMVVKEPGPDDSLTVGHLGLPLDTVPLAHALAPYSRLILDVLHGDRSLFTRPDGLAHVWAVADALLRDPPPAKPYPAGSMGPPEAEDLASPCGWLVTGSPD

SEQ ID NO: 41646 - protein, 146 aa, Glycine max
MSCSSSSGSEEDDEGFDSYRKGGYHAVRVADQFAGGRYIAQRKLGWGQFSTVWLAYDTTTSAYVALKIQKSAAQFVQAALHEIDVLSSLADGADMDSKCVVHLIDHFKHTGPNGQHLCMVLEFLGDSLLRLIKYNRYKGLPLDKVR

SEQ ID NO: 41647 - protein, 177 aa, Chlamydomonas reinhardtii
MPANERAVFVTVGTTKFETLVERVDSLELLRALKDKGYTKLVIQKGNGSYCPSVIVPKGQTKGTTEGVDVEYFDYSPSLAAYITSAALVISHAGSGSIFETLTAGVPLIVVPNPLLMDNHQVELGEQLAAMGHLVSAAPEQLLAAVRSFDPARLKPYVKGSAAGMAAAIDKQLGFTP

SEQ ID NO: 41648 - protein, 278 aa, Xanthobacter autotrophicus Py2
MPKIVTLPNGETVPALGQGTWYMGESASARAGEVAALRAGLDLGLTLIDTAEMYADGGAEEVVGEAISGRRNEVFLVSKVYPHNASRAGVQAACERSLKRLKTDVIDLYLLHWRGSHPLKETIAGFEALQAAGKIRLWGVSNLDTDDMEELLAAPGGRACAANQVLYNPSRRGPEFDLLPFLAETGIPAMAYSPIEQARLPRGGALGAVAKKHGVDPFQVALAWVMRAGDVIAIPKASRIAHVQMNAAARDLVLDADDLAAIDRAFPAPRRKVGLEML

SEQ ID NO: 41649 - protein, 430 aa, Pantoea oleae
  misc_feature (157)..(158): Xaa can be any naturally occurring amino acid
  misc_feature (379)..(379): Xaa can be any naturally occurring amino acid
  misc_feature (381)..(381): Xaa can be any naturally occurring amino acid
MAVMGRNLALNIESRGYSVSIFNRSREKTDEVVAENQGKNLVAHYSVEDFVDSLEKPRRILLMVQAGEATDKTIASLTPHLDKGDILIDGGNTFYKDTIRRNKELSEQGFNFIGTGVSGGEEGALKGPSIMPGGQKEAYELVAPILTEIAAVAEGEXXVAYMGPDGAGHYVKMVHNGIEYGDMQLIAEAYSLLKNALNLGNEELAKTFSEWNEGELSSYLIDITKDIFTKKDEEGKYLVDVILDEAANKGTGKWTSQSSLDLGEPLSLITESVFARYLSSLKTQRVAASKVLSGPTVQRGGDKAEFVEKVRRALYLGKIVSYAQGFSQLKAASDENNWDLHYGEIAKIFRAGCIIRAQFLQKITDAYADNANIANLLWXPXFKNTADEYQQALRDVVAYAVQNGIPTPTFSAAIAYYDSYRSAVLPANLI

SEQ ID NO: 41650 - protein, 454 aa, Burkholderia thailandensis E264
MKNLQRHLSARHIRFLALGSAIGTGLFYGSASAIRLAGPAVILAYIVGGAAVYMVMRALGEMAVREPVPGSFGHYASENLGPFAGFVTGWTYTLEMVIVAIADITAFGIYMGFWFPDVPQWIWVLAIVAIICGLNLCHVKVFGELEFWLSIVKVGAIVAMIGGGAAILFSGMKLGSGGAPALANLWSHGGFLPNGVGGLVASLSVVIFAYGGIEVIGMSAGEAKEPERVIPRAINAVPMRILLFYVLTMVVLMSIFPWTGVGANGSPFVQIFSALGVRSAAEILNLVVISAAISAINSDIFGAGRMMYGMALQGQAPRALASMSARGVPWVTVLVMAGALLVGVVLNYLMPKDVFLMVAAIATFATVWVWLMILLSQVAMRRRLSAAETAALKFKVPFWPIGPAITIAFMAFVIAMLGYFDDTRIALFVGAAWLALLTLVFYTRVRPRLAAVAR

SEQ ID NO: 41651 - protein, 234 aa, Triticum aestivum
MASSPRSPQPAELEISRQSRILAALSKKVIDLDELRMLAAQGVPDGAGVRSTVWKLLLGYLPKDRALWEQELAKKRSQYEAFKDEFLPNTVGGSSTTGGSEGHSDGNAEHVENGFLDRSEIAQDDHPLSLGKTSQWNQVAEHSEMIEQVDRDVKRTHPDIHFFCGDSSFAKSNQDSLRNILIIFAKLNAGIRYVQGMNGILAPLFFVFRNDPDYKNANFAEADSFFCFVELPRG

SEQ ID NO: 41652 - protein, 431 aa, Pantoea agglomerans
  misc_feature (48)..(48): Xaa can be any naturally occurring amino acid
  misc_feature (74)..(74): Xaa can be any naturally occurring amino acid
  misc_feature (139)..(139): Xaa can be any naturally occurring amino acid
  misc_feature (159)..(159): Xaa can be any naturally occurring amino acid
  misc_feature (170)..(170): Xaa can be any naturally occurring amino acid
  misc_feature (369)..(369): Xaa can be any naturally occurring amino acid
MAVMGRNLALNIESRGYTVSIFNRSREKTDEVIAENQGKKLAPFYTVXEFVESLEKPRRILLMVQAGEATDKTXASLTPHLDKGDILIDGGNTFYKDTIRRNKELSDQGFNFIGTGVSGGEEGALKGPSIMPGGQKEAXELVAPILDKIAARAEDGEAXVAYIGPDGAGXYVKMVHNGIEYGDMQLIAEAYALLKGALGLNNEELAETFTEWNNGELSSYLIDITKDIFTKKDEEGKYLVDVILDEAANKGTGKWTSQSSLDLGEPLSLITESVFARYLSSLKNQRVAASKVLSGPQAKPSGDKAEFIEKVRRALYLGKIVSYAQGFSQLRAASEENNWDLHYGEIAKIFRAGCIIRAQFLQKITDAYXEDAGIANLLLAPYFKDIADQYQQALRDVVSYAIQNGIPTPTFSAAIAYYDSYRSEVLPANLI

SEQ ID NO: 41653 - protein, 121 aa, Staphylococcus aureus subsp. aureus MRSA252
MQDTIFLKGMRFYGYHGALSAENEIGQIFKVDVTLKVDLSEAGRTDNVIDTVHYGEVFEEVKSIMEGKAVNLLEHLAERIANRINSQYNRVMETKVRITKENPPIPGHYDGVGIEIVRENK

SEQ ID NO: 41654 - protein, 500 aa, Gibberella zeae PH-1
MSDLYVNLEAPNGVKYRQPTGLFINNEFVPGSSTQKITSIDPATEKEIATVHAANADDVDKAVKAAYDAFRNPSWKKLPPPQRGVLMNKLADYIEERTKIFATSEAWDNGKVYTDAEGGDVVEVINTIRYYAGWADKITGQTITANPNKLAYTLRQPLGVVAQIIPWNYPLAMAAWKIGPALACGNTIVMKAAEQTPLSILLLGEAIKAVGFPPGVFNALNGYGSEAGPALVEHPLVDKVAFTGSTATGARIMEMASKTLKNITLETGGKSPLLVFSDSDIDEAVKWSHMGIMSNQGQICTATSRLLVQDKVYDEFVQRFIETTKTVSKVGHQWDSETYQGPQVSKQQYDRILEYIQIGKSEGATLLAGGQPVDSSKKGFFIQPTVFGDVHHQMRVFREEIFGPVVVITKFSDEAEALKLANDTTYGLGAAVFTKDVERAHRVAAEIEAGMVWINSTQDSEPYIPFGGVKQSGIGRELGEAGLEAYSNTKSIHVNLGSRL

SEQ ID NO: 41655 - protein, 431 aa, Pantoea agglomerans
  misc_feature (11)..(12): Xaa can be any naturally occurring amino acid
  misc_feature (378)..(378): Xaa can be any naturally occurring amino acid
  misc_feature (421)..(421): Xaa can be any naturally occurring amino acid
MAVMGRNLALXXESRGYTVSIFNRSREKTDEVIAENQGKKLAPFYTVEEFVESLEKPRRILLMVQAGEATDKTIASLTPHLDKGDILIDGGNTFYKDTIRRNKELSDQGFNFIGTGVSGGEEGALKGPSIMPGGQKEAYELVAPILDKIAARAEDGEACVAYIGPDGAGHYVKMVHNGIEYGDMQLIAEAYALLKGALGLNNEELAETFTEWNNGELSSYLIDITKDIFTKKDEEGKYLVDVILDEAANKGTGKWTSQSSLDLGEPLSLITESVFARYLSSLKTQRVAASKVLSGPQAKPSGDKAEFIEKVRRALYLGKIVSYAQGFSQLRAASEENNWDLHYGEIAKIFRAGCIIRAQFLQKITDAYAEDAGIANLXLAPYFKDIADQYQQALRDVVSYAIQNGIPTPTFSAAIAYYDSXRSEVLPANLI

SEQ ID NO: 41656 - protein, 494 aa, Gibberella zeae PH-1
MAENYHKEVISGLKNKSLFIQDAFINGQWVAKENKFDVFEPSTATVLGQVANCALEDFQTAIKSADVAQTKYFDSTTGASRGAMLRKWYDLVLANQEDLAKILSLENGKTYSEALGEVIYSASFISWFAEEATRSYGVTIPSSAPHTTLMTIREPVGVCGIITPWNFPAAMITRKIAPALAAGCSVVIKPPSETPYSALAFTKLAIEAGLPPATIQVLPTRDRQAATELATNPLVKKISFTGSTGVGKYLAKLAAGTLKKLSLELGGNAPFIVFEDADLDLAAEGAMFCKFRCSGQTCVCANRLYVQKSVAKEFTAKLVEKVNALKMGGGLDKTTTQGPLVNKSAIDKVKEHIADATSKGAKIATGGSTPDSPGFFHQPTVLTGVTQEMAVAKDETFGPLAPVFEFDTEEDAIRLANDTEFGLAGYFFSKDISRVMRVAHKMQVGMVGANTGKISAAEAPFGGVKESGYGKEGSLYGMAEYQNIKSITIGNLNN

SEQ ID NO: 41657 - protein, 458 aa, Geobacillus stearothermophilus
MSGPNDIDEAVQAAKEAQRQWALVPAPKRAEILYKVGMLLKERKEQLARLLTMEMGKVIEEARGEVQEGIDMAFYMAGEGRRLFGDTTPSELKDKFAMSVRTPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQEFERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTDD

SEQ ID NO: 41658 - protein, 147 aa, Glycine max
MEETIPVIDVEKINSDEGECKKLREACERWGCFRIINHSIPATLMADMKKVIEALLDLPMEIKKRNTEVIAGSGYMAPSKVNPFYEALGLYDLGSSQAMHNFCSQLDASHHQRFVSLPLCLDLSHLLFWIYLVVMLDLINMIKKNNS

SEQ ID NO: 41659 - protein, 254 aa, Saccharomyces cerevisiae [sequence omitted]

SEQ ID NO: 41660 - protein, 227 aa, Physcomitrella patens subsp. patens
MGETPVPDNVAELLVVRHGETSWNALGRLQGQAESDLNEPGKKQAQAVADKLASMGLEFAAVYTSDLHRALDTAQSIAEKCQLKQIVVREDLRERCLGDLEGLTRTEARTAAPEALKVFMKNDDSLPIPGGGESLEQLFVRVQNSFEQVALENLGKRVVVVTHGGVLRTSHIIAKGLPCPGKVVNASISVFHISDDKDWTIISWGDVSHLQNIGFLNTGFGGDKLSG

SEQ ID NO: 41661 - protein, 326 aa, Prosthecochloris aestuarii DSM 271
MNSLMLSERRRFSLGASPDPEPGEGEAVLRVEACAVCRTDAVMWDKGHRDLLLPRVPGHEICGRVYGAAPSSLQVVWPGIACGSCDMCRIGRENLCRSMRIIGFHRDGGFADCLVVPEANLLPVPSGITAEVATLAEPFGCALHALDRSRLRKGERVLIYGGGTLGILLALGAVAQGAEVLQVDPDLQKLEKGRSFRRSFHIGGGSVIDGQDAQDFNVVINATSACGSFSDGIHRLAPGGRYCLFSGLRGNEEYPASLVNEIHYREADLVGSYGCTRQDMRAALELLVLHEAELSFLIESRISLEQVQSIMPTVLEGKGFKFVITF

SEQ ID NO: 41662 - protein, 411 aa, Physcomitrella patens subsp. patens
MNALEATNFYFKRAVKLLGLDSKVERSLLIPFREIKVECTIPKDDGTLASYIGFRVQHDNSRGQMKGGIRYHPEVELNEVNALAQLMTWKSAVANIPYGGAKGGIGCNPRDLSPTELERLTRVFTQKIHDVIGPHLDIPAPDMGTNAQTMAWILDEYSKFHGYTPAVVTGKPVDLGGSLGREAATGRGVLYATEALLKDHNLSIRGQTFVVQGFGNVGSWASKLIHEKGGKIKAVSDVTGAIKNNSGIDITALNEHVRMTGGVKGFEGANPLDAAALLAEDCDVLIPAALGGVINGETAKDVSAKFIVEAANHPTDPVADEILAKRGVIILPDIYANCGGVTVSYFEWVQNIQGFPWEEEKVNTNLKKYMEKAYLSIKSTCQTHNCSHRMGAFSLGVGRVAKATLLRGWEA

SEQ ID NO: 41663 - protein, 343 aa, Cryptococcus neoformans var. neoformans JEC21
MAAAAAFDLLDKYIPGASDSLTIVNATTAQNTLYPGVDFAALNWLERLWASYYVWVGNPIIATGLMSFLLHEIVYFGRCIPWLIIDAMPYFQKWKLQPNKHVSRAQILKCTKVVLLTHFTCEAPLILAFHPICCLFGMKTYEIPFSSIGLMAAQIAFFFVFEDTFHYWAHRALHYGPLYKHIHKLHHEFSAPIGIAAEYAHPLEVLILAQGTISGPFLYAVFRNDLHILTVYVWITLRLWQAVDAHSGYDFPWSLRHFLPFWAGADHHDFHHATFTSCFSTSFRWWDYYFGTDVKYHAYKARVAAAGVKERAAVEKREMEKLEKEGIIEERAAASHSKRGKKE

SEQ ID NO: 41664 - protein, 370 aa, Zea mays
MDAKKPYMLAITTVAIYTGMYVVSKAAFNQGMNSFVFVFYRQAAASLLLLPIALVLERKNVRSMSSGLILKLFLLALIWNTLGMNLCNASVTLTSATVASATGNSTPVITFCLALLLRMEVVKLRSVSGIAKVTGVALCLAGALVIALYTGPSLSPVNRHHRASGGAHGFKAPTRGGTWVTGTFLMLLSNVTWSLWTVLQGALLKEYPNKLLVTTSQCLFSTAQSFVVAAVAERDFSKWALKLDVSLIAVAYTGFLVTGVSYYLQAWCVQIKGPVFLAVWNPLCFVLTIFCSSFFLGENVHLGSIVGGILLVCGLYSVLWGKTLEVHQTVESGDNTVGEVQNGQEEKNHQQKVLEKGRQEEASMTAPGVV

SEQ ID NO: 41665 - protein, 248 aa, Novosphingobium aromaticivorans DSM 12444
MGRLNGKVAIITGAARGMGESHARTFVREGARVVLTDLSEEAGKALVAELGDNAVFLKQDVTDPQSWNAVVETAVREFGTIDILVNNAGILGPMAPTDSLDDEGYRKVCAVNQDSVFFGMRAVLPVMVKARRGSIVNISSIAGMAANYGFPSLAYVASKFAVRGMTKATAVEFGKHNIRVNSVHPGFIQTPMMVEATDEVGGEALAQIPLGRIADPSEVSNLVLFLASDESSYITGSEHLVDAGMLAH

SEQ ID NO: 41666 - protein, 468 aa, Escherichia coli
MSKQQIGVVGMAVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEEGKYLVDVILDEAANKGTGKWTSQSSLDLGEPLSLITESVFARYISSLKDQRVAASKVLTGPKAHPAGDKVEFIEKVRRALYLGKIVSYAQGFSQLRAASDEYHWDLNYGEIAKIFRAGCIIRAQFLQKITDAYAKNAGIANLLLDPYFKNIADEYQQALRDVVAYAVQNGIPVPTFSAAVAYYDSYRAAVLPANLIQAQRDYFGAHTYKRTDKEGVFHTEWLD

SEQ ID NO: 41667 - protein, 186 aa, Glycine max
  misc_feature (144)..(144): Xaa can be any naturally occurring amino acid
  misc_feature (180)..(180): Xaa can be any naturally occurring amino acid
MSTASLDEETAKKVVRQVEFYFSDSNLPRDNFLRKTVTESEDGMVSLALICSFNRMRTNLNLGDVKLDGVTKDTVKAVAQALKNSALVRVSEDGTKVGRATELLKPEEVIEQVEIRTIAALPFEYDVKLEDVETFFAQYAKVNXSVPVPPHVGDKKFFCGPALGEFSSDEETEKVFEAKXWAIAGA

SEQ ID NO: 41668 - protein, 331 aa, Ostreococcus tauri
MRSDALRRDGNALLRDGNLVDAREKYRSALAAATDDRERALAVGNEAVVAIALGDDATATTLCARAWSYDEGYARATTRLEALLTSGRGLGRALEIAKRARDAGNEAFRAGEYEKAMQAYGEGLETCAGVPGAGILFSNRAACKMRVGDASGALADAEAALARDESFVKAKMRKAAALMTLGRHREADAVYDALVFELPGDEDLVRSANEARRALGKSERKAGARNVEEWSEYQALVRGAKLVFVDFTATWCGPCKMIGPTFVSLSTKFPRAHFIKVDVDAAQEIAGQERVSSMPTFAVYMDGNKVETFSGADANRLTQMVSKHYANARFR

SEQ ID NO: 41669 - protein, 338 aa, Burkholderia thailandensis E264
MSITRRTTLSKYLIEQQRETHNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPDGQQATEQSFLQPGTEQVAAGYAVYGPQTVFVLTTGNGVNCFTLDREVGSWVLTQSNLRIPEDTREYAINASNARHWYDPVKRYVDELNAGAEGPRGENFNMRWIASMVADVHRILNRGGIFMYPADKRTPDRPGKLRLMYEANPMSFIVEQAGGAATTGLKRILDVQPTGLHQRVPVILGSKNEVERVARYHQEAQS

SEQ ID NO: 41670 - protein, 384 aa, Saccharomyces cerevisiae
MTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPIIRGSLPDSLQQRPHGRPTGDD

SEQ ID NO: 41671 - protein, 378 aa, Arabidopsis thaliana
MAIKKLLMISFSLTSLLFSLLYIIPTTKTLFTSSKIPSLPLESNQNSNSTLPCFAYLISASKGDAGKLKRLLRSLYHRRNHYLIHLDLEAPEEEHLEMIRFVAGEPLFQPEGNVMIVGKPNLVTYRGPTMLATTLHAMALLLRCCRWDWFINLSASDYPLVTQDDLSDAFSELPRDLNFIQHTSRLGWKMNKRGKPIIIDPGLYSLNKSEIWWVSNQRSLPTSFKLFTGSAWTFLSRPFAEYCIIGYDNLPRTLLLYYTNFVSSPEGYFQTLICNSDEFKNTTVNHDLHYIAWDNPPKQHPKILGTRDYRKMVMSNRPFARKFKSNDPVLNRIDREILRRKRKLGSKPDLGPGPGARRLKSLLMRLLLRRNFVNRQCR

SEQ ID NO: 41672 - protein, 725 aa, Saccharomyces cerevisiae
MPQSTPSQEVQRVPWDNKPALKQITLRATIAGIAIGSLVLTSNFQFGLQTGWVSMMSLPSALLACAFFKNIWPLIFPNDRPFSDVENVYVQSMAVAVGTGPLAFGFVGVIPAIEKFLTNDESGGLREQGQSFTFRELLIWSTALAFFGIFFAVPLRKQVIVREKLPFPSGSATATLISVLNGTEILQEVSKSELLEMRQRRLNECPEVLQPNRDPEEADYLMNSSHSELGDYTATSQDGSSILSTGSENYRANIIILLKTFVVSSLYTMVSYFVPVIRSIPVFGKYLSNNYLWNFQPSPAYIGQGIIMGLPTVSYMLIGCFLGWGVLAPLARYKRWVPPDADVHDWEEGVQGWILWSSLSIMVADSVVAFIVVTVKSIVKFILIDDKAALLNNIIDDTFQSMLLEEERAINSSRRNTYVDGRQDTVRLVSRDNEIEVDSKHLVRYTTVISGCLVSSIICIVSIIYLFGIQVIPLYAIITALILALFLSILGIRALGETDLNPVSGIGKISQLIFAFIIPRDRPGSVLMNVVSGGIAEASAQQAGDLMQDLKTGHLLGASPRAQFCAQLIGACWSIILSSFMYLCYNKVYSIPSEQFRIPTAVVWIDCARLVTGKGLPDKALECSMILGVIFAVLSLIRNTYRDYGYGWILYIPSGVAVGVGIFNSPSFTIARFIGGWASHFWLKNHRGDLNAKTKMIVFSSGLVLGEGIFSVINMLFICLNVPHY

SEQ ID NO: 41673 - protein, 215 aa, Staphylococcus aureus subsp. aureus MRSA252
MILLKRMRDDIKMVFEQDPAARSTLEVITTYAGLHAVWSHLIAHKLYNQKKYVAARAISQISRFFTGIEIHPGAKIGKRLFIDHGMGVVIGETCTIGDNVTIYQGVTLGGTGKERGKRHPDIGDNVLIAAGAKVLGNIKINSNVNIGANSVVLQSVPSYSTVVGIPGHIVKQDGVRVGKTFDHRHLPDPIYEQIKHLERQLEKTRNGEIQDDYII

SEQ ID NO: 41674 - protein, 778 aa, Physcomitrella patens subsp. patens
MTRNRVVTESCCSQDITATESDLVTTGKSLKGVKRDISGMDDAEDDASPIKKMKASPGLRSIHATTTIMNPQARSEECDSTIASLKSSLRNANEELERWKQAFIDNSILPSGTTPDPAAVVQVIQKLQASEVQLQEQLLTARRREGALLVKLGNTEHEILGLKSTVRSLKRQSKWPLSSVARSLLPKPANFDEVSRLKKELKPAEKITMEVPDITASIYIRPQNMRSNVLNAEFPADLTENSGAACEVLEDKEDDGLQLMYVPFPSTKKKLGSSRKYLIAKEEAEGEEAKKNWMDSEVETLISLRWELEPDFLKNAYKQGVDMWSQLQARMSSAIPGFTRSGLACQRKFNSLIKQHKKDVLDVKEGKHHTWDRHARKFYDSLDRCWHTNGTVMKHVTANSMHVNHSDSDTALTNGNKEENLRMSVKEDEGEEAKKNWLDSEAETMVSLRWEMEPEFVGNAYKTGEDMWSKLQMRMVSLIPGFQRSGLACQRKFNALIKQHKKDILELKESGRERYNYRFYDILDRWWHTNGTVMKHVTASPNDSESLGNPEHLTEYLDDASNKLLREGDEGEEGKKNWADSEVETLIGLRKEMDSEFVKNWKKQGGNMWSKLRSRMLSLYPGFTRSPLACKRKFNTLVRHHKKYMHILAASGEEPLNFKHHDLLVQWLHNNRTSLRCSTATASASASASDSDLNQLTTGDPTVASESQRDVCKPNKAESSIIPYVVGIQYGINVPGSLSNVIEPSSDVNEKDKPSMLLAKLDGEIDPFMDSLKPTVSI

SEQ ID NO: 41675 - protein, 524 aa, Bordetella bronchiseptica RB50
MAPPDHVVPSPANGHRHDARPATRLPEPTSLRRTLSARHLTMIAVGGSIGTGLFVASGATIAQAGPGGALLAYLLVGIMVYFLMTSLGELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 41676 - protein, 133 aa, Arabidopsis thaliana
  misc_feature (6)..(6): Xaa can be any naturally occurring amino acid
  misc_feature (14)..(14): Xaa can be any naturally occurring amino acid
  misc_feature (21)..(21): Xaa can be any naturally occurring amino acid
  misc_feature (23)..(23): Xaa can be any naturally occurring amino acid
  misc_feature (28)..(28): Xaa can be any naturally occurring amino acid
  misc_feature (30)..(30): Xaa can be any naturally occurring amino acid
  misc_feature (32)..(32): Xaa can be any naturally occurring amino acid
  misc_feature (38)..(38): Xaa can be any naturally occurring amino acid
  misc_feature (78)..(78): Xaa can be any naturally occurring amino acid
  misc_feature (97)..(97): Xaa can be any naturally occurring amino acid
  misc_feature (102)..(103): Xaa can be any naturally occurring amino acid
  misc_feature (110)..(110): Xaa can be any naturally occurring amino acid
  misc_feature (118)..(118): Xaa can be any naturally occurring amino acid
  misc_feature (120)..(120): Xaa can be any naturally occurring amino acid
  misc_feature (123)..(123): Xaa can be any naturally occurring amino acid
  misc_feature (127)..(127): Xaa can be any naturally occurring amino acid
  misc_feature (131)..(131): Xaa can be any naturally occurring amino acid
MASSMXSSATMVAXPAQGHMXVXPLKGXKXSXAFPATXKANNDITSITSNGGRVNCMQVWPPIGKKKFETLSYLPDLXDSELAKEVDYLIRNKWIPXVEFEXXHGFLYRXHGTQPGIXYXGRXLPMXELPXFG

SEQ ID NO: 41677 - protein, 87 aa, Arabidopsis thaliana
AGVLYAPGKASNAGGVATSGLEMSQNAMRLTWTRAEVDQKLHGIMKSIHAACVQHGKRADGTVSYIDGANIAGFVKVAEAMLAQGVL

SEQ ID NO: 41678 - protein, 77 aa, Neptuniibacter caesariensis
MSNIEERVKKIIAEQLGVKEEEVTQEASFVEDLGADSLDTVELVMALEEEFETEIPDEEAEKITTVQLAIDYINAHQ

SEQ ID NO: 41679 - protein, 381 aa, Novosphingobium aromaticivorans DSM 12444
MTPAEISPIEDIIREAVEGRPFILVDADDRENEGDIIIPAQFATPAQISFMACHARGLICLAITQERSSQLQLRPMAPRNESGYGTAFTVSIEAKEGVTTGISAHDRARTIAVAVDPTKGVDDLVTPGHVFPLTARDGGVLVRAGHTEAAVDISRLGGLTPAGVICEVMNDDGTMARLPDLKIFAAKHGLKIGTIADLIAYRRSSEQLVEEMASAPFQSHFCPSPMTVHVYRNKIDGGEHVALVKGEIRADQDTLVRVHQVDLTTDVLGWNTASPEYLRRALRFISDHSGPGVVVLVRDPDPESISRRVAGGRREYHEKNANRDYGIGAQILIDLGVRQMTLLTSSKAKLAALQGFGLTINGRTELRENRPDSPIRVRSDF

SEQ ID NO: 41680 - protein, 418 aa, Bacillus anthracis str. Ames
MIEIKVPELAESITEGTISQWLLNVGDKVEKGGSVVELETDKVNVEIIAEDSGIVSKLLGEPGDTVEVGATIAILDANGAPVAVSTPAPAEQSKQETAEAPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 41681 - protein, 371 aa, Cryptococcus neoformans var. neoformans JEC21
MPDLVVTTQELRPSSPVYGHARTIIKNNFVAMAGEYVGTTLFMLCCLGGTHVALLPEKSVTGDLSQPLNTSSLFYISLSIGLSLTVNVWIFFRVSGGLFNPAVSLGMVLAGCLPPMKGALLTVAQVLGGITGAAIINVLLPGELNAGTTLGGGASIAQGLFIEAILTALLMLTVFFTAAEKNEATFLSPLAIGMALFIAEMVGVPYSGGALNPVRSLGPAVVTHNFPGYHWIYWVGPALGSVLATCFYSLLKYLEYESVPGPGEAPHVPPFWRLPARGYLSTLSHPFAKRASTGTYSHEDDPEKGLRSGKDSQANTDNPTRVNRRGSGDAEIQSPVEDTTMANARLDRIEMLLTQLMQVRTSEGTQKSPAV

SEQ ID NO: 41682 - protein, 208 aa, Zea mays
MATVNATTTTAGSGKQTDAAPSPPAAAAAACRSFSGANLALRVLLFAVTLAGLILLATAKQTVRVPVPQFPGLLLSRPAKFTDSPALIYLLVALVVTCFYSLLSTAFTSLKLLSGSSPATRTLFLLVLFDVIWRQLYAAIMASATGSAGGVAWIGLKGNSHTNWNKICNIYGKFCRHIGSSVFLGLIASVVLVLLTILNAHSLYRRSR

SEQ ID NO: 41683 - protein, 626 aa, Vibrio cholerae O1 biovar eltor str. N16961
MTLDISKYPTLALANTPDELRSLPKEVLPKLCDELRTYLLNSVSQSSGHLASGLGTVELTVALHYVYHTPFDHLIWDVGHQAYPHKILTGRRDQMPTIRQKDGLHPFPWREESEYDTLSVGHSSTSISAALGMAICAGKEGKDRKVVSVIGDGAITAGMAFEAMNHAGDVHPDMLVVLNDNEMSISENVGALNNHLAQVLSGSLYTSIREGGKKVLSGIPPIKELVRRTEEHLKGMVVPGTLFEELGFNYIGPVDGHDVLELIKTLKNMRELKGPQFLHVMTKKGKGYAPAEKDPIGYHGVPKFDPSHHSLPKSSNTKPTFSKIFGDFLCDMAAQDPKLMAITPAMREGSGMVRFSKEYPSQYFDVAIAEQHAVTLATGMAIAGYHPIVAIYSTFLQRGYDQLIHDVAIMNLPVMFAIDRAGIVGADGQTHQGAFDLSYMRCIPNMLIMAPADENECRQMLYTGHQHQGPSAVRYPRGNGMGVELESSFTALEIGKGRLMRESTACEGEKVAILSFGTLLPNALQAAEKLNATVADMRFVKPLDEALIKQLAQTHDVLVTLEENAIAGGAGAGVIEFLMKEKQLKPVLNLGLPDQFIVQGTQEEMHAELGLDGAGIERAIRDYLAK

SEQ ID NO: 41684 - protein, 294 aa, Vibrio cholerae O1 biovar eltor str. N16961
MIEALSSYQQRNNQQLDQWLNRIPFQTLPLIEAMRYGLLLGGKRARPYLVYITGQMLGCELSDLDTPASAVECIHAYSLIHDDLPAMDDDELRRGKPTCHIQFDEATAILTGDALQTLAFTILAEGDLSAAGETQRVAMLQALAEASGAQGMCLGQALDLAAENRLISLEELETIHRNKTGALMRCAIRLGALAAGEKGRAMLPHLDRYAEAVGLAFQVQDDILDIISDTETLGKPQGSDQELNKSTYPALLGLEGAQQKAHTLLQEALLALEAIPYNTEHLEEFARYVVERKN

SEQ ID NO: 41685 - protein, 345 aa, Saccharomyces cerevisiae
MTIDNYDNSKQDSSKYEVSGTGDGRNGDGGLPLVQCVARARIPTTQGPDIFLHLYSNNRDNKEHLAIVFGEDIRSRSLFRRRQCETQQDRMIRGAYIGKLYPGRTVADEDDRLGLALEFDDSTGELLASKATTWDAHNDTLVRIHSECYTGENAWSARCDCGEQFDRAGRLIACDHEPTSKIKGGNGHGVIVYLRQEGRGIGLGEKLKAYNLQDLGADTVQANLMLKHPVDARDFSLGKAILLDLGIGNVRLLTNNPEKIKQVDHAPYLKCVERVPMVPIHWTNSSEGIDSKEIEGYLRTKIERMGHLLTEPLKLHTNPQPTETSEAQNQNRMNSALSSTSTLAI

SEQ ID NO: 41686 - protein, 589 aa, Candida albicans SC5314
MLELNSITIPRNFTEFQLTALKIYYQLKILFLATYCAQGSFGLNGSVCLARDIFVGYVVYTQLLKLYRVLRGYGIVDSIRRLYLYVSSTVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGMYGSPTLAGSRPGALVVGCWATLINIGKQGYTKFCYDIVSASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 41687 - protein, 799 aa, Burkholderia thailandensis E264
MTNAANVAKDQAYVIPFEQLRMTDVEIVGGKNASLGEMISQLAEAGVRVPTGFATTALAFRDFLQHNNLTERIAQRLESLDVDDVKALAEAGAEIRKWIVDAPLQPRLEQEIRSQFEILKNGSPGELSFAVRSSATAEDLPDASFAGQQESYLNVVGIEDVLDRMKHVFASLYNDRAISYRVHKGFTHAEVALSAGVQRMVRSDVGAAGVMFTIDTESGFKDAVFITASYGLGETVVQGAVNPDEFYVFKTTLEQDKYPIIRRSIGSKLIKMEFTQPGEPGRVKTVDVPHEQRNRYSITDDDVIELAKYAVIIEKHYQRPMDIEWGKDGRDGKIFILQARPETVKSQAHGKVEQRFKLKGQSQVLATGRAIGQKIGAGPVRVIHDPSEMERVQPGDVLVADMTDPNWEPVMKRASAIVTNRGGRTCHAAIIARELGVPAVVGCGDATDVLKDGSLVTVSCAEGDEGKIYDGLLETEVSEVQRGELPSVPVKIMMNVGNPQLAFDFSQLPNAGVGLARLEFIINNNIGVHPKAILEYPNIDADLKKAVESVARGHASPRAFYVDKLTEGIATIAAAFYPKPVIVRLSDFKSNEYKKLIGGSRYEPDEENPMLGFRGASRYIAEDFAQAFEMECMALKRVRDEMGLTNVEIMVPFVRTVKQAERVVGLLGKFGLKRGDNGLRLIMMCEVPSNAILAEEFLQHFDGFSIGSNDLTQLTLGLDRDSGMELLAVDFDERDPAVKFMLKRAIDTCRKLDKYVGICGQGPSDHPDFAKWLADEGIASISLNPDTVIETWQALAAKQ

SEQ ID NO: 41688 - protein, 110 aa, Brassica napus
MESSRGGCGIQQLLAAEQEAQHIVNAARTAKMARLKQAKEEAEKEIAEYKAKTEQDFQRKLEETSGDSGANVKRLEQETDAKIEQLKNEASRISNDVVEMLLKHVTTVKN

SEQ ID NO: 41689 - protein, 359 aa, Bradyrhizobium sp. ORS278
MPSTNALHIAVLPGDGIGPEVMAPALEVLRKVEARAGLSFRFTEAQAGANNYLATGVSIAESTIRLCEQADAILLGACGLPSVRYPDNTEIAPQIELRFHFDLYAGVRPARLIPGVPSPIVGAAERGIDFVVIRESTEGLFASMGKGQVTHEEARETLVITRRTSERLFNFSFKLAERRRARGRSGTLGCVDKANVFKAFAYFRKIFDEVAELHPEVKTERLYIDACALMLVKRPWDFDVLVTENMFGDILSDLAAGLVGGMGMAPSADIGDRHAVFQPCHGTAPDIMGQGKANPTAMILSAAMMLDWLADTHGIEGAAEAAQRIEQAVDRVYAAGLKPFEFGGHAGTIDVTKAVLQEL

SEQ ID NO: 41690 - protein, 718 aa, Oryza sativa
MEVGADGVAVVTICNPPVNALHPIIIQGLKEKYAEAMDRDDVKAIVLTGAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKERGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFLQRGQKMIAANLEGLVKRGSLTKDKMNKAMSLLKGALDYSDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVALAVKDIYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFRGGLVFWADTIGAPYIHSKLSKWTEIYGDFFKPSSYLEDRAKRSLPLSAPNATQQASSRSRM

SEQ ID NO: 41691 - protein, 284 aa, Triticum aestivum
MAGGGELVVSFGEMLVDFVGKLGDDEFGRMLAAILRDNGVDDGAVVFDAGARTALAFVTLRADGEREFMFYRNPSADMLLTADELNVDVIKRATVFHYGSISLIAEPCRSAHLRAMEIAKEAGALLSYDPNPREALWSSREEARTKILSIWDQADIVKVSESEVEFLTGIDSVEDDVVMKLWRPTFKLLLVTLGGQGCKYYARDFRGVVPSYKIQQVDTTGAGDAFVGALLQKIVQDPSSLQNQEKLVEAIKFANACGAITTTKKGAIPSLPTEIEVLQLMESA

SEQ ID NO: 41692 - protein, 578 aa, Geobacillus stearothermophilus
MGNAIREKTIHGIAASSGIAIAKAYRLETPDLAAEKRTVADVEAEIARLEAAVAKAKEELEAIKQHALEKLGEDKAAIFAAHLLVLDDPELLNPIKEKIQTERVNAEYALDETALFFISMFEAMDNEYMKERAADIRDVTKRVLAHLLGVTISNPSLISEEVVIIAEDLTPSDTAQLNRQYVKGFATDIGGRTSHSAIMARSLEIPAVVGTKTVTAEVKNGDIVIVDGLDGQVIINPSPELLAQYEQKRARYEAQKAEWAKLVHEATVTADGIHVELAANIGTPDDVKGALANGAEGIGLYRTEFLYMGRSELPTEDEQFVAYKTVLEQMNGKPVVVRTLDIGGDKELPYLQLPKEMNPFLGFRAIRLCLEMQDMFRTQLRALLRASVYGNLKIMFPMIATLDEFRQAKAILLEEKEALLRQGVAVADGIEVGMMVEIPAAAVMADQFAKEVDFFSIGTNDLIQYTMAADRMNERVAYLYQPYNPAILRLISHVIDAAHREGKWVGMCGEMAGDPIAIPILLALGLDEFSMSATSILPARAQLKKLAKEEAARIKETVLSLGTAEEVVSFVKRTFSLA

SEQ ID NO: 41693 - protein, 125 aa, Zea mays
MAGRLSGVASRIMGGNGVVARSGASSLRQRAGMGLPVGKHIVPDKPLSVNDELMWDNGTAFPEPCIDRIADTVGKYEALGWLCGGLGFFATLGLLAVVNDKASKVPFTPRVYPYDNLRVELGGEP

SEQ ID NO: 41694 - protein, 254 aa, Enterococcus faecalis V583
MITLKSPREIEMMDESGELLADVHRHLRTFIKPGITSWDIEVFVRDFIESHGGVAAQIGYEGYKYATCCSINDEICHGFPRKKVLKDGDLIKVDMCVDLKGAISDSCWSYVVGESTPEIDRLMEVTKKALYLGIEQAQVGNRIGDIGHAIQTYVEGEGYGVVRDFVGHGIGPTIHESPMIPHYGEAGKGLRLKEGMVITIEPMVNTGTWRMKMDPNGWTAYTEDGGLSCQYEHSLAITKEGPRILTSQGEELTY

SEQ ID NO: 41695 - protein, 700 aa, Oryza sativa Indica Group
MARSGRERKIRRRRRRRWCRWSGCSRGGWCRGWKEQVTLRALAVSALLGAMFSVIVMKLNLTTGIIPSLNVSAGLLGFFLLTSWTKFLDKVGVASVRPFTRQENTVVQTCVVACSGIAFSDADLCTGGTGGFGSYIFAMSDRISDQSGEARDEHNIKNPSLGWMIGFLFIVSFLGLFSVVPLRKIMIIDYKLIYPSGTATAHLINSFHTPQGAKLAKMQVKMLGKFFVMSFSWGFFQWFYTGGDGCGFMSFPTLGLEAYRNKFFFDFSATYVGVGMICPYLVNISVLLGGVMSWGIMWPLIEHKKGDWYPADLKPSSLRGIVGYRVFISISLILGDGLYNFLKVMTRTTTALVMQVRAMMSEPTLPVSGGGGGGGGQTPEETFDDKRRTELFLKDQIPNWLALSAYVVIAVVSIATVPRIFHQLRWYHVAVSYVVAPVLAFCNAYGCGLTDWSLATTYGKLAIFTVGAWADASDGGIIAGLAACGVMIGIVSTASDLTQDFKTGYMTLASPRSMFVSQVIGTAMGCVIAPSVFWLFYKAFHDIGMPGSEYPSPNALVYRNMAILGVQGLGSLPKHCLDLCIGFFVAAIAVNLARDLAAPKVARFLPLPMAMAIPFYLGPYFGIDMCIGSLIRFVWDRLDGARAKAFAPPVASGLICGDGIWTLPQSVLALAGVKPPICMKFLSRTTNIKVDAFIAKLPSS

SEQ ID NO: 41696 - protein, 597 aa, Cryptococcus neoformans var. neoformans JEC21
MYPRSLTLPPVRPRPFSPVFLSLARTLIPQPPPPLVSSRPLPTTFKKVSPQSESNRLFMEGLIREIETLRAQAKEGGGQKVLDRWKAKGTGKLSVRERVSALLDPASPFLELSPLAAHDVYPDALPGAGLVTGIGMIAGRKCMIIANDPTVKGGTYFPLTVKKHLRAQQVALENSLPCIYLVESGGAALPYQAEVFPDHDHFGRIFYNIARMSGMGIPQISVVHGISVAGGAYMPAMSDVVIIVKDQGRIFLAGPPLVKAATGEIVDEEALGGGDMHTSVSGVADYLATSDSHALRLAREAIRDLCPIPIAQALPSGSTAAGTREVVPPLYPTEDLNAIVPADPRQTYDPREIIARLVDGSEFREFKKEFGKTIITGFAEVHGYTVGIIANAGVLLSPSAQKATHFINLCSQRRIPLVFLVNVGGYMVGEKAERGGIAKDGAKMVRAVARAKVEKYTFVVGGSYGAGNYGMCGRAYSPRFLFMWPNARISVMGPDQLSTVMHTVQGKRAQENGKAAEDAERKRQELRDAIEKQSMGIYSTARLWDDGIIKPSDTRDILGLALELAHDERAKRPHGAQGTRGEIGADGDNGDWGVFRM

SEQ ID NO: 41697 - protein, 267 aa, Zea mays
  misc_feature (88)..(88): Xaa can be any naturally occurring amino acid
  misc_feature (145)..(145): Xaa can be any naturally occurring amino acid
MTSSRSKSRSHSRSRSRSRSPQRRDRLRSERAPRHSRSRSRSRSPYRRRERRGYKDLVCKNCRRPGHFAKECPSAPTCNNCNLPGGPXPIPFIFYSLFAAECTSKTVCWNCKEPGHIASECKNEALCHTCNKTGHLARDCPTSGXNVKLCNKCFKSGHIAVDCTNERACNNCRQPGHIASECKNDPVCNLCNVSGHVARVCPKTTLASEIHIQGGPFRDILCRICGQPGHISRNCMATVICDTCGGRGHMSYECPSARIFDRGFRRF

SEQ ID NO: 41698 - protein, 262 aa, Neptuniibacter caesariensis
MSIAKKIFKNSELFQQLEKLMNDADTSILEIYNSNNFGEESKGDDSPVTKADLAAHQLLVDGLQQLTPNIPIVSEEDPSSLTIPAEHSAYWLIDPLDGTKEFIKRNDEFTCNLALIESGASTLGFVSIPAKQELYYGGKELGSFKQHKQHEPTPIHHSSKKGATRVVASKSHLNAETQEFIAQLQGKIELIQAGSSLKFLKIATGEADLYPRLAPTCEWDTAAAHAILEGAGGKVLQADSLQPLVYAKENILNPYFIASAKG

SEQ ID NO: 41699 - protein, 615 aa, Legionella pneumophila str. Paris
MKSTDPIKIAVLPGDGIGIEVTEATLPVFEVLDVPAILSYGDIGWEFWKKEGTAIPSRTWQLIASSDTVLLGAITSKPQREAKQELSKALRKSNPYYVSPVIQLRQGLDLFANVRPCFSIDDQSKPFNFCIIRENSEGLYCGFDYFPLPKAIHNLLAESQHWQTIPADEASCALRLQSKPGLTRLFDFAFNHAMQTGMPRVTLADKPNVLRESGEFARKIFESTAQKYPKIQADILNVDAVALWLIKSPEKFGVIVAENMFGDILSDVGAGVMGGLGLAPSANIGDKGSYFEPVHGSGPRMKKNCANPSAMFLTISMLLNHFGYPDRAKKIVNAVMQVIKEKRYITYDLGGHSTTTDMANAVIERCARLEASCLSTDFNPVPKENIIESDAMGNLLQQLMHCNSAEISDALDSCGIEGGLLNIKPLSQGMKMVGPAYTIQYLPREKKEAVFHNAANYIDKVPKHSVIVIDNNGQTDCTVWGDLLTHTALRNNIMGTVVHGAVRDVESIRSTNYPVFCTGIYMCSGKNRVYKANEQCPLFINGVTINPGDIVFADDNGVLVIPNVLLHEVVNKAIAIRLTEERIKAAVASGSTLEQAREDYYYEQPWLGINKKREQ

SEQ ID NO: 41700 - protein, 543 aa, Nocardia farcinica IFM 10152
MITATDLEVRAGVRTLLSAPGPALRVQAGDRIGLVGRNGAGKTTTLRILAGEGEPYAGKILRSTEIGYLPQDPREGDLDVLARDRVLSARGLDTLIRDMEKQQALMAEVADEAEREKAVRKYGRLEERFSALGGYVAESEAARICHSLGLPDRVLGQPLRTLSGGQRRRIELARILFSASDGSGGRSDRILLLDEPTNHLDADSITWLRGFLQNHDGGLIVISHDVELLEAVVNKVWFLDAVRGEVDVYNMGWKKYLDARATDEQRRRRERANAEKKASALKAQAAKLGAKATKAVAAQNMVKRAERLLDELDEVRVADKVARIKFPEPAPCGKTPLMAENLTKVYGSLEIFTGVDLAIDRGSRVVVLGLNGAGKTTLLRLLAGVEQPTAGQLVPGHGLKVGYFAQEHDTLDDQATVWENIRHAAPDAGEQDLRGLLGAFMFSGPQLDQPAGTLSGGEKTRLALAGLVSSAANVLLLDEPTNNLDPISREQVLDALRTYAGAVVLVTHDPGAAEALSPERVILLPDGTEDHWSAEYLELIQLA

SEQ ID NO: 41701 - protein, 251 aa, Bacillus anthracis str. Ames
MKTTENFTDKADIYAKYRPSYPNEYIEYLLSANELNENQIVADIGSGTGIFSRQLLDSGLHVIGVEPNDDMRKMAEQSLKRYPRFQSIKATAENTTLKENSVDLVTVAQAFHWFDKEAFKIECQRILKQKANVALVWNSRDVTSPLIKENAEICQKTCPTFKGFSGGIDETPEVFNSFFKDGKYEFKEYQNDLLFDYESFLGRNLSASYAPKENDEQYKNFIFLLSELFEKYSKNGKIVLPNLTRSYMGNV

SEQ ID NO: 41702 - protein, 332 aa, Zea mays
MSTANHYQHIKSTKPVVGKARKLKDLMIKSDNRICADCGAPDPKWASTNIGVFLCLKCGDVHRALGPDISKVLSVTLDDWSDSDIDSMVEVGGNSYANSIYEAFLPKDHPKPKPDSTMEYRTKFIRAKYETQDFLKPSLRISSRSSFKSTNSVKSVDSNFSSTSRKDISEDTREFVGELNITVVKGTNLAVRDMLTSDPYVVLTLGGQKAQSTVKKSDLNPVWNEMLKISVPRNYGPLKLEVYDHDTFSADDIMGEAEIDLQPMITAAMAFGDTSRLGDMQIGRWFTTKDNALMKDSTVNVVAGKVKQEVHLKLQNVESGELELELEWVPIL

SEQ ID NO: 41703 - protein, 448 aa, Burkholderia thailandensis E264
MSTHATDDWVARSLRAVWHPCTQMKHHERLPLIPVARGERAWLFDRAGNRYLDAISSWWVNLFGHANPRINAALKQQLDTLEHAMLAGCTHESAIELAERLAARTQHTLGHAFFASDGASAVEIALKMSFHAWRNRGRGDKREFVCIANGYHGETIGALGVTDVALFKDAYDPLIRAAHVVASPDARGARDGETAADVAARALGDVKRLFAERGEKIAALIVEPLVQCAAGFAMHDPSYVRGLRALCDAHDVHLIADEIAVGCGRTGTFFACEQAHVWPDFLCLSKGISGGYLPLSLVLSRDAIFDAFYDDDVTRGFLHSHSYTGNPLACRAAVATLDLFDTDDVLAENARKSALMREALAPLASHPQVRHLRERGTIFAFDVALEGDAAKTFPRRFFERALARETLLRPIGTTVYLMPPYILADGEIEWLASRTRATLDATLSETHA

SEQ ID NO: 41704 - protein, 491 aa, Mycobacterium tuberculosis CDC1551
MMTTESVARKTQKSETEAPREPAPVSDEKQTDVAKTVARLRKTFASGRTRSVEWRKQQLRALQKLMDENEDAIAAALAEDLDRNPFEAYLADIATTSAEAKYAAKRVRRWMRRRYLLLEVPQLPGRGWVEYEPYGTVLIIGAWNYPFYLTLGPAVGAIAAGNAVVLKPSEIAAASAHLMTELVYRYLDTEAIAVVQGDGAVSQELIAQGFDRVMFTGGTEIGRKVYEGAAPHLTPVTLELGGKSPVIVAADADVDVAAKRIAWIKLLNAGQTCVAPDYVLADATVRDELVSKITAALTKFRSGAPQGMRIVNQRQFDRLSGYLAAAKTDAAADGGGVVVGGDCDASNLRIQPTVVVDPDPDGPLMSNEIFGPILPVVTVKSLDDAIRFVNSRPKPLSAYLFTKSRAVRERVIREVPAGGMMVNHLAFQVSTAKLPFGGVGASGMGAYHGRWGFEEFSHRKSVLTKPTRPDLSSFIYPPYTERAIKVARRLF

SEQ ID NO: 41705 - protein, 156 aa, Schizosaccharomyces pombe 972h-
MVAVGSTLPKVTLWENKPEEVVEFPSQGKFIIVGVPGAFTPPCSSQVPGYIANEKQFAAKGISGIYVVAVNDVFVTKAWKKSFDGGEQSGVHFVADWNGEFTKAFDAGFDASGLLGPLRSKRYAAVVENGKVVKVFIENEVTDVDISSADKVLSSL

SEQ ID NO: 41706 - protein, 406 aa, Arabidopsis thaliana
MISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 41707 - protein, 482 aa, Saccharomyces cerevisiae
MVKRTVATNGDASGAHRAKKMSKTHASHIINAQEDYKHMYLSVQPLDIFCWGTGSMCELGLGPLAKNKEVKRPRLNPFLPRDEAKIISFAVGGMHTLALDEESNVWSWGCNDVGALGRDTSNAKEQLKDMDADDSSDDEDGDLNELESTPAKIPRESFPPLAEGHKVVQLAATDNMSCALFSNGEVYAWGTFRCNEGILGFYQDKIKIQKTPWKVPTFSKYNIVQLAPGKDHILFLDEEGMVFAWGNGQQNQLGRKVMERFRLKTLDPRPFGLRHVKYIASGENHCFALTKDNKLVSWGLNQFGQCGVSEDVEDGALVTKPKRLALPDNVVIRSIAAGEHHSLILSQDGDLYSCGRLDMFEVGIPKDNLPEYTYKDVHGKARAVPLPTKLNNVPKFKSVAAGSHHSVAVAQNGIAYSWGFGETYAVGLGPFEDDTEVPTRIKNTATQDHNIILVGCGGQFSVSGGVKLSDEDAEKRADEMDD

SEQ ID NO: 41708 - protein, 461 aa, Triticum aestivum
  misc_feature (160)..(160): Xaa can be any naturally occurring amino acid
  misc_feature (172)..(172): Xaa can be any naturally occurring amino acid
  misc_feature (188)..(188): Xaa can be any naturally occurring amino acid
  misc_feature (199)..(199): Xaa can be any naturally occurring amino acid
  misc_feature (266)..(266): Xaa can be any naturally occurring amino acid
MPTANVRAAQPSADRRLSTLVRHLLPSSPRTSAATATSADSSLQPFPTMASPSVFAGIAQGPEDPILGVTVAYNKDPSPVKVNLGVGAYRTEEGKPMVLNVVRRAEQMLIQNESRVKEYLPITGLADFNKLSAKLIFGADSPAIQENRVATVQCLSGTGXSLRVGGEFLARXHYHERTIYIPQPTWGXNHPKVFTLAGXLTARSYRYYDPATCGTGFPKDSWEDLSSAPSGAIVLLHACAHNPTGVDPTLEQWEQIRQLMRSKALXLPFFDSAYQGFASGSLDKDAQSVRMFVADGGELLMAQSYAKNMGLYGERVGALSIVCGSADIAVKVKSQLKLVIRPMYSNPPLHGASIVATILKDSAMFDEWTLELKAMADRIISMREQLFNALKIRETPGDWSHIIKQIGMFTFTGLNSDQVAFMRQEYHIYMTSDGRISMAGLSSRTVPHLADAIHAAVTKLK

SEQ ID NO: 41709 - protein, 246 aa, Physcomitrella patens subsp. patens
MSWSIVYQSSTVQLSVPWFVDFYLKSGIPNFSKQYFVRLLEPLNMISFLIERCRDLNQQGSLKEMAPANNAFSLQVTNELVQKLAKENIVAKRPARKAPAPKPSVKPLEAPLVTKQGLPLPFYRGFLSGVPGINKEQAYQQSQEQKHDLVPIYKVLEETENLNKKLQMQENSELEKVKQLAQELQDRQFRAPSYPIPCQAEKERCLQCYRGSPESPVECAEAVRMYKECSQRVQQDFAERVATSQL

SEQ ID NO: 41710 - protein, 328 aa, Saccharomyces cerevisiae
MTEILPHVNDEVLPAEYELNQPEPEHCPGPESDMAGKSDACGGCANKEICESLPKGPDPDIPLITDNLSGIEHKILVLSGKGGVGKSTFAAMLSWALSADEDLQVGAMDLDICGPSLPHMLGCIKETVHESNSGWTPVYVTDNLATMSIQYMLPEDDSAIIWRGSKKNLLIKKFLKDVDWDKLDYLVIDTPPGTSDEHISINKYMRESGIDGALVVTTPQEVALLDVRKEIDFCKKAGINILGLVENMSGFVCPNCKGESQIFKATTGGGEALCKELGIKFLGSVPLDPRIGKSCDMGESFLDNYPDSPASSAVLNVVEALRDAVGDV

SEQ ID NO: 41711 - protein, 523 aa, Physcomitrella patens subsp. patens
MERGRKDYVPVRPKAYPASKNALTVDAKYWKAFKILSTPQHIGAVTSIQFSPVDHYDFAVSSSTRVTIYDGVTGEVKKTISRFTDVAYSGTFRSDGQLLAAGGETGIVQVFDLGSRQILRQLKGHKGAVHWVRYAPQDKLHIFSAGDDRTVRWWDVSTSESLSTLEGHTDYVRCGVACPTTNDLWATGSYDHSVRLWDIRTPKCVLQLEHGKPLEDVVFFPSGGLLASAGGTEVKVWDIVGGGREVQTLGNHQKTVTSLTIMCPRESTSALEPDAPRLLTSSLDGHVRVFDTSQFKVTHAAKYPHPLLSMGLSASSQTLAVGTASGMLFVRQKKEPKSEEDIEKPQNVLDTTTPKKAKQLRPNNFRYFLRGRSEQASEGDHVLARPQRQRLTAQDKFLRKFMYREALSSALATSDSTVIVAVMEELIARRGLVKAISNRDAPALEPLLAFLCKYIVMPRQARLLIPVAHLVLDTYSESLGLSPTITHLVCVLKDRVQSEVKLHMALQSLQGIMEPLIQASSQI

SEQ ID NO: 41712 - protein, 534 aa, Desulfotalea psychrophila
MFASYKSIQETCAFEKLSELAQSPYDLTQPGALQADNRLQRYQVAGQAFKLFYATEQVDDRVLAGLQAVADECQLVSQYRAMRTGAVMNKIDGFVSENRRVLHTATRDLFSGEPAEASMNSRAKRELEKLSHFLDALDAGEIVNEAGEAFTTIVQVGIGGSDLGPRAVYEALKSYTIVGRRAAFISNVDPDDVSMALADLDLGKTIFNIVSKSGSTLETVTNEAFVRRALLENGYDSARHCISITGEGSPMDDPDSYLASFYLYDCIGGRYSTTSMVGCVLLGFTLGFEQVMAFLRGAANMDNSADEVDILKNIPLLMALIGIWNRNFLDLSSLAIIPYSQALYRFPAHLQQCDMESNGKSVDRQGRAVQGKTGPIIWGETGSNSQHAFFQHIYQGTSPVPIEFIGFSESQRGKDIEVQGCTSQQKLLANLFAQMVALACGKKDQNLNKFFAGNRPSCLLFAKKLTPYVMGSLLACYEAKIVFQGFAWNINSFDQEGVQLGKELAKRFLREIGGEEEGFHGIESAFLNEVQRGV

SEQ ID NO: 41713 - protein, 646 aa, Marinobacter sp. ELB17
MLTISDLSLQRGGVWLLEGVSLTVQPGQRMAIVGANGAGKSSLFQLLLGDLAPEHGNFSLPGGCRIAHMAQEVEATGRSARDFVLDGDFDLRRLEHELARAEAAQDDLAQARIHGELDLHEAWSASRRAESLLRGLGFSDGDADHPVSSFSGGWRIRLNLAQALMRPSDLMLLDEPTNHLDLDACLWLENWLRRYSGTLLFISHDRDFMDRVATHVVHFDRRDLALYSGNYSAFEVQRSERLAQQQAGFERQQARIAEIQRFIDRFKAQATKARQAQSRVKSLERMEKIAPAHIDSPFNFQFPLAEKVSNPLLSIRQGQAGHGDVTILRNLNLSLLPGSRIGLLGPNGAGKSTLMDSLRGEATLINGERTCGEHLAIGYFAQHQLESLDLDASPFLHLQRLSPRASDQSIRNFLGGFDFHGNAALSPIRSFSGGEKARVALAVIAWQRPNLLLLDEPTNHLDLEMRQALTMALQNFDGAIVVVSHDRHLLRNTVDEFWLVNDGRVVEYQGDLEDYERWLADRRKDDTEAPKRQSVVAEGGQDAAVNGESADDRKVRKRAEAAVRQKISPFRKQQATLEKKMDSMQAALAEMDAELTNPALYSDSGKQQLKTLLGRQAEARQKMAVVEAQWLDVSETVEALEAELES

SEQ ID NO: 41714 - protein, 281 aa, Enterococcus faecalis V583
MKITAYVASAFSKNHEGGNKAGVVFMTQPLTRTQKMAIAKELGFAETAFISDSKIADFRLEYFTPKEEVDLCGHATIGAFTIMKHLNKLLQTAYTIETNSGLLAITANGEQLFMEQTVPTFYDTLTLEELSGCFDLNAVATAFPIQIVSTGLKDILVPIKNAQLLQDLQPNFEKIKLLSQKYGVIGMHLFALSEENIICRNFAPLYDIDEEAATGTSNGALACYLHHHQILQKTNYTFAQGYTLNAPSEVLVRLNTTSQKTIDQVLVGGRGYYVETKELFL

SEQ ID NO: 41715 - protein, 282 aa, Bradyrhizobium sp. ORS278
MKHKTFGTGGAGVSVIGQGTWYLDHADRKRAITTLQRGLDRGMTHIDTAEMYGDAELVIADAITGRRDEVFLVSKVLPSNASRKGTITACERSLKRLRTDRLDCYLLHWPGSHPLEETVAAFEELKAAGKIASWGVSNFDVDDLDDLDELLDVAGRGKIACNQVLYHLQERAIEHAVIPWCGQHGVAVVAYSPFGHDDFPERRSTGGEVLQRIAEQHHATPHQIALAFLTRASSLLAIPKASRPEHAEENAAAGEIELTAADIAAIDRAFPRGPKPRGLPML

SEQ ID NO: 41716 - protein, 286 aa, Arabidopsis thaliana
MGQKRLLFLLAVFTFLVSSSYGRVLKLKSDDDRPVYNHTLAVTLVEYASAVYESDLTKLFTWTCERCNGLTKDFEVIEVIFDVEHCLQAYVGVAKDLNAIIIAFRGTQEHSIQNWVSDLFWKQLDLNYPDMPDAMVHHGFYSAYHNTTLRPAVLDAITRVKKVYGANINIIVTGHSMGGAMASFCGLDLVVNEGEENVQVMTFGQPRVGNAAFASYYSLLVPNTFRITHDRDMVPHLPPYYYHFPQKTYHHFPTEVWVKDFSFSNFVLFGLEKVCDNTGEDPTCSR

SEQ ID NO: 41717 - protein, 393 aa, Cryptococcus neoformans var. neoformans JEC21
MSAASTAPSSPEVVQQFSDLDIGSTVTTPAVTRPSSPSPPSLPPSPLSSGKHKIAVIGSGSWGTALAKIAAENAWRRKEDFHSEVRMWVREKIVNGKPLTHVINKTHLNSRYLPDVVLPRNLVAVPHLKDVVKDATLIVFVVPHQFLHTVLNELARPGVLLRGAKAVTAIKGVEVNGTDIQTFASLIEAKVGLPCSALSGANIALEVAMGQFCETTIGCPTPDQSLLWHAVFNSPSFRVNTVEDVSGVSLAGALKNVVALAAGMVDGLGLGGNTKAAIMRIGLKEMTQFCLEFFEGVRPETFSNESAGVADLTVTCFSGRNRKCAEEFVRSGQPFDVVEKKLLNGQKLQGTATAEEVNAFLFARKRAHAYPLFEKVYKIAFEGMPPKNLVVGL

SEQ ID NO: 41718 - protein, 379 aa, Shewanella oneidensis MR-1
MSNEKPQFIKSKAAVAWGPRQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLKEICLLGCGVTTGMGAVMNTAKVEAGATVAIFGLGGIGLSAIIGATMAKASRIIAIDINESKFELARKLGATDCINPKNFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 41719 - protein, 618 aa, Oryza sativa
MHTKLLLLPILASLQLLPGAANGATVDPSCPPATCGNLTITYPFWLGSQNQSSCGPPSFQLTCNDRASGPFLRNSYIKVLGFDYGRRSLVAVHALLAADAACTVMFNVSSAFAITDRFSISQSNRELYVLSRCRERLPPPDAVPVTNCRANSSGMYAYLGGSYGTGQTPVNNGGCELSVFLVLGSSNAADMTAANYRQLIAGGFLLEWEPVGDCNACTASGGRCRYDASTSAFACLCSDGGMRPSICVSLSAAAGLVFAFLAWLMYRQRQKFRSAICGVYSGNTKNEEEMLKKCESLALKRYKYSELKKITKSFEDNLGEGGYGVVFKGRLQNGRMVAVKILTVSKGNGEDFLNEVMSISRTSHVNIVTLLGFCLEGPKRALVYEYMPNGSLKNYIHSESSNLATGWEMLLKIVIGIARGLEYLHQGCNTRIIHFDIKPRNILLDHEFCPKIADFGLAKLCHLNESILSMAEARGTIGFIAPEVFSRGFGVVSTKSDVYSYGMLLLEIVKVRKNIKGIADNFSETFFPHWVYDSLVSEMQCCETAYGTEEIARKMTIVGLWCIQMTPETRPSMSRVIEMLERSISELEMPPKPFLCSPIHSTNVSSYKSVNFTMSASS

SEQ ID NO: 41720 - protein, 455 aa, Bacillus anthracis str. Ames
MSVSSIVNKQKAYFYNGHTRSVEVRKNNLKKLYEGIQRFEEEIFQALKLDLNKSVHESFTTEVGYVLKEISFQLKHMSSWSKPKRVRTALTHFGSKGKVVPEPYGVTLIIAPWNYPFQLAIAPLVGALAAGNTIVLKPSELTPNVSKVITRMLAELFQEELVAVVEGGVEESTALLKEPFDYIFFTGSVGVGKVVMEAAAKQLTPLTLELGGKSPCIVHKDAKVDVTARRIVWGKFLNAGQTCVAPDYLYVHASVKEQLIEALRHEIAEQYGNEPLQNENYVRIVSERHFERLCRFLQDGQVAIGGNYKRDTLHIEPTVVKDITWQDAVMEDEIFGPILPIIEYENIEEVIDTIQQHPKPLALYVFSEDKEMQKKVTSNISYGGGCVNDVVYHLATPYLPFGGVGSSGLGSYHGEESFRTFSHYKSILAQSTAFDMKIRYSSTKSALKFIRKLLK

SEQ ID NO: 41721 - protein, 498 aa, Bacteroides thetaiotaomicron VPI-5482
MDKFAMIIFGASGDLTKRKLMPALYSLYRDKRLTGSFTVLGIGRTVYSDEDYRSYILGELQQFVKAEEQNLELMSSFVSHLYYLPMDPAKVEGYSQLRERLVELTKEVDPDNLLFYLATPPSLYGVVPLHLKAAGLNTPHSRIIVEKPFGYDLESALELNKIYSSVFDEHQIYRIDHFLGKETAQNVLAFRFANGIFEPLWNRNYIDYVEITAVENLGIEQRGGFYETAGALRDMVQNHLIQLVALTAMEPPAVFNADNFRNEVVKVYESLTPLTETDLNEHIVRGQYTASGNKKGYREEKGVAPDSRTETYIAMKLGISNWRWSGVPFYIRTGKQMPTKVTEIVVHFRETPHQMFRCSGGNCPRANKLILRLQPNEGIVLKIGMKVPGAGFEVRQVTMDFSYAQLGGVPSGDAYARLIDDCIQGDPTLFTRSDAVEASWNFFDPVLRYWKDNPDAPLYGYPAGTWGPLESEAMMHEHGADWTNPCKNLTNTDQYCEL

SEQ ID NO: 41722 - protein, 491 aa, Bacteroides thetaiotaomicron VPI-5482
MANQNKTDIGLIGLAVMGENLALNMESKGWHVSVYNRTVPGVEEGVVDRFMNGRAKGKNIEGFTDIKAFVESIATPRKIMMMVRAGSPVDELMDQLFPLLSPGDILIDGGNSNYEDTNRRVKLAESKGFLFVGSGVSGGEEGALNGASIMPGGSEKAWPEVKPVLQSIAAKAPDGTPCCQWVGPAGSGHFVKMIHNGIEYGDMQLIAEAYWVMKNLIDLTNEEMADVFARWNEGKLRSYLIEITSNILRHKDKSGGYLIDKILDAAGQKGTGKWSVINAMELGMPLGLIATAVFERSLSAQKELRHLASKQFLCKHTLPIYNKAELVKEIFSALYASKLVSYAQGFAVLQRASDSFGWNLDLASIARMWRGGCIIRSIFLNDIAAAFEAADKPKHLLLAPYFREEIKSLLPGWKNLVAEAMKEELPVPAFSSALNYFYSLTSDNLPANLVQAQRDYFGAHTFERKDELRGQFFHENWTGHGGETKSGTYNV

SEQ ID NO: 41723 - protein, 191 aa, Ostreococcus tauri
MWRRGQKLMALALQSRISAIFSLDIHPAARLGKGILIDHGTGVVIGETCVIGDSVSILQGVTLGGTGKASGDRHPKIESHVLIGAHSTVLGNIKVERGSMISAGSLVLKPVAPHTIVAGSPANVVGKVRDTKPSLAMDHHITPRAPTFCDDLEQAVRRQVDEERERWKGHDAQKIRSHVVSADEKRRRRRG

SEQ ID NO: 41724 - protein, 494 aa, Oryza sativa
MAMVVASVMWAYRWSHPRANGRLPPGSLGLPLLGETLQFFAPNTTCDISPFVKERLNRYGSIFKTSVVGRPVVVTADPEMNYYVFQQEGKLFESWYPDTFTEIFGRDNVGSLHGFMYKYLKSLVLRLYGQENLRAVLLDETDRACRTSLASWAAQPSVELKDSISAMIFDLTAKKLISYEPSKSSENLRKNFVAFIRGLISFPVDIPGTAYHECMKGRRNAMKVLKKMMRERMEEPGRQCEDFFDVLIEELGREKPVLTEGIALDLMFVLLFASFETTSLALTLGVRLLAENPTVLDALTEEHEAIVRGRKEGCDAAGLTWADYKSMTFTSQVTLEMVRLANIVPGIFRKALQDIEFKGYTIPAGWGVMDKVEITGGSKHFMAFGGGLRFCVGTDLSKAAWTPVRRRGAASHAQSEPTAAAAAGGSPSAPNAPVSLCSSRNFAVLISPLGETSCCRSPTPPRAAPPGYSPRRLTTTSIRRKTTPTCRGSPRRPT

SEQ ID NO: 41725 - protein, 291 aa, Gibberella zeae PH-1
MQFTNYSRPTAMTNVDTSLPPEPTGAAANFAAQHSEEHPLKLYGGWFCPFVQRSWITIHEKRIPHQYVEINPYKKEPHFLALNPRGLVPTLAVPFDVQGKEQKALFESNIVCEYLDEAFFDESKHGPRLLPTEPYEKARCRIWIDHISTRIIPAWYKLMQHTPDKAFSLEDAREELKGHIKSFVEEMDSEGPWFLGSTLSLVDICFAPWAKRLFLIDYYKEGGHGIPTTGEGEDGDVWNRWNKWYKAILKRDSVNETWSADERYIIAYKRYAEDTTNSEVGQATRSGKRLP

SEQ ID NO: 41726 - protein, 319 aa, Triticum aestivum
  misc_feature (85)..(85): Xaa can be any naturally occurring amino acid
  misc_feature (151)..(151): Xaa can be any naturally occurring amino acid
  misc_feature (215)..(215): Xaa can be any naturally occurring amino acid
  misc_feature (224)..(224): Xaa can be any naturally occurring amino acid
  misc_feature (230)..(230): Xaa can be any naturally occurring amino acid
  misc_feature (263)..(263): Xaa can be any naturally occurring amino acid
  misc_feature (273)..(273): Xaa can be any naturally occurring amino acid
MSAYCGKYKDELIQNAAYIGTPGKGILAADESTGTIGKRFASINVENVEDNRRALRELLFCTPGALQYLSGVILFEETLYQSTKXGKPFVDILKAGNVLPGIKVDKGTIELAGTNGETTTQGFDDLGKRCAKYYEAGARFAKWRAVLKIGXTEPSQLSIDQNAQGLAHYAIICQENGLVPIVEPEILVDGPHDIDRCAYVTEVVLAACYRALNDXHVLLEGTLXLKPNMXVTPGSDSKKVAPEVIAEYTVRTLQRTVPAAVPXIVFLSGGQSXEEEATLNLNAMNKLQTRKPWNLSFSFRAVPSQEHPQRPGSRAKTEN

SEQ ID NO: 41727 - protein, 386 aa, Gibberella zeae PH-1
MATQTMKAVNYQGPYKVTVEDVELPKLEHPDDVIVKVTTAAICGSDLHMYEGRTAAQPGITFGHENMGIVEQLGEGVTLLKKGDRVVMPFNVADGRCRNCEEGKTAFCTGVNPGFAGGAYGYVAMGPYRGGQAQYIRVPYADFNALKLPAGKEHEADFILLADIFPTGWHGVEISGFRSGESVAVFGAGPVGLMAAYSAVLRGASRVFVVDRVPERLQAAEKIGCTPIDFSKGDAVDLIIKANGGEEVDRSVDAVGYQAVGNSGDTEQPNIVLENMIRVTRPCGGLGIPGLYVPSDPGASDEASAKGMISLSFGKLFEKGLTIGTGQCNVKSYNRYLRDLIISGRAKPSFVVSHEINIDEAEVAYEKFDKRIDGYTKVLIHPNGGF

SEQ ID NO: 41728 - protein, 676 aa, Magnaporthe grisea 70-15
MSDAVATLIGLQAATGGTTIQDILNRTAPGLSFIPSFLRRWLQIDISAIIGLLSLIGAMSSGFHFLNHIGLKLYWTLTRFCTASVAVAASDRLNREVLSWISSTVLMRQGTRVLAARSEMVDDERYYYQRPKTIRDDCANETRRPVEYMPTFGTTWFWHRKRLFIVRCVRTHNHRGGAFSRDSPEEFFDAPTGEEPLVVMCFGRSVAPIKQFLNDCRDWGEAQRARYVTVRTCKKSYNGAHWDSTILRPTRPIQTVHFDEQVKKDLIADIINYLDPHTRDFYHQRGIPYRRGYLLHGPPGTGKTSLSLALASMFKLELYLLHVPSLANDGELESMFDELPPRCIILLEDIDAVGIPRRNELAARMTGLDDKDDDEDDEDEENGSGRGRSTLSGLLNVLDGVASQEGRIVFMTSNLADKLDPALVRPGRIDRKIFLGNINQESARLMFLRMYAESDDSQFADLGPAAEMEMSELSGQTTPAIISPGPPTSLDEKVNTVELEKVAAEFASHIPDDAVTPALIQGFLLSHRSDPLAARDGIQDFIKDEMLKLEEAREKALRARETKARKRKSKALAQLGALATLTAKTRAAVSTDSEEPVGNATVEALAKTATSGAAGGLGSPSDSKAAPGATEGAEAIKNDGSHTNHTEGAGKDTPSGKQSKAGEDGSIGNGTTEVGV

SEQ ID NO: 41729 - protein, 370 aa, Campylobacter upsaliensis RM3195
MKAYIYLENDVFLSARAFGCGGTFLGELVFNTSMSGYQEIISDPSYAGQFIVFSMSEIGIVGTNEDDDESKDIFASGIFVREFSSTFSNYRAKESLDTYLKKHQKIGICDIDTRFLVKLIRDSGNLRAIVSTEISNKEELKEKLLASKKIDEVNFVKEVSTKKSYKHEQGVWNGKTYNEPKKAKKKIAVIDYGVKRNILNELVNANLAVEVFPYNVKAQELITLFKKGEIHGIFLSNGPGEPKILKDEIAEIKKLAEAKVPMLGICLGHQLLSNAFGYETYKMKFGQHGANHPVINLENKKIEITAQNHNYNVPEELCEVAFITHRNLFGDNVEGVRYKDYPIISVQHHPESSSGPHESKYIFKEFANLL
